United States Patent 12,642,819 (COMPOSITIONS AND METHODS FOR TREATING INFLAMMATORY BOWEL DISEASE) - sequence listing, part 60

SEQ ID NO: 28 - DNA, 2180828 bp, Bifidobacterium pseudocatenulatum
  modified_base (381244)..(381342): a, c, t, g, unknown or other
  modified_base (1169837)..(1169934): a, c, t, g, unknown or other
  modified_base (1376982)..(1377078): a, c, t, g, unknown or other
  modified_base (2171481)..(2171639): a, c, t, g, unknown or other
  modified_base (2171977)..(2172014): a, c, t, g, unknown or other
  modified_base (2172305)..(2172532): a, c, t, g, unknown or other
  modified_base (2178553)..(2178581): a, c, t, g, unknown or other
tcagggtgttcaggaacaagtgccgacagtgaacacctttattcgatcacacacagctcgcccaaccgcgccagcgcatcctcatcgctgacgccgtcggccttggcaagaccttggaggctggcatcctgatggcggaactcatcaagcgccgcaagggccgccgtattctcgtggtaacggcgaaaagcatgatggttcagtttcagaaggagatgtgggagcgattcaccattccactgatcagtttggattcctcgcgtatccagcagattcgttccgagattcctgcgaatgccaatccattctcctattacgacaaggtgatcatctccatcgacacgttgaagcgtgacatccaatatggcgcggcgctcgatgcctcgtattgggacatcatcgtgatcgatgaggcccagaatgttgccgaccgtgccgtcaacggccgtagcgcacagcgtgccgagcttgccaaacgacttgcctcccgttccgacacgttgattatgctgtccgccacgcctcatgacggccgcgctcgcagtttcgcttcgttgatgaacatgcttgacccaaccactctgcccgatccggagcggtacgacaagaaggatgtcgaacacctgtacgttcgccgtttcaagaaggacgtgatggccgaagtgtcaggcagcttcccagaacgcaaggtgacgcaggagaaatgcatggccactgcagtcgaggaagaggcattcgattacttgactgatatgaaacttgtcatggacatgcatcagaagagaagcaattccttcctgttcaagacgatgcttgagaagagtctgttttcatcgccggcagcgtgcatcaagaccatcgacgagcgagtgaagcggcttgctaaaaaagatgcgtccgatcagaccggagacattgacgggcttgaagggctcaaggctgccttggagaagatcggtccgatgcagttttcccgataccagagactgctgcagcttctgcgcagtgccgattacggttggcataacggtgaagacgccgacgaccgtatcgtgattttcacggaacgcatcgagacgaagaactatctcgaggagcacttgcggcaggatctcaaactaccgaagaaggctatcgtctccatggatggaggcatgagcgatgtggaacagcagaaaatcgtcgaggatttcggtacgaagtcctcgtctgtacgtattctcgtggcctccgacgtggcctctgaaggtctgaacctgcactatctgagccacagactcatccatttcgacactccatggtcgttgatggtattccagcagcgtaacggacgcatcgaccgttatgggcagcgtaaacagcctgatattcgtttcatgatgattaactcgcgtaatgcaaagattcaaggtgacgcgcatattctcgagatcctgcagcagaaggaagaccaggcacgtaaggatatcggcgatccgtccttgctcatgggcaaattcgacgtcgatcaggaggaaaatttcacccgcgaagcgattgaatccggcgaatcagcggagaatttcgcagccagactttgtattcctgatgaggacatcgatcattcggacgaacgttccggagacgttgagactgtggcggatgacgatgttttcgatccattgagttttttcaacctcactacgccggatggttccgatactacgagcactgaggaaaacgagtccgcaggggagagcacggctgggagcgccgacgatggcggcatagtcgattcctctacgctgatgtcggattacgagtatgtggatgaggggctctcctgcgaagagttccggcagtcggctggtcttaaatcgaaacgtcagttgcgtgatgctcatggattcgcggtggagttccaaggggatagcccgttgcgcgcgtggctgcgcagacgtgtgccgaacacgcaggtgttgcgagataacatcgctgaatggagtgatgacgcgaaatactgcgaagaccaagccaacggtctgctggcccgtatcaacgacgagtcatggagtcgggtccaatacctgtgggaattgaatccaatcacggaatgggtcgggttgaaggcttcctcactgctgtaccaacgtgacgaggccccgattattggcgtgaccaacggaaacctgcatgcggatgagacgattatgctgatgaacggcatggtcgccaacaagcacgcatccccggtgatcgatgaatggttcggtgtacggtatctcgatggcgaatgcatgggcatactgccacttgaggaagtgtggcgtatcaccggatatcgtgggaacttgattccgggaaccactgaacgtcgttatgtgaatcgagaggattccgcggccagctccgaacagatagatgcggcacaactgctgttggaggatgcggtatcgcgcggcaagagcatgctcagcgattgcggtgaacaatatcgtgcgcaggcagatgaagaagtgactcggcaaatggaccgcatcgagcattggtcccatgcacgcaaggcactgttgcaatcccaaggcaaaaacaccaaggaaaatacaaaacaggttgatcggatgctcgaacaatatgccgactgggttcaggacacattggacgcctccggcgaaccagtgatccgcattgcggccgcattcgtaggtaaggaatagagggggagaccatggcgaaggaactgaacgagacattcccaggcatcgaggcggtcaacgacttctacacgccgtactacatgaaggaatattttccggatgaagtgaagaatgcctccgcaccttggaaacagcttcctcctgagaaacgcccagcgcgactgctgaaggacatgcgccagtcgttcaccgaagtcatcaacaacaacgagaacgatctgtttccagctgaacgggtacggaatttcatcgacggcatgctcgccgcactcggctatacgcaggaggggaatcaagccaaagacaagggattgcccgaccggatttcagggaagtctgttcctgtctactatcaggtcaatgattccgatggggctccgcgcttgcaagttctggtgagcctgtccgatagtgcggaggcaggcgttctggaaagccccatcgaagacggctctggcaaggacggcacctcctgtgaggaatatgcacgtatgctgcttgccgatttcgacgagccggcacggtggattcttcttatggggttgcatcagatagcgttgatcgaccgccgtaaatggaatgacaagaaatgcatgctgtttgacctggacgagatcttcagccgccatcaggatcatgtgtatacggcgatggctgtgctgttgcgtcgtgatagtctctgcccgaacaaaggtgacagtctgcttgacgcgtttgatgacacgtctgcgaagaacgcggttgaggtgtctgacaatctgcgttccgcgttacgtgaatgtgtggagatccttggcaacgaggtcatccacgactggacttgtaataaggggcgaagcatcgacgaaatcgacgcaggcgacctgactgtgcaggcgttacgctacatgtaccgtctgctgtttctcctgttcatcgaggcgaagccgtcgctcggctacgcgccgatgaaatccgacatctaccgtaccggctattcgctggatagtctgcgagatattgcagaacagatgcgtggtcgcatggatgaggctggcgattccacctatctagcggacacattgcgccgactcgacgatctggtgttcaacggttacccgaaggcggatgaggatttcaaggggctggttggcgaggaagccatcaatgcggtgttcatggttccgccgctcaaggcgcacattttcgatccggagcggaccgtgctgattgaacatgctgcactccgcgacagcgtaatgctgcgcatcatagacctgatgagcgtcaccaagactggtaagggagtcaaacgcaggcagcgcatctcctatgcggccctgggcatcagccagatgggtgccgtgtacgaggcattgctgtcctaccgtggttttatcgccaaggagaagctctacgaggtcaaacgcgccaaggattcctacgaccctttgaaagtcggctactttgtgccggaacgcgaactcgacaactattcggagagtgaacgcgtccgttacccggacaaaagcccgcatgccggcgagctacgcacctacgagccgggcacattcatctaccggcttgcaggtcgggaacgcgagacttcggcctccttctatacgcccgacagcctcgcgcaatgcctggtgaagtacgcgctcaaggagatcgagccacgtattcaccaagccaccgatattctgagtttgaaaatctgcgaaccggccatgggttccgcgaccttcctgaacgagaccatcaaccagctggccaccatgtatctgaaccgcagggagaaggagcgggtcgccgaggaaggccaacgggcggcgattcctgcggaacgccggcaggccgaactgcagaaggtcaagatgtacatcgccgaccacaacatctacggcatcgacctgaaccccgtggcggtggaacttggagaggtgtccctatggcttaacaccatctgtgaaggatccttcgtgccatggtttggcacccagctgcaatgcggcaattcactgatcggcggccgccgcgtcggataccttgagtcggatctggccagcacgaccaaaaaccgccactggtatgaggtcgagcccaagcatatcgggttcaaccagagctcgtcgtccgtcaagcgcgtctaccagttcctgaccggggacccagacatgtgcaagtacgacgacaaaatcgtcaaaagcatcgaatccgaacatctggaaaccatcaaggcttggaagaagaattttgccaagaagccttattcccagacggagattggcctgatgaggtcgttgtcaaagaccatcgacgaactatggcgcggccagatcaaagcgcgccagcaattggagaaggcgactcaagacgatctgattatctacgggtttgacgcgaacgcctccaaaaagaccgcgaaggctttggaaaaccagcagaagcatgggcagggctcgctcggcatcgaaaatgaatacttccgtggcaacaacctcaccatccgtgagaaggacgagatgcttcgcattgcctaccattcggagaaggccgagaacgccagcgaatacgctcgtttgaaacttgccatggactactggtgctcgctgtggttctggcccatcgaccaagcgaacctgctccccacaagatcgcagtacctcacggaaatgtcgctgatccttaccggcgagatcccgcaggaagaaggattcacgctgacatcgatggacaacggccagcctacgttcgatgatgccatggacgacagccacgagcgcgattacatgtatgaccatgccgtggatttgaacgagctatgcaaaggcgacggggaacccgcacaaaggcttcgcttggtgaagaaaattgccaagaagcagcgtttcttccattgggagctcgaatttgccgacgtgttcaaagacggcggtttcgacttcatggtcggcaacccgccgtgggtgaagcttcagtgggaggcggccaatgccatttccgacgtgaatccgaagtatgcggtccaatcgatcagcgcatccgatttgaacaagaaactacccgaattgttgaagaaccagcgcacgcatgacgcattcatcagcgaatatgtttcaacggccggtcagatgtcgttctacaacgccatcggcaattatccgctgctgcaaggccaacagacgaacctgttccgttgtttcctgccgaacgcttgggattacacgcgcaagcatgacggggtgagtgcgtttgtgcatccagacgaactgtatggtgacacgagagcgggcatactacgcgagcagatgtatcgcaggcttcggcaccatttccaattcatcaatgaaaggaaacttttcgccggtgtccataacgaaactatattcagtctgaacgtgtatcggaatccgaatacggattacaatcttccccgttttgattccatctggaacctctacgatcccaagaccatcgacgaatgctatgcgtccgatggctcgggagccgttcccggagtcaaaaacgaactaggcgaatggaatacgcgagggcacaagagccgtgtcatttccatctccaagggtgaactgtccatgttttcccgtctggttggcagcggcgaatcgagcggatggttacaagcgccaatggttggcatgcatgcgacggagttgctttctgcactggagaagatgtcggagattcctcgaacattgaggaactatgctgatgaaatcacatattcgggaatgtggcatgaaaccaattcccgtaaggatggcaccatcaaggatgacattcatttcccaacctcaacgaaagcgctaatctactccagcccatttataggtgtcacgaatccacttttacaagtggcgcgccaaaaatgtcaaactaatcgagattacgatccgattgacctgaccgacattccagcagactatatgcctcgcgtgaaatactcgcaggcatgcacggatgcggaatatgaggcgcgtgtgcaaaaaatggccgatccgaatcaagaagacggtgctgctggccgatttgatgccgtttataggctttgtaatcgcgaatacgtcgggcttagcagcgaaaggacactgcaggcgtcctgtgtgcacccaggcgtagcctgggtgcacaccatagcaggctatggtgttcacccagagcgctacgcgttgctcgcgctcatgagcggcctggaggccgccttgccttacgatttcttcgtacgctccgctggaaagccacacattaacagatccgtgctggaatctttaccagttccggcaagtgtcctcaatcctgagatccgtctccgtggtctactgctcaattgcctgaccaagccgtatgcgaatttgtggcaatcctgttgggacgagacgtacacgtccatgagctgggcgaaggatgatcctcgacttaccgccgatacgttcacctcattgacggacgagtgggactggcatacgccattgcgtacggactacgaacgccggcaggcattggtggagctggacgtactggcatccatggcgctcggcatcaccttggacgagctcattgacatctacggattgaccttcatggttcttaaccagtatgaagcggatacatggtatgacgccaacgggcgcgtggctttctcatccaaaaaagggtacgggaagctgaccttcgaccgtcccgatttcgaaagaatcaagaacgcgcctgcaggcaaagtattcactcgcaccatcacagacgacacccagccgggtggtccacgtgagcggaccatcgaatatgtggcgccgttcgacaaatgcaatcgcgtagaggattacaaaaccgcgtggaagttcttcacgcagaagtatggagatgccaaatgattcccatggtgcttgcacggcacatccagtccggactcgccgattacgtggagactacgttccccatgaccaatatgccgttccgtggctccatccgcaggctcgcacatcaggaaggcatgctttcccaggagccgttcgtatcagtcaaactgccgttccgagtggtcggcaaacacgcggaattcccgttcccatgcctgcacccctcgtaccggccatacgcgcaccagatgcgcgcattcaaacgcatcgccgccggcgaatccacactggtggccaccggcaccggctcaggcaagaccgaatgtttcctgtacccgatcctcgactactgctaccggcagcgtagacttggacgcaagggcatcaaggccatcctcgtctacccgatgaacgccctcgccaccgaccaggcgaaacgattggccgaactcatccacgacagtccggaactgcgcaacaatgtgaccgcgggcatgtatgtgggccagatgagccaaggcggcagcgacaaggacaatcatgccatgaccgccaccaacatcgtgaccagtcatgaggaactgctcaagaacccgccggacatcctgctcaccaactacaagatgctcgactacctgctggtgcgccccaaagactcccggatctgggacagcaatgatccggacacgctcaaatatttcgtcgtggacgaattgcacaccttcgacggcgcacagggcaccgacctagcctgcctgctgcgcaggctcaccgataggctgaacaccaccagcgacaacatgtgcttcgtcggcacgtcggccaccatgggcactgaagagacagtacgcgacgtctgcgcgtatgccaaccagatcttcaacaccacgttcacaccggaatccgtggtgactgaggatcgtcttcgcgtcgacgaattcttcgtcaccagcgactacgacgacaccatgcctactgccgcgcaagctgaccggctcatcgaactcgaagaggatgttgaccccagcgaatatcttgcccttgcggctcaagcatggcttgacgaagctcccacagagccaagctccacagataaggcacgcatccggctcgccgaatccctccgccattcaaggttcctggccagcctgtcctcgttcatctgcgacgaaccccagcaaatcgatcgcaaactgttggataggcttgccattatggacgcgaggttcaacgccttgtatccgcgtcagcagaaggcctgtgtggacgcgctgatagcgcttgtctcccacgcgcgcaccggttcggaaggccacacacgtccgttcctgaacgtgcaggtgcagctatgggtcaaggaactcggccgcgtggtcgccaacatcacctcgcaggaggggagcatcgactaccgtccggtcgtcgaactgtccaaagacgacctcaagacccgcatgccggtgattaactgccgtgattgcggaggaaccgcatggattggacttgccggcaaagacggcggcatcagcatgggtgacccacgaacgttctacaacgagtatttcgcctaccatgccgacaatgcgttggtgaccttgcaaccctgcaccatggattatgttcttgacccgcatgccgacaacggagccatggtctggttctgcaatgcatgcatgaaggaacaggccgtagaacgtttcgaatccacggaacatgaatgcccggcctgtggagagcggcgcatacccatggtcgctaggggtatggagcttgtatccggcaaccgcaagcactatcggtgtccgttctgcggcagcgaacaggacattgccatggtcggtgtgagaaccaccacgcaggtcagtgtgatgctcacccaactttccggagactccttcaacgacgacagcaaggccatcgtgttctccgacagtgtgcaggacgcctcctaccgagccagcgtgttcaactcccgcacctggcgattcgccctgcgcaactccgccatggactacatgcgcgaggaacacaaggacggcgtttccctcgccgaatatctcaacagccagaacgactactaccatcgccgctatccggacgacaacgaatacatcgtgcgattcatcgcgccgaacatgacatggatgcgcgaatacgaagccgtattgcaaggcaatcccgcagggcccggccggcgtcagctgctcgattggatcgagcgcagactccgactggaatcgctgctggaattcggcatgcgctcccgtaccggacgtacgttggagaaatccggctgcgccgcaatagcattcgaccagattctcctgaaacgtgtggcacagaccgttgccgaacgttgccataacgagatcggattgcacgagaattccatcatggagactgactggctccgactgattatggcgttcctcgaccagctgcgcacgaaaggcgcgttcttcgacgtgacctatgaccagttcctgcaaaacgacggcaacaagttcctgctttccaacacgaacatcaaatggatgcccggcatgtacgcggatggtatgccctatttcctgtcggacaaggagccagtgcgcaaaggcgttttcaataccctgaattcgccggcataccgtcagatcgtcgaccggtacctcaccgacggcgcccttgaaggcgacatccaccacgagctgttgggaatcgtgctcgaagagtgcatagcagcaggattcatcacgcagcaacgttatccaagcatgaaaatggaacgcaccgtgtacgggctcaacgagtccggttgcatggtcagtggcaaggtaacgcagttgatctgcgacacgtgtggacggagctattcgtgcgctacgcagaaccttgacgcgtggaacggagcacgttgccgtatccgcaaatgcccgggcagactggtctccggcactcccgaagccgaagccctggaattgcgctactatggcaagctgtactgcggggagccagccgatcgcatccacgctgccgaacacacggggctgctcaatggcgatgaccgtgccaaggtcgaagaggaattcaagcgcaagaaccgcaagcccggcgacgtgaatgtgctcgcctgtacgccgaccctggagatgggcatcgatatcggagacctctccacagtgattctctcgtcaattccgcctacccaagcccagtacatccaacgtgccggtcgtgcagggcgacgtgacggcaactccttggtgctggcggtggccaataccaaggaacacgacacgtacttctaccagcgtccgaaagatatgcttggaggcgcggtgaacccgccgcacatcttcctcgacgcgaccgcagtgttggagcgtcagctcaccgcctacgcattggatcgttgggtgcatgccatgctggatgccggcagcgaaccggccgatgtggtacccgacaaattgaaaaactgtttggataatgtcaacggcagcggctccagcgggttcccggtgaatttcctgaactggacaggccaacattctggcgaactgctcgacggattcggaagaatgttctcattctccgaggaactccgaacgcagctcgacggattcgtacgcggtacggaagatggcagcaccatggccagacgcgtctacgatgtgttccaaaaaaccaacgataccgtcagaacgctggaatcgcagaagagcgctgcgaggcagttgctcgacgagctcaagaagaagccctccgactcatcgttcgaagagcagcagcgcgaatgcgaagatgagattcacaatcttggccgcatcgtcacaagcattctcaacaccaacacgttcaactacctttccgacgaaggtatcctgcccaattatgcgttcccggaaaccggtgtgaccctccacaccatcctcaaagaggacaaggaaccgtccgatgcggcacacggaatcgagcctgccgcgcaggacaagacgaaacgcaaggggaaggccacgcgtgatttcgtacgcccggcggccacggccatcacggaactggcgccgggaaacacgttcttcgcgggcggacgcaaatacaaaatcagccgcgtgctatgttcgaaaggcggtgccgacgacgaactggcaatgtggcgcctatgcccgaactgttcgcacgcggaacccgcctccagcaccgagaacctcgccagctgtccctcctgtgggtcaatgcagtgggccgataacggccagaaaaggccgatgctgcgcatcgacaccgtcatatccgatgagacctacagcgaaagcctgattgaggacacctccgacagcagacccaagacccagttcctgaagaatacgatggtggacattgatccggcagacatccaatcgggatggcagttcaagggaatcacgaacttcggattcgactacacgccgcagggcacagtccgtgaaatcaacttcggacaggtttctgataggggagcctcggtggaaatcgccggtagcaaggagatacgtaacggtttcaacgtgtgcctgaaatgcggcgcgttgctcggcgagcgcgaatcacggcacgcctacttctgtccggaacgcaagaaggcgcaggaacagcagttggagcaatcggagcggaacggcacgtgcctgttcctataccgtgaggttaaatcggaagtgctgcgtatgctcgtgccagggcttgccgatgcccaaggtgcggacggtgctgcggagtcattgaccgccgcagtgatgcttgggctgcgtgaacgcttcggcaacgtggaacatctacaggcgacactcatgaacgagccgttgccggataactccggactgcgcaaaacctatcttgctctatatgacacagtgcccggaggaactggctatcttaagcagctgtccgatccggatacgatgttcgaggtgttttccagggcaaaggaagtcatggagcattgcgaatgtgcaaagaacggcggcgacgggtgctacagatgcctgtatgcatacagacaaagccaggacctgaaacttatttcccgtaagaccgcgctggcgatgctcacgggcatcctcgacctggccaacaaacgcagtcgtgtgacaaccgtttcgaagatcaacacgaacaaactgttcgacagtggactcgaacagcagttcatcgaagctctccggtgcatgcatgcccatcccttcgcggaatccgacgatgccaagggacgtcgtgccatcgtcaaggacgaattcatcaatagcaaacctggatattccatcaccgtgaacggaagcgtgtggagcgtcgagccacaagtcgcgttggggccggccgatggggtcgcgattccctgcaagcctgatttcgtgctgacggtcagcaatatcgatgaatctggtgacgtggttgagcatgacggaaggaagccggttgccatcttcaccgatggcctgcaataccatgcaggcatcgtcgcccaggattccctgaagagggaagcgcttcgtcaggcaggctatcgcatatggtccttggattatgacgatgtgatcggatatgtgcagggcaaggatgtggcgcagctcgccgatccgatgctggcacccaagtccatgccgtctccggtggcttacaagagcacgattggcaagaggactgacgaattcaaccccagcgaagtttcggcaatggccatgctggaatattatctcgcggaaccggatgccgaacggatattcgccatccaagcgctggcaatgagctatgctctgaatccgcgaaacaagaacgttgaacctcaggccgtggatatgctgcatcggaatgaagcgttgcacggcgagaacgaatcgacattcatgatttgctcgtcctggaatccttcgaactgcacgagactgaaattccaatccggtttgtgcattggagaggatatgcggaccaccgaaccccacgtcggcatggtgttctcggacattcaacgtgatgccgcgaaagcaaagaacgatgattataatccgttggacgctttggacgagaacgaggcagaggcgttcaaaacgcagtgggcagccttctggcattttgcgaacgtgatgcaattctcggaatacttccatgctatcggtgatgctgcgctacgtgacgaatccatgtacgagccgcttcgcaacggcctgcggaacgctcctgatctgcagaaagacaatgattccgaatggaacgatattctggcggatccgacctacgtgtattgcgcggatgaaaccaaggaggccgtcaaacggtttattgagtctgacataccggcaccggatgcactcggatatgagctgctggacgagaacgaggaaatcattgcgcaggcagagctcgcatgggaggatgggaagatcgtgtttttcccgtcctacgacttgcaatccgaccgagagaacgccgacgaattcgtcaagcgcggctggactatcattacggaaaacaacgatgaccttgacaaggtgttcgcttcactgacggaaggcatggaacgctgatggcagatatacgtacgatgaacaaacccgtggtcgcgctcggcagcgatctcatgcgcagcctgctcgagctgcctaagaaagcgcagaaacatgccacgacgtttctgacaaaattccaggcgaatcctcgatcatccggaatcaatctggaacgaatcgccaatgcggcggacgaaaaactgtattccgcgcgcatcgaccagcgatatcgcgccatcatcgctttccagaaaagcagcaacgtgtacgttttgctgtacgttggagaccacgatgacgcttacaaatgggcggaaacaaagcgaatcagcgtcaacccgaatacgagggccatccagctgtacgatatggctcctcaagaggaaatcgacgcagcgatgcatgaggattcccaaaacaaagttggatggggaagcgttgccgcaaacgcgccccaatcagattccgctgcgtcggaatctgttccccagcccacggaagaccataccggcacgaatcacggaatagcttcagctattgcaacttcagctgtgacggacaagacgccgcagatgccacagcaagctcccgaacctcataccggtccgcttccagacacttatcgggcattgacagataatgacatgcgccggttcggcgtacctgacatgtatgtgccagtcatgtgcacgagaaagacgtgggaagcgtttgaacggtggggggccaggctcccaaaggatgctttcacgtaccttaccttcgttgctgaaggacttcccaagtccgaggtcttcggactgctcgatgaaaccgaaggcaagaccagcgacaggctggggctggagcagcagatgtctgcctcgtccatcgaatctggtgaagaggccgatccggaggacttccgtgccgccctgtcaagctatgcgtcgcagcagtctttcgtggtcgtgcagggagaagcggatctcaaacgtattctggatgcgccgctggaacagtggcgtgtgttcctgcatccatcgcagcgtctttatgtggaacatgattaccatggtccgttccgcctgctcggcggtgccggtacgggaaagaccgtggtggccatgcatcgcgcgaaacgtctcgctgcaagactgctgagaagcggtagccgtcagaaagtgctgttcaccacatactcgcgtaatcttgccaccgatattgcatcgaacctgaaactcatctgcacgccagacgaattcaataccatcgacgtggtcaatctcgacaagctcgtaaaagatctgctgacggggcatggctattccggtgagatttggtatgacggcagccccgaccatggcaatgatcttgacgctgcgtggcgtaaagccatcacgtccatcggcgtgaacgattcgaaactcacggtttccttcttcaaaagcgagctcagccaggtgattgtgccgcagcaggtgcggaatgcagccgattacatgcgcgtactacgcaaggggcgcggcacgaaactaaaccgagcgcagaagctcgccgtctggaaggtcgtggaaacgtatcggcgcatcatgcaggcgaacgacgcgtacgatgtggacacggccatgcagaacgtcgtgtcgttgctcacgcagggtgatatgccaaggaaatatgcgcatgtggtggtcgatgaagggcaggacttctccacgccggcataccgtgtgattcgtgctctggtggatgagggagacgatgatatcttcatcgtcggcgatgcacagcagcgcatctacgggcatatcgcggtgttatcgaaatgcggcatccgaatccaggggcgtgcccgcaaattgcggatcaactatcgcaccaccgaacagattcgtagcgcagccgactccattttccgtagttccggcgccgatgtcgcggattcagtgttcgcggctgttcatggtatcgaagatgcttcgccggccacaacgttcgatgacctggacggaggggagagtccgaccggcgatagcagatcgttgatgagcggtcccgttcccgaagcgcggcggtttgcatcccagtcagatgagatggatgccgttagggaatggatttatggattgtgcggcacggcggaagacgcggccagcgatgagtccgacggcgggcgtgtggatccgcgtaatgtgtgtgtggtagcaagaagtcgctactgcatcgaccagtggtataagacgcttgatgacggcttgccgtatggcgtgtaccggcttggtagggatgcagaaaacaggcaaaggcaaggaattcgcatcgccaccatgcatcgagtcaaaggtctggaattcgactatgtggtggtagtcgacgtgaacgatggtgtatgcccgccgaagcctgcgctgcaatctgccggtgccgatccggctgcgttgaatgatatctacagggaggaacgaagtctcatttatgtggctatgacacgtgccaaaaagggtgtgctgctgactggcgtctcggcgcatgtgaggtaagggaagaggagcaccatggacgctggaaagaaaatcctgctggacttattgaccggttcgcttcggttcgtggttccggtgtatcagcgcagatactcatggggcgaggcgcagtgccggcaattgtgggccgacattgtaacggctggtaggcatcctgagagaacgcatttcaccgggtcagtcgtatggatgcaggaaggcggcatcggcccggatggtgtcagccggtgtctgctcatcgacggccagcagcgccttacctcggtgaccctgctgcttatcgcactggccgaatatgctcgagcgcgccctgaaaacctgcgattctccgcagacatgcgcatcgaccgtggctattttgtcgacaagtatgcaaccggcgaaggccgctacaagctgacgctttctgacgacgatagggaagtgctgcacagcatgtgcgaccatgtggtcgcccctgatcggccgaaccatgccaatacgggttcccggctggaagcaaatcttgatttgttccgttcgctggtcgccgcaatcgatgatgcgaacgtggtgtggaacggtctgcagcgtctcgaagtcgtgtctgtcaccttggaccaagatcgtgacgaaccgcaactggtattcgaatcaatgaattccaccgggcttgatctggagacttccgacctggtacgcaactacatgctcatggggtgttccatggccgagcagaaaaccttatacgaagactattggctgcccatggaacgtgttctcggcaacctctcattcgatgcgttcctgcacgactggatggtcgttacattgaaaaaacccgtgctcaaaggccgcgttatgtacgcggaatttaaacgtttcgcggctgacagttccttgctgcgcatggaacgtacgcgtaatcttctggcgaacatgctggaatacgccaaatactatgccgctatcaagggcgttgccgccgctggcagcggcgatatgaacgtggaccgccgtctcgaatcaattcaaaaactgggcagcacggttacggacccgttggttatgtacatgttcgcggcatggaagcgtgatcgcgtaagttgtgatggactgctgcgcatgcttgcggatcttgaatcgtacctgttccgcagaatgatctgctcggtatccagcaacggattgaacaagctcgttccgtcgctgatcgtcagacttgattcggctgaagatgatttggccgaaaccttcgccgcactactcatcaccgagactgccaaagccacacgcatgcctacggacagtaaattcagacaggcgttgctcggtgagaacctgtaccggccggcctggcgatgcaagtatctgcttgccggcttggagaactataaccaccccaaggatccgcggtccttcagcgaatacaccatcgaacacatcatgccgcagaacgccatggcgcacgccgaatggtgcaatatgctcgcaaacctcgaccgattcccgctattggtgaacagtctgggtaatctgacgctgaccgcatacaattcggagctttccgacggaacgttcgaacagaagaagaaccgtgcggtcggcggatacgatagcgaatacctatccatttccgcggaactgcacgatgcttcgcaatggaacgaacaggcgatcgcgcagcgaggcacccgacttgccgatctcgcattgcaggtgtgggcacgccccacagcggggaatgaggttatgcagactctgcgcaatcggaacgtgaaccagggggaacgcgaacagaatgccgttgatttcgctgatttgtgcaaacgcggagtcctcgcggccggagatgtgctggaaagccgatacgctggcgtaaccgccacggctaccgtaaccaaagaccatcgcatccgcttggccaacggcgagatattcgacagtccatccggcgcatttcgccgtgccagaatgctcgaaaccggcgaggataagcaggtcaacgggtggacagtgtggaaagtcgcggacggcagaactttgaacgaattgcggtaagtcggcagtaatatctcgctgcggcgtagtttctggaatggattgtacgaatatgccgcaacacgggctgattttgtcgacgtgtatggcgatccatccggccgtaagacaaacatcgacacatggacgagtttcggcgtgggttcggaaatctgccacccagaggggacactgaatatccgtggcggctatattacggtcgacctgtacttcaccgacacgttccagtacgcgaagctctacaccatgagggattccgttgaacggatactggcaaatctgggcgaggtgatgtgggacgagccggaagccgacaagaaaaactggcatctttgggtgcgtcgtgatgtggatttctccggtgacatgacggaagcctaccggtggatgacggacgggctgctcgccatgcgcaatgtgtatgagctgctcggctgatgttttggccgtttcgactgctgtgcgttcaatgcttcatacaatgaacgtagtcatccgaaaagaggccgccatgaaatatgggatgagaaaacctaactggaacatctacgacgccgaaacgaacgacatggccacgaaaatccacaacaaccaatacacggtgaactgacggaaacgattgtagccggcgccgcctagcatgcaatacgggaaacgacgccggccacaacgaccggccaagacggacggaacacacgaaaaggcgaatcaaacacagcatgggcaagaacggcacgcaaccaacaacgaaaaacgtcacaccagcagtcacaccatggggtaagaaccgtgtgaagaacaccgaaaccggcaagcacgtgctcatcatgccaggcattggatacaccgtagaccgaccgctgctgtactgggcagcgcaggcgcttgcggccaacggatggttcgtggaccggctcgacctgaaactgacggaaagcgtcgagtttccggaaatgatcgcctgcatggaacgcgtggtcgacgaatggcacaaagcggcgctcgaacatgctgccgaatcgggtgaggagccgcatttgctggtcgtcaccaaatcgctctccacactctcatatccgcattccgcaaagctaggattgcgcgtggtgttgctcaccccggtgctcaatccgccgccattcgacaggcacaagtcggtcattcccgcgccgctgccgggaactgccggcagcccgatgccgctaatctgcgcgggtgacgccgacccatactacgatgacgccaaagcgcatctgctcaccgaccatgtgcgcacgtacgctggtgccaaccattccatcgaagtgccggacgattggcagacgtcgctcgactacctgaaacaggtcacgcaagccatcgtcgactacgccggctgaaaagaccgggacggactatgcgcatcgtattgcagaaggtcggcgaaggatccgtcgacgtggtcgacgagacaagcggagaagtcgacaccacattcgaaccacagcatataggcatcggctatgtgctgctcgtcggagtggaagacacggacggagcggagcaaatcgactggcttgcccgcaaaatcgccaatctacgcgtcttcgaagacgagaacggcaaaatgaaccgttccatccacgacgtgaacggcagtgtgctgtccatctcccaattcacgctatacgcgaacgtgcgcaaaggcaaccgcccaagcttcgtgaaagccggagcgcccgcgcacgccgaacagacatggcacggattcaacgacgccctgcgcgtgcaaggactcgaagtaaaagaaggacgattcggctcccacatgcgcgtgcggctcgccaacgacggtccggtcaccatcatccttgacaccgacgaactcggcgtctgacccagaaccccaacgtgaaaccctatatccgacgattgtcatagggtaaaacgcatgggaatatggaacgaccgcaaattgatcgtcaactgcctgccgttgaccgaatccgaacgtgcgcaattcatacgtgctgcgaaagacataccacaggaattcgtcggcgattcgacccaacggggaagcatgagctggaccgccgcagtaccggaggaactcaaagccaaagccaccgcggtcatcggcaacatcgcgcccgaggaatgcgcgcaatgccccaaactcgaatggcttcaaacttggagcgccggcgtcgacaaataccagcgacccggcatcctgcagcccggatccatgctcaccaatgccaccggagcctacggacaaagcgtctccgaacacatgttcgccatgatgtgggccatcatgaagaacctgcacatctacgcggcaagcaacccgaatgccatgtggcaggacgcaggacgagccatcagccccaacggaaaaacggcgctcgtcatcggaaccggcgacatcggatcacacttcgcacgactctgcaaaaacgtcggaatgacaaccatcggcattcgccgtaatcccgccgtcgaagcgccgggcgtcgatcatatagtcggtttcgattctctcgacgacgtgctgcaatacgccgatgtgatcgccatgagcgtgccatctacttcgacaacgcgccatctgctcaatgcggaacgcatcgcatctctcaaacctgacgccatcatcatcaacgcgggccgcggcaacgccattgaaagtcaggcgcttgccgacgcgctcgcggaaggacgaatccgtggtgccgcgctcgatgtgaccgaaccggaaccgctgccggccaactcgccgctgtggtgcgagccgaaatgcctcatcaccccacatgtggcgggaggcaaccatcttgagatcaccgaacgcagtatcatctccattgcattaggcaacgtccgctgctacgccaacggtcagtcgctcgacaatcgcatgcccatcaaaagctgacggtcgcgcgtgcggggagacccgtatgatggcagtcgggaagaaaggaaagggtatgacattgaacaaatggcgtcgtgcgacggaatggttcatgacggcattggcgttggtgttcctgttcgcgtattcgtgggaagttctggcgaggacgcatatcctgttgtgtgaaatggtgatcaacatcatctggatggtgttcatcgccgactgcgtcgtttcgatcctgctggcagaagataagaaaacttggttcaaagacaatctgctgatgctggtgtccatcgcattgcccgtcttcaggccgttgagactgctgcgtctggtggcagtgctcaacgtgctcaatcgtaccggtggcatggcggtgcgtgggcgcatcacactgtacacatgctgcagcgtgacactactgatgtatatcggcgcccttgccgaattggatgtggaacgtggggttccgggcgcttccatcaccgatttcggtgaagcgatatggtggtcgttcgtgaccgtcaccacagtcggctatggcgatttgtctccggtgacatggcagggaagatgcatcgccatcggactgatgataaccggcgttgccctgatcggcatcgtcaccgcgacgctggcttcatggattgtcgaccgtgttcgtgacgagaccgacaagcgtgcggatgaggcggaatcggaaacggaacagttacgccacaatgtgcgggaactgacggacaccgtcaaccagctgcgcgatgatatcgcgcagctgcacaggttatagcggttctcatgcctgcaccggtattatcggtcggttccacggtcaacgcgacggtatctgtgggcgtgctcgaagccgccaccgattacaagggtcagcgctcgctgccgcgcgacttctccatagaactgaagcagggctccatcaccaaccagcgtagatcgggccgctgctggaatccgaaccggtggaactcgatccatggcagccgctcaccaagcgttgccgctgatataacctgtatggagcgaagccgtggctgggattgcagccacggctttcctgttccgctgtgctgatactctttcataagaacaaatgtgcgaacgattggggttcagttggcggatactttgtcatggctttctgacgaactacgcagcgaatgcagtcagcctgtattgcagcgtgcccgtggaatcgccaaccagtggcgtgcgaaaatgtcggatctgcattgcctgaacgactccgattccgatcgcatcaccctgcatgccaatatgcggggcaccacctcaccgtccagccgatacgaagtgcaggccacgcttgatttgcatgatgagcttttcttggccaggtattgctcgtgccccgcgttcaacggttcgcagcacggttatggcacgtattcgtcggcatattcgcccagctaccgcaacaatccaaaatatcgcagtttcgatgatgatgacgatgaatacgattatgtcgatgattatgatgatttcggttcaggatcgacgttcggccatgtgcaggacgatgacgagttcgattcggagccggctggggggcaccgctataccggcatgtgcaagcatgtcgccgcaatgctgctgctgtttcttgaccagcccgaacggttccgcggattcaagcgaagtgacgtgacctcgcctatcctctccgactacatgcgtgcgctggatgcgaagaatgacaataccggtcaaagcgcgcagcttgacgtgctcaagcgcatcgtcgacgcgaaaagccgtctcgccgacgagcaacgaggcgtcattacgcaaggggccacgaaaacaaaacgcaagagcggttccatcatagtgaaaccgggaagcgtgcgtctggagcccacgctgatcatgaaccgtgagctgtggagcctgacgttgaaaatcggctgcggcgacgcaagttatatcatcaaaagcatttccaaattcgtagccgacatgcgcagcggcgcatacgtgtcgtatgggcagaaactttcgttcacccatactccggatatgctcgaaccgttctctctgcagctgttccgattcctggaaggcgttgttggttcacgtgccgcagcgcaactgcagaacaactactattacgcgccagacgtgcgcatcgaacgtgaaatcatgctcaccgatggagaattgtgcgatctgctgaatctgttcaaggcggaatcgcaacaggactacatcgaagacgtgctgatagcacgtgggctggtggaaacgcccaaatatgaggaacgtgagagggcacggcagctgactccggatgatttcactcgtacggatgacactgccccgaactatgtcgatgtaaccacgcctggtgaatccggatcgcgtaccatcgccatgttcgacggcaatccgcaattccgatttgctgccgaatatgtgaaggaaggcgcgtcgtcgggcgtgcgtatcacgccgaaccgcgttatcacggatcggattgtcgggcagcgaggcgcgtaccttatgagcgccgagcataacgtcaatccatcgaacccccatatggtgcctgtcagtggattcttccgctgtgctgacagcattcttcccgcagtggacgcgttgatgacattgtgtgcgtcagacagcactgacggcgtatttattgcgaaaaacgactggcccatattcgcccgaaccatactgccgaagcttactgaagctgacatcggtttcgacattccacaggaagtcgccgaacagatgggagccgactgccaaatcgaattctacttggaccgtgatctgcagggcatcacctgcgaggctgtggcacgatacggcgatttcgtattccagctggtgccgaccgccaaagcgttacgaggcgtgatcaaccctgactcgcggtcgaaggcggcgctcgtcaaacgagatacggcgcgtgaatcattcgcggtgcaggtgatacgtcaattgttccccacttggagttccattgatgtggcgcgcgtgcgtgaggaagacgagcagacgattctgctgttgctcaccgaaggcgtggatatcttgcgctcggtcgggcaagtgttctccacggccgcgttcgacggcatgttgatgcctggcagtcctacggtgaaggttggactgtccatcgactcgaacttggttgaaatctcgccgatcgccaacgaagtgccgatgaacgaggtcggcgcgctactgaattcctaccgaaggaaccgtcgctaccaccggttgaaggatggtacgttcgttgatctgaagaacgccgatctgcgcgagatcgatcagatcgcaacggatcttgaccttaatgagaagcagcttgattccggaagaatcaccattcccggatatcaggcgttcctcttggacgcgcaggttgacgacgatggcaaaagtgaatcgttcgtcgactacgtcaacgatgtgaaaatcatcgattcgaagcgatatgaagtacccagcaatctcaaaaacgtgttgcgtccgtaccaagtggagggcttccaatggctttccaccttgtgggacaaaggcttcggcggcattctcgccgacgaaatgggtttgggcaaatccgtgcaattgctgtcgctggtggaagctcgcaagggcagtggtcccgcgttgatcgtctgcccggcgtccttggtatacaactgggccgccgaatgcgaaaaattcacgcaagatctgaccatcgaagtcgtggccggcacgaaagcgcaacggcgcaagctcatcgcagccgtggcacagcaatggaagaacccctcggaatccaacgatatgcagcgtaccgatgtggtgatcacctcatacgatttattgcgccgcgacgtggatgattacgccgcctgccggttcgcattgatggcgctcgacgaggcgcaatacatcaaaaaccatgccacgaagttggcgaaagccgtcaaacagatcaccgccgaacaccggttcgcattgacgggaacccccatcgaaaaccggttgagcgaactgtggagcatcttcgacttcctcatgcccggattgctgggaacctacacgaagttccgagaaaaatacgaacagccgatcatggcacccggttctgaacattccgtcatggctgacaaactgcaggctttggtcggactgttcattaagcgacgtctgaaaaaagacgtgctgaccgatttacctgacaagttcgaaaacgtgctcaccgtcaaactggaaggcgaacagcgcaaactctatgcggcgcacgagcaacggttgcgcgccacccttaccaaaaccaaggacgccgacttcaatacgaagaagattcgaatccttgcggaattcacactgttgcgcgaaatctgttgcgatccgagactcgtctatgcggatgcgaaaaacgcttccgccaaacttgacgccatctgcgaactcgtatccacgtgcatggacgaaagcaagaaagtgcttgtattctcgcagttcacttcattccttgacctgattggtacacgtttggctgaacagggcgtggacttctacaccatcaccggcgagacaccgaagaaacgccgtgtggaactggtggacgaattcaatggcaacgatgttcccgtgttcctcatctcgctcaaagcgggcaatacggggctgaaccttgtgggtgcgtccgtagtggtgcacgccgacccgtggtggaacgcggccgcgcagaaccaggccaccgatcgtgcgcaccgcatcggacagacgcaggatgtgaacgtgtaccaaatcgtagccaaagacaccatcgaggaacgcatcctcaaactgcaggagaagaaaagcgagcttgcccaacagttcaccgacggcaccgcatctggaggcgtcggcacactcagcaaagacgacttgctcgacctgctggcataacaatcaacgtacctgccgcttgcttgaacgcacacgatacgaaagcaacaggcaaagcgcacactgcggcaacacaccatgaggcgacgttcatgccataggcaaaaggcatatgaggccaagatcatggtttccggattaaagattgatgcctgctgataatagacgccagtgagacgcggtttgcatatttccgacgataggcgtatatataatcgtgcaagtttcagggaaggtgaaaatccttactggcggtaacggtacgactgacgttcataacggtcccatgccgaagcccgcgacccgcgaaagcggctgatccggtgagaatccggagccaacggtcaaagtccggatggaagaaacggggctcaacatgagtgtatcctcaccaaacaatacccaaaacaacgacgccgaaatcaccagcgaaagcatgacgcgccccgacaacgcgcattccacaggcgtggccgactctggacgctggtccaccaaacgcatcgccatgtatgcgctgttcgtggcgctgtcgatggccgtcagctttgtggaatttcccattgtgccaggcgtggaatggctgaaatatgatccatccggcattgtcagcctggtggcaggtttcgcctacgggccagcggcggcggtaatcgtcagcgtgcttggtttcctgccgcacctgttcaccaacccatggggcacgcttatggccgtgctcgtggctttggcattatccgtgccggcagcactgatctaccgcaggaacaagacccgcaaaggcgcggtcatcggcatcatcgtcggtgcgatcgcagccttggcgatggcgattgtgggcaatataatcgtcacaccgttctacgcgcatatgaccaccgcacaggtcgtggcattgatcgtgccggcgcttctgccgttcaacgcgttgaaattcaccatccatggcgtggtcaccttcctgatctacaagccgatctccaacctgttgaaccgctgagcctcgttcaccatatcgattccgcatattgatgaataggaaggaacctttcgacgtatggaaggttcctttcgtttatgaaagactttttccatgaatcctgacagcgccacgaacaccatcgcggtcgaactgcacgatattcgtttcacctacgactccggcgcgacctgggcgctcgacggcgtgaacctgaccgttcgccaaggcgaacgtgtatgcttggcaggaccaaacggatcgggcaaatccacactttcacgcatcatcgcaggacttgccgcacccgatgccggacatgtcacgttgttgggaaacaacgtattcgatgactccggcgcgcacgctgatgcttaccgcagcgcccggcatggtatcggggcggttttccaacatccggaagatcagatcgttaccaccgtcaccgaggatgatgttgccttcggtccggaaaacctcgccattgcgcatgatgatatcgatatgcgcatcgccatgtcacttgacgcagtcgacatgagcggacaacgagaagccgatcccacgcgaatgagcggaggccaacagcagcgcgtcgccatcgccggcatgcttgccatgaatcccgaaatcctcgtgctcgacgagcctaccgccatgctcgatccgcaaggccgtgccgacatcatgcatgttcttgacgaattgcagcagcacggcacaaccatcattctcgtcacccaccatcgtgacgaattcgtcaatgccgaccgcatcattcgcctggataacgggcgtatcgtgcaaagcgctcgcggtaatactgcaagtattccggaaatggacgaatcaggcacagcgcaagaagacaacccaattgccaaatccaatattgcaaatggcgcatcgaagccaacatcagctgtaccaatcattgaaatccataatctgatatatcaatatccaaacagtagcaagcctgtgctcgataagctttccataaccatcaatgagggtgaaaccgtggccatcacagggcataacggtgcaggcaaaaccaccctcgcgcgtcttctctgcgcgctggaacagccgcaatctggcagcattaccgtcaacaccattcccgtcgcacgccaacgcgccaacggcaatatgcagtcgctcaagcgtgcggaccgcgagaaactgcgcgccaccatcggctacgtcatgcagcaccccgaacgtcagcttttcgccgaaaccgtagccgaggacgtcgcctacggtccgcgcaaccaacggcttgatgaagcgcaagtggatgaacatgtcagccaagccatggcattgctgcatattgaacatcttgccgaccgttcgccattcgacctttccggcgggcagcaacgactcgttgccatagcgggcgtcatcgcatgccaaccgcggattctcattatggacgagccgaccgcgggacttgatgaagcggccacaacccgcgtgcacaatctcatccaaaccctccacgcacaaggcatcaccatactcatcatttcccattcgcaagcggaaatcgacgtacttgccgaccggacgatcgcgcttgacgctgaccggaacgttggtggaaaagttcgtgatgccgagcctggttctgctgtcgaatcggcaggttcgaagaatctgcacacgcttggctccggacatgcaaagggagacgtccgtgaaaaccgcagttttatggaacggcttgacccgcgcgtgaagatggtgggcgcgttggcggtcatgttctccgcattcgccatccgctctttctggcagctgctcgtggccgcactgttgaccggcatgatcgttgcgacatcaggcatcggcgtgaaacaactgttcaaatcgattcacatgttccttgcattgttcgtgttctgcggactgctcaatgtgttcttcgtacaatccggcaatgttcttacgaacatcggaccgattccaatcaccgacgacggtgtgcgtatcgctatactgtacgcctgcagattcgttgcggtcattatcgtcggagtggtgttcctcgccaccaccacgcctacggccatcaccgacgcgttcgaagccttgctcaaacccttcgcaaaaataggcgtgcacgcgcaggagatcgcactggtgatgagcctcgcactgcggttcctgcccactctgggaagcgaggcgaaagccattgcggacgcacaggcggctcgaggtggcagcatcgaaacgggaacgttcgtgcagcgtatcaaggcgatggtttccatcatcattccggtgttcgcaggggcgatacgccatgccgacaatctcagtctcgcactcgacgcgcgatgctatgaagagggtatcgcacgcacacattggcgcgtgatgagcatcgccaaacgagacattgccgcgggcggtgtggttgtggcatatgtggctgcgttggttctgatcgctggactaaactgaaggcagtcggcggattttaccgtcctcacgctactcttgagcaagcatcatagataggaatggaacaagttatggcattaaccaagaagcaggtcaagcagctgcgaggcctggccaccaagctcaatccgctcatccaggtcggcaagaacgatctgagcgaaaacgccatcaagcaggcggacgaaaccatcgaaaagcgtgagctcatcaagtgctccgtgctcgacggatccggtctgaccgccaaggaagcaggcgagggattggctgaagaactgaacgcggaactcgtgcaggtcatcggcaaccgtttcgtgctctaccgccgctcccatcgcgacgacgtggaacatatccgcctcgtacgcgaataaagcgggaaactgacgcgaccaaacataacagggcgggtgctttctgaaaaccaatcagaagacacccgccttgctgcaatgaaaataaacaatcggaagtcaggaaaccccatgaaggagtgctatcagcgcgcctgattccattcgggcttccatgtgtactgcatgtcgtacgcgctggcccagaacatgtattcgttctccacgccggtcacgaaaatgtcgatcagctcgcgcttgcgctcctcgctcgcgtcggccaccagtttctcgatatgatcgagcagccacacggaatcctgccagaactcgtcggtcttatacatgtcgacccagctcttgtacggattgttgtcgagcgtgtccgcgaactcggcggcaagacgataaccataatccgcatacacccaggcgcacggcagcacggccacaagaatgtcgagaatatccttgccataggcgatggaaaggatattcgacgtgtaggcacgcgcgaaggccgactggcgcacattgttcatctgctcttcggtgatgccatagctggccaagtaggagcggtgtacttcggtctcgacctgcagggcgccgttctgcaccttgagcatgaacgccatgatttcagggtcggtggccttggctaatcccaaagcgtgcactctggcgtaatcgttcacataacgaaaatcctgcagcagatagaaggcgaaacgctcgcgttgcagtgtgccttcgccaagctcgcggatgaacggctgctggtagccttcctcccaaaccaggtcggcggccttgcgcatgcgctgcgcgaacggcggaagattgtcgcgttggatgcctttggcggcgtcgaactcataatcgaaatcggttgttgatgtcacagcagtcactagacatgcctccctacgctggtgttaaccatcaggttcaaagggttcaggcctcacttggcccatctcaacccgacgaacacgggttcccctgcattacgccgtacattatggcaaagccgcacgaaatgtgcaagagcccgtccgtcgaatggaatcgtgccgcatgatgcgaacacaggcgatgttcggttgagggcgagtgcaagaatggaacgtatgactgaaaagcaagttgcgaagaacaccatcgaaaagctggctatcgtcgtggtgacgtacaggcgtcagcagctgctcgccaccctgttcgaatccatcgaaaaactcactgtggcgccatggcgtatcatcgtcgtggacaacgagcacagcgaggcgacccaaggcatggtcgacgatttccgtgaagcggtcaccgcgcagtggggcaataccatcgccgaccagtcgggcaacgaaagccgtgtggtgtacgcgccgcaatccgacaacctcggcggcgcaggcggcttctccgcaggtgtgaagaaggcatacgagctgggtgcggagtggttctgggtgatggacgacgacgtggccgtgatgcccgaggccattgaaaggctcgccaagtggaccggcagccatgatgtgatccagggaagccgatacgactacgacggaggcccgttctactggcagtacgatttcatcgtgcctcttggcattcccaatccgatcgctccggccgcgttcgggcgtcccggctatcgtgtgatggacaccttatgctttgaaggcggcctgttccgccgcaatatcgtggaacagatcggtttgccggatccccgcttcttcatctactgggacgatacgatgtacggctatcgcgccagcaaggtcaccaatccgatcgtggtgcccgacgtgatcctgcgacgtacgcgcgagatcggcaattgggatatcgccggcgtgcgtcagctcaactccacttccgacatgaaccgctaccacatcatgcgcaaccgtggctacatggcacgctatttcatgtcgttcggcgattaccgtccgctgatgttcggctttggcacgttgctgaccgccgccaaggaggtcattcgcttggtgatggtggaccgtgagcatgccaagaccggcttggtgcagattgccaagggttggtgggattcacgcaagctgctgcatgatccggattggaagccgatgccgccgctcaagtaatgtggctacaccgtcttcagacggttattttcttatgattcgccccatgccgatgcgttgcgttggcatggggcgaatcgtttgcagaaaacaatcgcaaatatttgcgtttcattgcgacagattatgcaatcgtattcaccaattgtgtattgtcggcgcgttttggggcatggggcgagttactatggcgtttaccggttcgatatacccactatgtaccttgataggagaggtcgaagatgattgaaactgcacaggcatttggcgttgacattggcggctccggcattaaggcagccccggttaacctcgagaagggcgaatttgctgaaccgcgtctgaagatcctcaccccggaggtttccactccgaaggccgttggcgaaatcgttcgccagcagctcgagcattttgaggttcctgagtccgctccggtcggcatcgcattccccgctccgattcatgttggcgagaagctcggctatatggccaatctggaccagtcttgggttggcgtggacgtcaccgaagtgttctccgaagcttgcggccgtccggtcaccgtggtgaacgacgctgatgcggccggtcttgccgaacagcagttcggcgcagccaagggccaggacggcttggtcgtcgccaccacgctgggcaccggcatcggcaccgcgctgatcttcaacggcgagctcattccgaacactgagctcggccatttggaactgctcaagggcaagggtgacgccgagaagtacgcggcatcctccattcgtgaaaagctcgatatgggctacaagaagtgggccaagcgtctgaccaagtattattccctgatggagttctacttggatccgcagctgttcgtcgtcggcggtggcgtgtcccgcgtgtccgagaagttcctgccgtacatcgacatcaagaccccgatcgtcgcagccaagctgcacaatgaggctggcatcatcggcgctgcgtactacgcaagcatcaagcagaagtgatgtcgtgaaccataaaggttcctaaccttcatataagcgagagccgtccgattcatccgtcggacggctcttgttattcctctgatgatcgcatggcgaatgcatccttcttgctcgatgcaacacttgcgcaacccagagagtatggtggagaccatgcgtttttcctccagagtcgatatcagcgagcccaatcccatcgccaaagccgaagcggaagccaaagcgaacggcatcacactcggcaaactcaacgactccaatccaaccaaacatgcgctcgcgtcggaactattgccggacatctacggagcggagccacgcgggcaacgatacgcacgcgaagcgctggccgcattcctgcatgaacaaggcaataccgctaccgccgacgacctatacatattgagctcgacgtccgaagcgtactcatggctgatcaaactgctctgcaatgcaggtgacgctgtgctcgcaccgaagccgggatatccgctcatcgaatcgatcgcacgactcgaatgcgtcgacatgatcgagtaccagcaacgtttcgacggatcctggtacatcgacgtggccgaactacgcgaagcgcttgaaggtgaagatggcggccgcatccgcgcgctggtgctcatcaatcccaacaatccgaccggatcgtacgtcaaagcgtcggaacgtgaggccattgtgcggctttgtcatgaccatgaggtggccatcatcgccgatgaggtattctacgactatgatcttgaaccattcgatggcaacgcgcgtctcgcgggggagaccggcacgctcacattcgcattggatgggttctcgaagacgttggccgcgccacatgccaaagtgggttggatccaagtgtccggcccggcggctgaaatggatgaggccaagcgcagactcgacgtggtcgccgacgactatctgccaatgagtgagatcatcgccaaacagatccccgccatgctgggcgccgcagccgcgcagaccgcgcgcgtgcgagagcgcgtgcaaaccaacctcgcagccttgcataccatgctggatgatgacgagcagggcatggtcagcgtgttgcgtgccgaaggcggatggaatgtgcttttgcgcgtgcccagcgtgcttgacgagaacgaactggtgttgtccatgatcgaaaagcacggaatttcaggacagcccggctatttcttcgatatgacgtcgaacggctatctcgcgatctcgttattgccggaacccgacgaattcaggcataacgttcagacggtgcttgacaccgtcaacacaatgatcggctgaaacatgttgtggttccatcgtcgacaccgatgaaggagccgcaacatgtggggaacgggaataatccgtgggtatggtcaggctttggaagcctcatatttagcgcggatgaggtccgtgtaaaaggccacggcctcatgcgggccaccgtcgaacaccacctgatgatcgtcgaccaccagcgtgcggtcgatcgcatattccgcgcgtgtgatcagctccgtgtcatgcgtggcgaacactacctgtttgtcgtaactgaacagagctttcgccacatgcgcggacgccacctcgtccaaacccttggtcggctcgtcggcaacgatcaccgcgggggagaagctcaatgcggaagcgatcgccagcagatgacgtttctcgctatccaatgcggaggcgggctcacgtgcgaccgccgccagatcgaaatgcgcgaacagattgccgatgatcgcctggcgttcgctttccggcaccttatgcttcttcaacggttcatcaatcgcctcgcgaatggaatccgctttgtaataactgttcggaatttcctcgcgacgaacgcggccgatcatcgattcgatacgtttcagatcacgtttcaccgacggatcatacgcagcaccattcgcgtcgatacgcaccgaaccggacgtcgcagacaatgcgccatccaacagctgcagcaacgtggtcttaccggaaccattcaacccgatcacagccacacgtttgctttccggagtgatcgtcaacgatgtcggctccagaccgacattgccatcctcatacgtgtggcctgcctgatctagcgtgaacgtgacgtcatgcgtcgcttcgggacgtttggatgaaaacagcgaatcgaaaaaacccatggcaaccattgtacgggcgtgccgaacccattgcatacgaaacggggccggaaatccaaactcccacaaggagtttagattcccggccccgtcaagcctgcggacaggatgtcaggcgaaatagaatcccgagaaatcgtacttgtacacgcggtagatgtacgcactgttcaacgtcatcttgaactgcgccagcagatcaccatccttgttgtactggccgaacagacccttcatgcccgagtcgatgaggatctggccattatccaattcctgcgcggaactgacatacggcgaatatggcacgtcgaacgatgacacttccgtatacgtgccggcattctcgttgaccagatacttgcgataccgcgaatttgccgtgtcggaagacagttcgatcgagattccgtcgatcaccgaccagtcaaaatcaggacgcgtcaacgaagtgccgaaattattgtcgaacatgtacaggtaatactggccgtcaggcaacgaatcatcggcgacgtatgtgatggaatgctgtccgccggtatcggaaaaatctccgtctttcgctaggaaactgctgacctcatcggtgcctgcccacacggacggctcgccgatcatgtagtcgaccgtcggatctgattccagatcatccactttgatgatggtggacgtttcgcgtgcggagaataacgcggaaccatcatccaacagttggatggtgttgcaatgcagccaatcccaacgattctgggcgctcgaatccgactcgtcggttcctgcatgcgtggtggaggccttatagtcggcgaacagttcgccgaaatccaccaagcgggtcacactgccggtggaagtgttgagcttgatgacctgatcttgcacggcattgtcgtcgcggcccatttcggtggccaacagcacgatgtctccattggcgtccatcgcgtaatcgtggtgcagaatatagtcggatccaagatcatagatcttctccaacttgccgagacggttcatcgctgccatgtggtgtgtggaagcggagaaccacatgagcccgtcatcgtcgaacagcagacgatgcgaacgatagtagagcacgggaatctcaccgcgcagcacgccgttcgtatcataatagaacatgaagtcctgctcgtcggaatcgttgccgagtatggcatacaggccatcgcccaagtcttctccggaatcagctacgacggtctgctccagttgcacttcctcattgccaagcagggaagcacccctgtgttcgaaggtatgcgtacgggatttgccatcggcgttggtcaacgtgatggtgatggtgttcttttccccgggaataaggccgagtatctggaattcatgggttttgctgtattgcgattgctggtaggcgtcacgggtgaaatccgcgtagccgtccgcatgcacggtataggatacggataccgagtcgtcggtggtgaaatacacatacagcgacgtggtgttggtgccgtacggatcctcggtgacgaacatgtcatcttccgtggcggcagacttgcttttttcctgctcgagcttgtcgtcggccatattctgatagtcggctgtgtacacattctcgatacgtgcgttcagccgttcgatcctgttttgtctgatggccgcatcgacgttgtcatagctggcgagacagacgcccaatgcgatggccgatgctaccacggccgcggtccagcgtttaacacgaggatggttagacagaagtggaagcgatttcataactgatgtctccaacaagggttcatctcatatcgaacagttacgacaccactattattcgcaaaactcggaacaaaccggagattttattggacaaaccgtaataaaaccctgaaataaccctgaaaacgccgtgcctcatatcagggtgaaccacgactgcacgtcatggaacaaaccggaattattgcgtatcagctcgtcgtcgcgaccatataggaacaacgacaacaccgtcaccgccaacatgaacagcagcagcgccaacaccagtacgcgcaacagccagcacagccgcggacggtcgcaatccaacgcaatgagcagcagaggcaacgaagccaaggcgaacagccaaccgaaatcggcgatgtagcgccacccaagaccacccaagcgcgcgtcaagcgccacaatcagcaaacttaacagcaggaacgtcgtcagtgtacgccacataccgacatgaccacgagcgcgcatatgccggcgtaggaatgggcatgccagcgaagccaatgcgagaggcgccctgacgaacaggcctccaggcatcgcctccgtgaacccccaatctttcaatggggtggggtcgacggcaaggaacgggaacatattcgtccagcgcaacggcaaaaacagatagtatgcgaccgtccaaatgaaattcgaccacgactgatggtagctcgtcatatccgtgaccgttatctgatatgacgaaccgaaatcgaatggcgaggagaaacgcaccatgttataggcgaacaacggcaccaccacaaccaatgcgggcaccagcacggccaaaggcgcacgcaacgcatgcaacatggcgcagacgcgcccatgcgcgccagaagcgaacacgccatcacgcaactgtttggcaatcgcacgaatctgcggccagaacaacggaaacgcggcgaacgccaccaccacaaacgacggacggcaacccacattcgcggcaatacacaccgaaccggcagccaaacgaggcagcgacaacgattcgaccgtattcgcaccaccatcgccaccggcatcggccgcgttcgggtgcgccgcacccatccatagccataagcccaacgtgctcaacaacaaggacgccgcaatcggcaccgaataaaaattcgtccgataccacaagtacggggcgttcgacgccaaaaccacaaacacgcacaacatactgaccgcagccagcgaaacatgcggacgcacacgctcgatcacgcgaatcgtcaacaggcacgcgaacaccaaaaaaacaaacatcagcagcggcaccgcagcgccagacggcatcatcagaccaccatcaacccacaacgacgttatcgcacgatacggcacaaacaacagcaacgccggcaccacgccaaaatacgaataccaacgaccatcaaaaaacgcataatcccaatacaccggactcacaccatcggcaagcaattgctgacgagtcgtcacatcatacggattatccgcatcgcgcaacgcgtcgggcacatccaaatcaagccacgcatgaccattaagcaacgcccgagccacatgatcatactgatcgtaatcatacgtatacatgccatccgtatgaaaactcaacggcaccgcagacaccaactgccacgccaccgccgcaacagtcaccaacccaggaaccgtcaacaacacgcccaacgtcacacgctgacgcacactcgacgtattcaacggcaccttccacaggcgcgagcccggacgccacaacgccaccaacaccatcaccaacaccaacaacgccacacgcaacggactcaccgaaaacggcacacgcacattcgcgcgaaccgcatcaaacggaatcaatgaccccttcggctccaccacctgcacgcgcaccgtacgaccggccgcagccctcacatacaacgaacgagacgaatccaacgacaccgaacacaacgaaccagccacacgatccgcatccgcacgaacacgcaccgtacgcaacacgcgcgaaccggcaggcacaccacccataacctcatcggacaccggcacgatccgcacatactcagacgaaccatccgcagccacctgcaaatacgcctgcgtcggatcagtaacctccaacaacccgtcatcacgacgctcaagccccggccccaacgtgttatacgcagccgccgaatcacccgacgccgccaacgagcggaaaaacggcacattacacaacacgcactcaaccaacaccaccacaacaaaagcggctacaatagctgcgcacacacgatgacgcgcctgaaaacgctgtttcgaaaaagtcacgaactttattctaaaggctgcatgtcgcattgaattgaaagaatggcccacatgtcacacctcacaccagcatcgccatcagcacaccatccacaccaaggacggaccatgctcaaccacgccatgcaaggggtacgacaactcatcaaccacaacaaacacccccacaacaccgccgacgccaaccccttcggcaaagccctcgacacgccagacgacatcgtcgatgaactcacccgcaacgccatcaaactcaacccactcatcaaacgacacatcatcaaaggcttcgaaggcataccaagcacactccaactcggctgggcgcaactgccacaaacccaaggcaaagccttctccatcggactattcaccgacaacaaccacttcgcgcaaatcgcgctcgccgacagcaaagcacgcgtcttcgcgggcaccaatcccgaaatggacgtgcaggatctggaaccacgattcatattcgtcaaagaagaaaccctcaccctgccagacggtccacgattcggacacgcgacaaacggcgcgccgaagatggtgcgcgcgtcgcaaggcggtgtcgtgggacgcatgcccgatggccgcatgatgtggctcgcatcctggctgaaagtcggcaaccgctacacgctcgaacagatgcgtgccaacctgccggaaaccatgcgattcgatctggaatacagggatgccatcaccatcgcattcttcgcagcctacatgctgccgcaaatgaacgggctactcgtgggattcggcacgggcaacatcttccgcaggctcaaccgagaggcgccgatgggcgcgatccgccgatccatcagagacacgatgagcgcacgctcccatggcatgcgcgcatccggacttgaggattatttcgccgacctcatgcgcgaggcaggcgcccttgacaaagaccaagggctcgaagcagtacacggcgcggaaccattgcacctatacacgtccagctactcgggctgctatttcttcgcttgggattccacactgccgttctcggcatcgctgcgcgcgctgaacatcgaaggcaacctcaaccgtttcgccgcagtcagttcatggctggaacgcaacgcccgtatcggcaagctgcccacagaagacaccgtaacccgcgcggaagccgcgcaaatcgacatggcgctactggaaaatccggcgctgatcgcattgaaaccggacgacgaattcggcgcgatcctcgactcacagcaggatgacggcgtccaagccgtcatgcgcctggtggacatcgccgcggaaaccagacgttccatcgccgaaaacacgaaggacggcgaggatggtaccgccttcggagccgaaggcggttcggaatgggtataccgccagacaatgtcgagactattgcgcagcatgcgcctgccataccgcttcgacgtggacttccgatgcagtctccgagacggcaatatggccatcggtttcacctctgccggcgtttccatgatgccatccaccaaatatgacgtgtcccgccacgcatgggtggatatgacggacgccgaacgcgcccgcatgagcgcggactacaatctgcgtgttggactgatgatggccgcgttgagttttggcgccgatccgggcatacagcgtgtgtcgatgcatatcgattcgattggtttggaagaggccgtggccgagcaggattccgccatcagcgagctgatgagcgaggctttggcggctttcgaacgcattcgtactggagatatgggtgtttctgggtccaaggccgatccgaaggacggcgatttccacggagacccgtcccgtccggtggcgccgagatccgccgacatgggcgttgatggcgtcaactccgaggatacggatgatgcgttgaacagccaattcgaggatctgatgcgggatatcgacttcgacgaagtgacgttcgcggttcccgacgagattgcggacgattcctctagcatggacgacggttccgcacagggcgtgcatgatggcgctcttgacgcgggactgatcggcttcggcgatttcgatgggaatggtgatgatccattaagccagcttcgcaagaatccgaccgtacgcaatctggtgacggtcaccttcaccagaagcgaattcatggagcgtctgggcgagtgcggattgtctgatccaacaggcacataccgtatgttcgatgcggaaatggatgtggacggcctcggcgcattgaagccagtggacgccacgttcgatttgcgcgatagtcgtttctccccatccggaagtcaggaggagcctgagctttccgacgccatattcgaccatgacacggcacagctgttcggctgccgtgacatgtcggggttgtccattcagcgcgtcgacctgctgcagcgcgcggttggcgaattccacagaatcgcgcaggactcccatctggaatcggtggccaaggcaaagcaggccatggacgtcatcaacaccattgccgacccggaattgacgtcgttggctccgcaggtgacgagtgcgctcatcgatggcaaagacactccggacttctccttccgcttggccgacgagcttgacgcggaacgcatcaaggcgagagacctgctgttctcaggacaggtcgaccaaagcgtggaactggccgaagcggcgttggagcgaatggaccgactgttcgcttcgaatccgggcgtgccgcggtatttcaactcgtatgcggaacgcgtcatctacaatcgcatgttcgccacggaaggcgaacggaccgtgctgattccggacaatctgttctacgcgcatatggaactcgccgacgtgcttgcacaggtcaaaggcgtgaaggccgcgttgccgcatctcaatgcgatggtgcgatatgcgccggcctacccgctttcccatctcaagctggcggttcaactggcgcgcgccgaggattgggatccggccagagcggcttgcctcaacgcgttgcacgtcgcacttgaccgtgaggatgcgtcgttcgcctattacagactcgcctatgcggaatggatgtgcgaccacttcgacatcgcggccgccgcgtacatcatgagcgaggagattgcccccgggcgaatcgccatgctggagagcgagctgcaggaattgatcggacgcgcgcaatcgcaatgcattccggtgcccaccgacgttccggaagccatgcacgtgcttacccaagcgggactgccggtatggcccaatacccaggtcgcatccttggtacgcaaggccgcgcgggtctgtgtggatgaaggcatgttcgtgccggcacgtacgctttcggttgccgcttcaaggatggatgacgaggagcgcgacggtgccgacgtggtgcagatgcagttcctgaggtcgttgaacaactgaacggcgtgctttccgcagtgcgccaaacagacgttggcgatgcagcaaatcgaacatttgtgcgataatgtgtgcatggcggctctgaccggcaaaacattgaagacagtgacaaggcaatgacaatgacaaggcatgacgattccgaacaactcgcatgggattttgacgcttctgaaatgggcggcgatacgggctccgcgtcaaccgctgtggttcccgacgggggagtcagctcatatgcgccgggcagtgaacgctggatcgccgcattgcagccaaccgatgccgacgccatgcggttgacccgacttgatgtctcgtccatcagtgctgaagccgcggctcgattgtgggcgcgtgtggcggcgtgggtggaatccgaccagatcgcatactacatcgatgacgcgccggtctcgtccgacgccgcctatgatgcgagaatacgttgtctacaggcgttggaagcccagttcccatccctcgattccgcgcaatcgccgacgcatcgtgtcggaggcaccttctccaatgatttcgcatcggtacgccacccgtctcgcatgatgagtcttgacgatgtcttttcgcttgaggaactgcatgaatggtacgacggtgttattcggggacttgattggcctgagacgaagcctttgccgatgacatgcgaagtgaaaatcgacggtcttgcgcttaacctcatctaccgtaacggcgtgctcgagcaaggtctgaccagaggtgacggcgtgatcggcgaggatatcacgctcaatgtgcgcaccatctccaccattccgcagaatcttgcgggaccggaagaagacattcccgaattcgtggagatccgcggtgaggtcttcatgcgatgggacgatttcaacacgctcaacaaagaaaacgaggatgctgggcgcgcgcctttcgccaatccacgtaacgcggctgccggaagcctgcggcagaaggatccgcgcatcaccgccaccagaaggctgagcttctatgcgcatggcattggaacgctccagtggggcgccaaacgtggtgccgaccatgatgcggtcaacaaccaatccgaagcgtatgggttgtataagaagtggggcatacccgtttcgccacataaccgtgaggtcaccacattcagccagattctcgacatgatcgattactacggcgagcatcgtggagacatcgaacacgcgctcgacggcattgtcgtaaaagtggatgatttgggattgcaacgatcgttgggcgcgacctcgcgtgctccgcgttggtccatcgcctacaagtacccgccggaggaagtcaatacggaactgcttgacatcaccgtgcaggtggggcgcaccggccgtgtgaccccagtggccatattgaagcccgtatatgttgcgggttcgacggtgtcgagaaccaccttgcacaatccattcgaagtggaacgcaagggtgtgctcatcggagacaccgttgtggtgcgtaaggcgggcgatgtgattcccgaactcgtaggtcctgtgctggaacgcagggaaggacacgaaggccagctgcgccgtttcgtgatgccttcgcactgcccgagctgcggggcggaactcgctccggccaaagagggggacaaggacatccgctgcccgaacgtggaatcctgcccggcacagttgaccgaacgcatcatcaatctggcatccaggaaagcgttcgatatcgagcatttaggcgaccaatccgccatcgctttgacgaatccggaagaggaccgtcccgattcgacggccacctacgcgccgaacatcacggaaatcgtggtggagccgggcgcggagcccgaaccgtacgagcctgtggaaggtctggagctgccggcccgccaaacaccggtgctgtccagcgaagccggtctgttttcgttgacgtccgccgatctgcaggatgttcgcgtatggcgtgaagcgccgatcatcgaaatccacgaaaccatcggcaagaacggcaaaccgaaaaagatacgcaaacgcattggcggatcgggactgtggcatcaggttccggcgttctggacagctcctacagttgcaagaaaacgtaaggactccgtcgacgaatccgcggaatatcccgaatatgacgtgcctgaagatgccgtggtcgttcgcgaggaaaccaaggtgtcgcgttccggaacatccagtgtgcagccgatatatatacgccccgcggaaaacacgaggaaaatgcttgacgaaatggacaaggcgcgccatgccgacctatggcgtgtgcttgtggccctgtccattcggcggctcggtcctcccacggcgcgtaccatcgccaacacattcggttcgctcgacgccatcgaacaagccagcgtggatgaactgtcacagatagacggcatcggtccggaaattgccgaatccgtggtcacctggtttgcttcggccaagaatccaggcgattggcgtggcatggtgctggaagcatggaaggcagccggagtgggagtcggacaggcacagaccagtgctctgccgcagacactggaaggcaagacagtggtcgtcactggttcgttggttgatttctcgcgggattccgccaaagaggcgattatctcccgcggtggaaaggccgcaggatcggtcagcaagaaaaccgattgggtggtcgtcggcgaaaacgctggtgccaaagccgccaaagccgaggaattgggaatcgccatgctggacgaggaccagttcaaactgctgctggaaaacggaacggtgtgacgcgtgccatatcaagccggcaacgtaatcacaagaaggctctggcatgccgcgcttccagacgctagtctggtacgcggctaaaggaggaaccatgaccgacgagcgcaccatcgaagcgcgcatctatgagcgactcagcaaagtaatcgacccggaactgggccgatccgtgaccgatttgggcatgatcgcagccatagacgcgataccggtggaaggtaagacgaacacctacgaggttcgtgtggaggtcgaactgacggtggaaggctgtccactgtcgcagaccatcaccaaccagatcaacggagcggtgtcgtcatatccggaagcgacattgctgccgcgcatcgaagtcgggtccatgagtcaagacaagctcacccaacttgtggcaggcctcaaggccgaacgcaaacagaatccgttcaacaagccgggcatcaaaacccgtattttcgccatagcatccggcaaaggaggcgtcggcaagtcttccgtcactgcgaatcttgctgccacatttgccgcattggggtacgacacggccgccatcgacgccgacatttatggtttctcactgccgcgactgttcggcgtgcatgcgcaacccaccaatctgaacggcatgctcatgccagttaccgcatggggtgtgaaattgatttccatcggcatgtttgccggcgccgatcgtgcgatcctttggcgaggcccgcgattgcagcgttctcttgaacaattcctttcagacgtatggtggggcgagcctgacgtgctgctgctcgacttggcaccaggtaccggcgacatggcgatttccgtggcgcaggctctgccgaacgcggaactggtggtggtcaccacgccgcagccatccgcctcggacattgcggtccgctccggcctggtggcattgcaggtaccgatgaaggtacgcggcgttgtggagaacatgagctattacgagcatcagggcgaacgcctgcggattttcggcgaaggtgggggtgcgcgtgtgtcggagcagttgaccgaaagccttggctatgatgttcctttgctcgcacagctaccgttggagccggaattgcgtgagaccggtgaggccggccgccccgccgtgttgaacgaggatggcgcgttgcgcgccgatggcattggcgagacgttcaggaatctggccgaatcgttgatgcacagacctatgtgatgtgcggggcacgtatccaggccgtcatgacccgcggtatggacggtggcctaatgcggctgcggattcacagctcatccggggaacgtctgggtggaaaacgaagcgaaatgaaaatgacccttgtgaaaatcttgtgccttgtgtagtatcaagcgcagacacgggggccgtatggctgagaggaagcaagcgcttcaaccgtatgaacgtataccgggtaatgccggcgcacggacgtctctcttttcccgtgccttgacatagagaaaggcacattcatgaccgtaaatgaatcttccgtggtgaagaagcataacaataaatggcgagttgttgacatcgtcgtggccgctatcatcgcggttgcggctggcgtgattttctggggctgggatgtcatctgcgccgctccgattacgcttttcgaagcggtgacgccgggcttcgaaggcttgttgaacggcatctggctgtttgcgggtccgctggccgccatcatcgtgcgaaagcctggcgctgcgttgttcgctgaaacctttgccgccgctctggagcttgccatgggcaatccgtggggcatcggcggttctttgattatcggtatctgccaaggcctcactgccgaaatcggttttgcgatttttgcatacaaacgttgggatttgctgtcgaccaccatcgctggaaccctcgccggcttgggatgcttcctgtataactggaccgtgaatcctgcttgggcaggtttgcgtattgtcgtcagctgcgtcacttccgttatttccggcgctctggtggctggagtcctgatgtatctgctgcagcaggccatcgctaaaacaggcgtgcttgaccgtttcgaatccggccgtgcgaaggccttggtatgacgattcgttaatgaagtcccgtatcgcattcacagtggtggatacgggacttctttgatgcgtgttcgttctgcaaacgcggaatgcaagaggaatgaaagaacgattcatgggtactgatgcagaaaaatcgttttccgcagccggggtggtcgcacgcgattggggatggcgacacgcctcacgtaaggatttcgcgttaaggcatgtggatttcaccatacagccaggggagcgcgtgttgttgttgggcgcttccggcgctggaaaatcgacgttgatgtccggtcttgccggcgtgctcggcggcgatgacgaaggcgagcttgaaggagagctgctgattgacggagtggacgcccgtcaggcacgcggacgttccggattggtgttgcaggatcctgacgcgcagacgattctggaacgtgtgggcgatgacaccgctttcggttgtgaaaatctgaatctgccgaaagatgagatttggagcagggtccgttcctcgctcgacattgttggactcggctacatgaaacttgaccgctccacacgcagactgtccggcggccagcgccagcgtctggccttggccggcgtgctcgccatgcatcccggactgctgctgctcgacgaaccgacggccaacctcgatccggagggcgtcaaggaagtgcatgatgcggtacgccatgtgctggaacagacccgtgaaaccttggtggtggtggaacaccatattgacgtatggcttgatctggtggatcgggttatcgtactcggcaagccggaggccgactcgcatgtcagcggcgtcatcgcagacggcactccggaagaagtgttcggcagcatggcatcggtgctcgcaaagggcggcgcatgggttccaggacgcaccatcgaaagtcatacccccgaatccagccaatcgtcgggagatgttgttctgcgaacggaggatctcagcttcgggcgtgacttcgcgcttggcgagcatgtgaacctcgtgttccatgctggcgagatcaccgcactgaccggcaaaaacggcgtgggaaaatccacgctcgcgttgactttggccggcttgctcaagccgatttccggccgtgtgagcatggatgagaccatggttcccgcacgtagggagaacgacgtcttcacttggaaaagtcgggatctgctcggacggatcggcatggtgttccaggagccggaacaccagttcgtcgcatccagcgtgcgtgacgaagcggcggtcggccccaaatccatgggcaagagcgaagaagagtcttacgctatagccgacaacatgcttgagcgtatgaatcttgctagattcgctcaagctaatccgttcacattatcgggcggcgaaaaaagaaggctttccgttgcctccatgctggccgccgcgccgaaagtcttggtgatggacgagccgacgttcggccaagacttcaccacatggacggaaatggtgaaactgatcgccggtgcgcgtgacgccggctgttccgtcatcatggtcacccatgacgaaccattgatcgaaacgttgggagcgcgtcgcgttctcgtaagcgagggggagtgagatggaacagttggaaaccatcagcgtggtaccgcacaaggaacgtcatgacgatgccaagccggcatcgccgtcatggttcgtggcaaaaatcaatccggtcagccgtttcatcggcgcgctgatactatgtattcccatgttcgtgacgctggacgtggtctccgcgtccgtggcactcgcattggaggtgttgttgctctggattggcggcgtcgctccgtggacggtgcttcgtaaaacctggccggtgtggattgccgcttcgggaagtttcatttccgtgtcgttgtatggcaagacctccggggccgtgctggtcaatctcggtgatgtcgttgtgatttcgcagggatcgttgtacttggcgttggccacgttcctgcgtgtggcggccattgccgttcccggcgtgattcttgcgcttggtcttgatccgactgatttggccgatggtctggtgcagattctgcatttgccgtcgcgtttcgtgtatggcggtttggctggcatgcgcatgtttactttgctgcaggatgattggcgtgcgcttgggcagtcccgtcgttctcgtggattgggcgacggcagcgccgtcaaacgtgtgttctcgcaggcgttcagtctgctggtcgtgtcgattcgacgcggcacgaaactcgccaccgccatggaagctcgtggtttcggcgcggacgctccgcgaagccaggctaggaaatcgagcttacatgccgtcgattggctgttttacgtgatttgcgtggccgtgccggtgattgcgttgtcttgcgcttatttcaccggttactggcattgggcttttaccggcactggcaattaatcggagcagggctgcgcagtacgaggtttgttgaatgcgcggcggatttgcgaagggcgtttcattcgttgtatggaatggaacgcccttcgcatttgcccgttgtttttctcaaaagatatgtgatatccgctacttggcaagcttgtcaagcagcagcgcttcggtgatcacattgtttttcaggctgggaagactgatggattcgttcgggctgtgcgcgttggccttcggatcctcgggaccggtgaccagtacctgcgcgtccgggaaaatacgctgcaattccggaatgaacggaatcgagccaccttcgcccttattgaccggagccacgccaaacgcctcttccatggcgtccatggcgtctttggtagcctcggcatttggatccatggcccaacccatgccattatcaagcttgtcgacccacacttcggcgccaaacggagcatgctcgaccatgaacctggcaagtgcttcctgagcctcttccggacgctggtttggagcggtgcgcaggctgagacggaacgtcgtttcaggggagatcacgttgaacgatccctccactggatgagcatcgaagccgatgacggtcacgctcggcttggtccacagacgtgcggccaaagaaccggtgccggccagacggtaggaatcgacgatgccggcgtccgtacgcacggttgcctcatccatatctcgctgcagtccgccgattggatcttctgaggcgacgcccggtaccaccaaatcgccatgctcgtcatacatggaagcgatcagcatggaggcaagcgtgttcgcatcgaggatcggtccgccgtactgaccggagtgcaccggatgatgcagcgccttgacgtgcacgtcaatatcggtattgcctcgcagcgacgtggtgagcgaggggatttcagcggaccaattgcccgagtcggcgacgatgatcacatcggaatcgaattcgtccttatgctcctcgatgaagggaatgaagcttggcgatcccatttcctcttcgccttcgatgaagactttgatattgaccttcaaatcgtcgccgagcgcctgcaatgcgccggaatgaatggcgattccgccgccatcgtcggccgagccgcgcccgtacaggcgggtgtcgattacagtgccgacgaacgggtcggtgttccatgcgctggcgtcgggtaccggctgtacatcgtgatgcgcgtacagaagcacggtcggcgcatcctcatcgacaatcttcgaaccaatgacttcccaagcgcccggggtgccattaggattgtgggactgcaccacttgggcgtttacgccgaccttgctgagctcttcggccacaaattcggcggatcgtttcatatgatccgcggtgatgccttttgccgaaatggactgtaatgcgattttcttgttaagcacgttgacgatgcggtcaaaatccgcttcgactcgtgatcgaacttcttcgacaggtaaagctgccatattgctccttacaaagacgcgctgccatacaacaacgcagcgtgatcatatgcgtgtaacgaatgaccattgtatcggtctcaatcggcacgtccaattgttgacagggcagggccaaggcgtcgatacgtcactttacgctctataggcatgagtttgtttaacaagaaggaagagacggcgcaggagcctgtcgagaccaaggttgcggaaaccacttccggcaagggtcgtccgacgccgaagcgcaaggatgctcaggcgcagaatcttcgcccgttggttcccaaggatcgcgaggcgagccgtaaggccgccaaggcgcgtatgcgcgagcgtgagaacgccgagtacgatgccatgcagaagggcgacatcaaccacatgccaaaggcagagcgtctgccatggcgcatttacatccgtgactacgtcgacgctcgttttaacctcggtgagttcttcattccggttgcgttcgtcattctgatcggttcgattttcgtaacatatcagtggcctgcgctggcattgccgttgatggtgctcatgtatgtgtacctgttcgcggtgatcattgacgtggtgatcatgtggcgtaagctcaagaagaaactcattgagaagttcggcgagcaatccgtgtccaagggcatgcgttctggttcctatgcgtggagccgtgcgatccagatgcgccgttggcgtctgccgaagccgcgttacgataagcgtggacactggccggagtgatcggctcctgccgggaatcgcggccatcgttttttcaagccgtcggcgaaaaccggcggcttttccattaccatgtaaccagttgtaacgcacgaatcaacgaggacaggcatgactgaacagcatttcgacatcgtcatcatcggagcgggaccaggcggatattccacggcactacgcgctgcccaacttggcaaaacggtggcattggtagaacgcgacgacacgttgggaggcacttgcctcaatcgcgggtgcattccatcgaaggcgttgctgacggccgcgcatagtgtagagaacgtacgtcaggcggagcgtatgggcgtcaatgtcgcattgcagagcattgacttcggcaggttacgtgacttccgtatgtccacggtggagacgatgacgaagggattggcgggattgctgtcgcaccgtggcgtcaccgtgttccgtggcgaggcacagctgaaaaatggtcatgaggtgcatgttgcgccggccttgggagagacgcaggttctgcgttccatcaaggcgggagtaggggaacttgtaggatcggaacttacgatctcaggcggcgatattgttctcgcgaccggttcgcgcccgctgccgttgcctgacgatccgttttccggagcgttgattgattcgacgcaggctctggaattggacacgttcccatccagcgcagtgattatcggcgctggcgcggtggcgttggaattcgcatcattgtggaatgcgtcgggatgcaaggtgaccttgctcattcgcaaggatcgcgtgctgtcgtcttgggagaggcgggcttcgatgacgttgacacgtgagctcaaacgccatggcgtgaatgtggtggcgcgcacgtcggtaagtcatgtggacaccggagcaaacttgggtgctaccgtgcactacaggcagggtgatgacgttgaggagcgtaccgcgtatggcgaagtggtgcttgctgccattggccgcatgccgaacaccgatgccgactggttcgcttccaacggcatcgcattggatgaacgtggctatgttctgaccgatgcgtacgggcgcacgaacgtggaaggcgtatgggctttgggagatatcacgccggggcatgccttggcgcaccgtgcgttcgagcagggcatcaccatcgccgaaaccatcgcgggacttgatcccaaacctgtcgtcgacgaaaccgtgccgcaagtcgtgttttccttccccgaggcggcaagcgtcgggcttacgctcagcgaggcgaaatcacgtgacactattgtcgatccgcaggaaaccgcatatccgatgctgtccaactcgcgtatgctcatgagtggggagggtggatccatgaccatcgtcagcggtgcgatggctgacgctcccgacgttcctcttgtgcttggcgtgcacatcgtcagtccgatagccagcgatctgatcgcggaagccgaacagctggttggtaaccatgtaccgcttgccgatgcggcaaagctcattcacccgcatcctacgttcagcgaatcgttcggagaggcgctgctcaaagcggatggcaggcctttgcacacccgataatcctcgtcaataaaggggaaacagcggaaatcatgcgatatggcatggttcctgataaactaccgttccagtgtgagtaaccgcataaccaagtgaggaagtcgatggcagacaaagaagagccaaagaagaagcagagcaccatcaaacagatcattcagatcttcaagtacacccatgccgaagacaaggctcttccgtggctgtgcggaggcgtgttcgtggcgcctatcatcgtgttcgtggtacttggcatcgtattcaagtggtcggtgattggatggatcacatccatgatcctggccgtcatgcttggcctgctgttcgccaccatgatgctcaccaaccgtgccgacaaagtcggatacgccaagcttgaagggcgtcagggtgctgccatcagcgtgctcggcaacattaacaaggctggcttcaactttccgcaggagccggtgtgggttgatccgaaggccaaagacgccatttggcgcggcaccggttacaacggcatttatctgctcggcgagggcgattacaatcgcgtcaagcgtgccatggaccgtcaggagcagaatatcaagggtgtgaccgccggttccgatattcccgtctaccgtatctacgtcggccagggcaagaatcagacgagcctgaagaatctgcgcaagaccgtgctcaaatgcaagagctacctgccgacccaccacaagaacaagttggtggccgccatccatccgaagagccgcttcatgcttaccaagaccgagctgaacatcctcaacgagcgtctgcgcactctgcagatgaagaacggcatgggcattccgaagggcgtcgacccgatgcacccgcagcgcatcagccgtcgtgctatgcgtggccgctgattttcctggaatcgtaaagccggcttacatatgggaacctcgatgaacacgttatcgaggttccttttttcatatctccgttaccttccgctggcctgcgcgcatgcggtaaggtttttgagaaaagaaatggacgtcgcaagcgacatgacgacacgaatgtccacaaattgaacggttttgcagaggcaaatacgagcgttcgtaacaattgaaccccagtttttcgcgaaatcatccttcgaatatgtcattacgaaacattctcgtaacccaattggcgagtgagcgaaacgcgcgttcctagactaagagcctgtaagttacttattcgaaaggagcggtcccgtgactgcacttgaaaccaaggctgatgctgaggcccttatcaacaaggaaggcatcgagtatgtctccgttcgcttcactgatctgatcggtgttcagcagcacttcaccgtgccggcaagcgaattcctgaaggacgccttcaccgacggcatgccgttcgatggctcctccgtggaaggcttccaggccatcaatgaatccgatatgaagctggtgccggacgtttccaccgcattcgtcgatccgttccgcaagcacaagaccctcgacgtggccttctccatcgtcgacccgctgaccgacgagccgtactcccgcgatccgcgtcaggttgcaggcaaggccgaggcctacctgaagtccaccggcatcgccgacaccgcttccttcgctccggaagccgagttcttcatcttcgacaaggtgcgcttcgagaacagcatgcagcgctccttctacgaggtcgactccatcgaagctccgtggaactccggcgtcgacaccgaagacgacggcaccccgaacatcgcattcaagaaccgcgtcaagcgcggctacttcccggttccgccgatcgaccacacccaggatctgcgtgacgacatggtcgccaacctgcagaaggtcggtctgatcctcgagcgttcccatcacgaggtcgccggcgctggccagcaggagatcaactaccgcttcaactctctgcagcacgcaggcgatgacctgatgaagtacaagtacgtcgttcacgagaccgccgctctggcaggcaaggccgcaaccttcatgccgaagccgatcgcaggcgacaacggcaccggcatgcattgccaccagtccctgtggaaggacggcaagccgctgttctacgatgagaagaactacggtggtctgtccgaccttgcccgctggtacatcggcggcctgatcaagcactcctcctccgtgctggccttcaccaacccgtccctgaactcctaccaccgtctggtcccgggcttcgaagctccggtcaacttggtgtactccgcacgcaaccgctccgccgccatccgtatcccgctggccggcacctccccggctgcaaagcgcatcgagttccgtgctccggatccgtcctgcaacccgttcctcgccttctccgcacagctgatggcaggtctggacggcatcctgaaccacatcgagcctccggagccggtcgacaaggatctgtacgagctgccgccggaagagcacgcaggtatcaagcaggttccgagctccctggcagaggccatggatgcccttgaggaagatcatgacttcctcaccgcaggcgacgtcttcaccgacgacctgatcgaaacctggatcggcatcaagcgtggtgaaatcgaccaggcccgcctggctccgaccccgctggagtacgagctgtacttccacatctgaggcctatacccagtttcccttgaaatcaagctgttttggactccaagggtaatcagaaggtagccagattggttataaggagagcctctccaaattggggaggctctccttattcctacagaatttcttccatccgggacggcaaagaccttacggaccggtcttctgactcctcgcctccacgaacacatcagacgcatccaataaataaccgttgatatgagccggacgtgcttccacaggttcaccgttaatgtcgtcgtattcatacaacgcaggagcgtttgtgcctctgtcgaatccgacaatgacgacatgcacgttcgcattgtccgtagtctgagcgtcccagcagaacgtacggtgagcgaaccggatacgccaccctcgttcgaccacatgcttgaatagcggggcgacttgtgctggccttgtgtgatgctattcgtggatacgaacgcgaattgcgcggagggattcccgtcaaggaaatcaatagctttaaaataccatccagccacataatccagcgagcctccggccttgccgcacaccagttccatatcatccttgatctgctgcgtgtgctgctgatggccgatgaacggcgggttgcccatcacatacgagcattcatcaccgggcagcagaagactgacgaggtcataaccatagtcactcgcgaacgctctcgttggcgtcgcggcatcttcgaggatgccttcaagcgcctcacgagtccccaacgtccttctctgcatgaatgaacctccttgtatggctggaagttatcgtcacagatgatttcgtaaccacttacctctgttcaagcgccgcgttgacccgtgccttgagtgcaggcaaggtctcggcctcgaaccaaggattcctgctcatccatagctggttgcgcggcgacggatgcaccaaagggaagaatccccggccgatataggcatcataatcgcgcaccacggttgtaaggctgtccgaattcttgagatgcaggtacctgcggacggcatatgcgcccacaagcacagtgagccgaacattgggcatgagcgccaagagtgcaggatgccactgctcggcgaatcccttgcgcggcggtagatcgcccgacctgccatgtcccggaaaataaaagtccatggggagaagcgccacccgctcaggatcataaaacgtctcgcgagaaacacccagccaatcgcgcagacgctctcctgacttgtcgttccaggggatgcgcgtctcttccgccaccgcgcctggtgcctgcccgatgaccacgatgcgagcgccagccccgacggagtagagcggatcgatgccgcgcttggtgtagtctgcattcgccccatcagcctttatggcattaaaaatcgcaaggaaatccttgtccatgtcgaaaccatctccttggtgacatgcgccgttcatgcatattgattactcgtttcccacaaatataccttgcctttgctctgcagggtatatcgtaggaaatcatcctcatgtagtaattcccgcatagccgcatatcgtctttcaagatttttattgccaatgtgcatcacaaagcactacgcctaactggattaaataaatactcaggtttcaaccgtcttgcaagcgtagcgttaccgcgaaccactctctataagcacccatggcgcccatcgtagataacaagccgaaagaaggagaacgcggtccggacgacctatttcaagcctctaaaggagcaatcctttcggggcttttctattgtccgaaaggaggcggcacgcatgccgagaaaaccaagacgcccctgccgccaccccggctgcccgaacctttgcgaggacggcgagcaatactgtgagaagcatcgcaaggaagcggagcggcagtacaagcatttcacgcgcggctactccgcgggcaagcgctatggcaggcagtggaagaagatccgcgaccgatagaagaacattggcatagtccttaaagtgaaatccccttatgaggtcagacacatctggcagcgggacaccataggacgccgccacatacgttagatattcccggaatgtgaaatactgaaatgactgatcttccgctgcccctagatccagtgcaaatcagaaagtaaggggtgatctgcggtgtaccagacgcttaaatggttcaaggaaagaagtgccttgctgtccattctgcattacctccgattgtttttgtctttctcccagagcgaataggcggagaacaggagcacgccgccgaggaaaatgtacagcaggacaaacgggatgttcatggtaacgaaactgtaaatcatgcagacaataaaacgcaaatccattcttcgcgtggccgacggatacgggttccatccgatcagtaagttcggcaaacgaagcatcccggagttgaccggatgcgctgcggggcatgtggatgcatgttggttgtgatgggccggttggaggatattccggccgattatgagggtcgtttgggcgtccccgttttcttgaaaaacctgtcgaataaaaacgaccttactgagccgcctatgccttgtgcatggcgataatatgctctatctcggcaagatccgaagcgaaatagataccatgctggcgttcccctgtggagaagccatcgtcgatcatgcgctgcagcaacgccttcatgtcatcgtagaaaccgttgagattgtagaaaatgcaaggctgcgtcaactggtcaaggcaaaccttcgacacaacctcactgatctcctccaacgttcccgtgccgccggggaaggcgatgaacacgtcgccaagctcgatcatgcgagtacgccgttcggtgatattcggcacgatggtgagctgggtcagattcttgtgcgcgacacccttgtccacgaacatctgcgcctcgatgccggtcacctcgccaccctgctcaagcacagtgtcggcgatgactgccatcagcccctcgttggaaccgccatacaccaaacggtgcccgttctcggcaatccatatggccagctccgccacggcctgcttgtatacggggttgttgccttcgtgagctcctaaatacaccgtgacgttcatgcttgtacctccaacattcatgggatgatgtcgcgcgcccaaccgtaatcagacaataagtcagataatcagtgtaacgaaccgatgttcgcaaaccaatcgaaagcggtgagacacactcgcaagctgtgcatatctttcatggatgtgcaaaagccccgtacccgacctgccaaattcatgacatgtcgaatacggggcaaggcgaagggtgacgatcctgctgtgacaaatcgctgccgttgcacaacacttttccctctgtgggattcgcaagcccggaaatcagtaacagcatagtggttttgccagcgctggggcatcgctctgtgcgttgccggactgctgcgaatccggagaattgttatcggtattggaatcctgcgagccggcagagtcgctggaatcatttgtcggaccctgcatatcgcgaccggactgcgccctctggctggtctgctgcgactgctgatggaatgaatctggaaagttttctgaattaaaaacgcgacatggacggggcattcattgcggcaatggtgttaggctaacgcgtatgcctataaaatccgaagtcattgcgaaccccaagtcggagcgcgtccgccgcgtgtccgagctcgccgatcgaaaagggcggaaacggtctggccgtttcatggtggaaggcccgcaatcggtgcgcgagctgctgacatggcatccaggacttgtcgaggatctctacgttgaggtcgagtcggcacagcccgatgcctcgtttgcgacacctgtcgtcgcgcagatggcgggcaaggccatgcaatccggcgtgtatgtgcacaaggtcactcatgcggtgatgcaccgtatgagcgccgacgcgcaaggcgtgcttgccgtcgcggacatgcaggctttcctcgattcgtccgccgctccggacgatttcgacgagcatgcgatggtcgccgcgttttggcaggtccgcgatcccggtaacgccggaaccgtgattcgttccgccgacgcggccggctgctccgccgtggtattggtcgacgactgcgtggacgtgttcaatccgaaagtgatccgctccaccgtgggatcactgttccaccttccgattctgaccatgggaacggacgacttcttcgcatggtgcgatactcacgagttgtcagtgtatgcggccgatgtatatggcacggattcccggcagccggaatccctgacggatgtaatcgctgcgccggaaacgcttgccggcgccaaagcggtgttgttcggcaatgaggcacgcggattgaccaaggaagttttggaacgaaccgataggatcgtgtccataccgctctatggcaaagcggaatccttgaacctcggcaccagttcggcggtaatgctgctgagcttggctatgtcgagtcatgttgaaagaatgtaaagtcggaaaacgttgaaattgcgcgtttttcgcgtaaaacaaacgggaaatgagaaaggtatctcgtggcagaaggtgcggtattcgacgcccaagcggtaaccgatgcggttgccgagggcatcgcgaaaatcgaaaacgcctccagcatggaggaattgaaagccatcaagacgcagtacgccggagcggaatccgcgatgacgcaggccagcaaggccatcggcgcgctgccgaaggaccagaagaaagacgccggcaagatcatgggcaagctgcgcgctgactttggtcgtgcgtatggcaccaaggaacagcaggtcaaggccgaggaagaggcccgtgcgcttgccgccgaaaccgtggacatgactcttccggtcaatcgcaagccgcttggcgcgcgccatccgttgccgaaactgatggaggatgtcgaagacttcttcatttccatgggctggcagatttccgacggtcctgaagtggaaaccgaatggtacgactttgacgcgctgaacttcggccccgatcatccggcacgccagatgcaggataccttctacgtcaagggcaatcaggccaaggacgccgcaggattcgtcggatccaacatggtgctgcgcacccagacctcctccgatcaggtgcgtggtctgctcacccgtggcgtgccgctgtacatcgcatgcccgggccgcgtgttccgcaccgatgagctcgacgccacccatacgccggtgttccaccaggtggaggctcttgcggtcgacaagcatctgaccatggccgacctgaagggcgtgctcgataagcttgccgtggccatgttcggcccggaagccaagacccgtctgcgtccgagctacttcccgttcaccgagccgagcgccgaactcgacctgtggttccctgacaagaagggtggcgcaggctggctcgaatggggcggctgcggtatggtcaacccgaatgtgctgaagtccgctggcctcgatcctgaggtctacaccggcttcgccttcggcgtgggcgtggaacgtaccctgctgctgcgccacgacatcaacgacatgcacgacctggtcgaaggcgacgtgcgattcagcgaacagtttgtgatgggggagtgattgacccatgccaatggttgacattgattggctcaaggaccatgtcgaggttccggaaggccttacgtacgaacagcttgccaaagatctggtgaaggtcggtctcgaagaggaagagatccacacctcccagctggtcggtccgatcgtcgtcggctacgtggtcgacgccactccggaaccgcagaagaacggcaagatcatcaactggtgccacgttgacgtcggcgacgaatacaatgagaccgatgagaacggcaacaaggtgccgcgcggcatcatctgcggcgcgccgaacatggctgccggcgaaaaggtcgtcgtaacgcttcctggcgctgtgctgccgggcgatttcaagatcgaaccgcgcaagacctacggccatatctccaacggcatgtgcgcttccgaacgcgagcttggattgggtgatagccatgacggcatcatcctgcttcgcaagtacggcttcaccccggaagagtatgagaagctccagccgggtgacgacgccatgcacctgctgcacttggacgagccgctgctggagatcaacatcactccggatcgcggctacgcgttctcataccgtggcgtgtctcgcgaataccatcattccaccggtgcggcctacaccgatccggctgtcgccctgaacgagaaggcgccgatcactaagggcctgccggaaggcaccaagaccgacatcgaagtgatcgtcgacgacaataatccgattcacggtgtggttggatgcgatcgctattacgctcgcgcggtcaagggcttcgatccggccagccatacgccgaattggatgcgtcgccgcctgacccgcgcaggcatgcgttccatctccttggcagtggatgtcaccaactacgtgatgctcgacttgggacagccgatgcatgcctacgatctggataagatcgaaggaccgatcgtggtgcgtcgcgccaacgaaggtgagaagctcaccacgttggatggcaaggatcacgatttgagcgtcgaggatctgctgatcaccgattccccgaatggcgaacgcggctcccgtgtgcttggcatcgcaggcgtgatgggcggcatgtatggcgaggtcactgccgaaaccaagaacatcctgctggaatccgcgcacttcgatcaggtgtcgatcgcgcgttccgcacgccgtcacaagattccgtccgaagcctcccgtcgtttcgaacgcggtgtggacgaccagctgcagccggcagccgcccaaatggccgccgaactgatggttaagtacggcaatggcgagccgagcgagcacccgaccgacttcaataccgtctctaaccgccgtccgatcctgttcaaggcttcggaagtggctcgtgtggccggacttgacacggacgtgaacaccatcagcgacattcttaccgacatcggttgctccgtcgcaggaggcggcaacggcgagttttccgtggcgcctccaagttggcgccccgacttgaacgagccgtgcgatctggttgaggaagtggcgcgtcttgtcggatatgacgagattcccgtcaccgtgccgccggcaccggtcgaaggtcaggtcggtctgactgctgagcagctgcgcaagcgccaggttgccgatgaacttgccgaatacggcatggtggaaacgttgagctacccgttcgtcggcgatgaggattacaagaacttcgcgctggacgtcgctgagacgaagaacgtcagcgtggagatcgccaacccgctcgccggtgatcgtccgttcctgcgtcgtgacattattccaacgttggcacagaccgttcagcgcaatctacgtcgcggcgtggagaatgtgtcgctgtatgagatcggccacgtgtatctgtgggatccgaacgctccggcgattccggcactgccgggtgcagtcaagccgacggacgagcagcttgccgcgcttgatgccggtcttccggaccagccgatgcatgttgctggcattctgaccggcaacgccgttgactccggttggctgggcgagcgccgcgcagtggattggtctgacgccgttgaggcggtgcagcgcatctccgaccgtattggtgcagctctcacgctggatcagccgaaggctgaagatgtgccggcacaatggcatccgggtcgtgcggctcgtgtgatggctggtgacgtattcgtcggtatggtcggcgagcttcacccgcatgtcaacgaggtgttgggcttcccggcccattccgcggccttcgagttggatttgaccgcgctgttcgccacgttgagcggcaagccggtgcaggccaagccgatttccaccttcccgccggtcaagcaggatctggcctttacggtgtctaccgatgtcacggtcgccgagctcaagcaggttattgtcgatgccgctggaagcagcctcgaaagcatcgagctgttcgacgtgtacaccggcgaccagctgggcgaggacgaaaagtctttggcctacgcggtcacattccgcgctccggataagactctcgcttccgaagacagcgaagccatccgcaagcgtattgtggatgaagcgtccaagctgggtgcgcagctgcgcgcctgatcccgaccttcccaagaacagaggatgattatgaacgaaccggagcagtatcagccgaccaacaccgacgaacgtcaggagacggctgatgctgctccggtttcgtcatcttccgatgccgctgcgtcttcacagccggagtatggtcagatcaatcaacccgaatatggtgcgatgagtagccagctgccggccggttacgatccatacgtgtatggtgcgcctgaacctgaaccgcaacctgcggatgctgtacagcagcagaatatgcaataccaaacggggcaatacccttcaaatgggcagcaaccgatgcctccgtacaatgcgaacggacaacggaatccatacggcgccaacccgtatgggccgaatccgtatgatccgaaccaatatccgcagcagggcaatatgccctatctgccgaatctggatctcaacgatcctcggcagaatcccgcatacggccattgggatgcctatgcgatcatgtctctcgtgcttgccgtgctgatgccggtgccggtccttcccgcgttggtcggcgcgatttcgatgtggcgtaccaagaagctccatatgaaagggtatggcttggctctcgccgcggtgatcatcaatgtgttgtacaccttggccgtgatttggttggcgatgcatggtctttccgttgccgacctgtataacgagacgttgcagaatatgcttggcggcgcgggatcggggcagggagacgagtcgatcgctgcctgattcggcgtgttttctagtcctttaataattgtcatagtcgcgcaatgaccactatgcgacacgaaatgaatgcataattatgcaatgtagtgcataaagtgtatgctgaatgtgttttcagtgagtcaatggaaagagacgtgacatggccaaatacacagtagccgtggccggcgcgacagggtatgcgggaggcgaggccctccgtatcctcgcggcccatccaaatttcgaagtgacgtgcgtggccgggcattcatccgttggggacaagcttggcaagcatatgccacatattccgcagcttgccgaccttgtggtggaagacaccactccggaggtactgaacgggcatgacgtgatcatccttgcgctgcctcatggggcatccggtgcattggcttcccagcttgatccgaatgccgtggtggtggatttgggagccgaccataggcttgaggaaaaaaccgcatgggatgagttctacggcggcgacttctatgagcactggacttacggcatgcctgagctcattaccggcatatccgaagatggttcttaccagcaccagcgtgaggtgattccaggaaccaagcgtattgccggtccaggatgcaatgtgaccgcaaccacattggcgctgcagccgggcattgcccaagggcttgttgaaccggcggatattgttgccgatctggtggtcggctactccggcgcagggaagaatctgaagcgcgtcaatttgcttgcagctgaggcattcggttccgcattaccgtattctgtcggcggtactcatcgtcatattcctgagattttgcagaacttcgcccatgctgcaggaaagaacgcatccgcggcaaacgagttcacgctgggattcaccccgattcttgtgccaatggcccgtggcattctcgcttcggtttccgccaaactaaccgatacagcattgaatatgtcagatgctgaaatcaggcaggtttggactgacgcatatgcggatcaggatttcatgattgttttaccggaaggcgtcatgccggccaccgccaatatcatcggatcgaacgcggcccatattcaggtggccatcgaccgtaaggcggggcgtttgctggccttcgcggcaattgacaatctcaaccgcggcacggccggacagacggtgcagtcgttgaacgtagcactgggacttcctgaagatgcaggcctgacaaagattggagtggcgccatgagcgtaacgtttgcgcaaggtttttccgcggctggcgtggaagccggtatttccgcagtcgaaggtaagaaggatctggctcttgtggtcaataacggtccgctggatatggctgccggagtgttcacttcgaaccgtttctgcgcagctcccgtgcagtggacgcgcaagatcgtggccgacggtcatgtgaaagccgtcatccttaattccggaggcgccaacgcatgcaccggccagccgggttatgagcaagccgaagccacggcacaaaaagttgccgaactcttgggcgcttcagccgaggacgttgcggtatgctccactggtttgattggtgaactactgccgctcgaccatgtgcttgccggtgcggacaaggcgtttgcggccctcgcaaatactgcggaagcaggagcggaagcgtcgcaagccatcatgaccaccgacaccaagccgaaaaccgtcgaacttgaagggtccaatgggttccgtgtcggcggcatggtcaaagggtcaggcatgatcgcgcctcagctggccaccatgctgtgcgtgatcaccacggatgccgtggtaagcgcgggacagcttcaggcagctctgaacactggagtggaaatgtcgttcaaccgcattgacgttgacggttgcatgtccactaacgacaccgtgcttttgcttgcgtctggagcatccggtatcgaaccggatcccgacgagttcaacgagcttgtggcgcaggcgactgcctccttggcacgtcagattgtcggagacggtgaaggcgcgagccatgacatccgtgtcaaggtgaccggcgccaccacggaagatgcggcgcttgcttgcggtcgtgcggtagcggcatccaatttgctgaaatgcgccatcttcggcaatgatccgaactggggtcgtatcgtcagctcgctgggtaccgtgccgccggaagtcgctccctacgattccaataaagtcacggtcgacgtcaatggcgtgcgtatctgtgagaacggcggagccggacgcgaccgatccgaagtcgacatgactccgcgcgaggtgcacatcgacatcgatctgcatgcgggaaaagcggaagcaaccgtctggaccgacgatttgacccacgaatacgtacacattaatgcagattacgaaagctgattgaacggtaatgaccaaggaactcaaaggacctggattccattttgacgtgcataccgatttgcgcgccgaccaaaaggcggaagtgctgatcgaggcactgccatggcttgaggaattcgccggacagcgcatcgtcatcaaatatggcggcaatgcgatgatcgacgatcatctcaaagcctgtttcgctgaagatatggtgttcctgcgacaggtcggcttgcatccggttgtggtgcatggcggaggcccgcagatctcgcacatgcttaaggctttgggcattaagtcggaattcaagggaggtctgagggtcaccacgccggaggccatggatgtggtgcgtatggttttgacgggcaaggtttcccgtgaacttgtcggattgatcaacgctcatggcccgttcgcagtcggtctttccggcgaggatggtgcgctcttttccgccatgcagcgcaagccgatcatcaatggctctccaaccgatattggtttggtcggtgacgtggtgagcgtcgacgcatccgcggttgaggatctgatcaatgccggacgcattcctgttgtttcctcggtggctccaaatgaggatgatgctaccgaagtgttgaatgtgaacgccgattccgcggctgcggcgcttgcggccgctcttggagccagcaagctggtcgtgttgactgatgtggatggcttgtacgccgattggccagacaaggactctttgatcggacgcatcggcgtggagaacctacgtgatatgctgccggatttggagagcggcatgcgtcccaagatggaggcctgcgtcagggccatcgatggaggcgtgccacgcgcccatatcatcgacggacgcaagccgcattccatcctgaatgagattttcaccacagacggcattggaaccatggtcgttcccgaagacggtattgaaatgaggagttcgtatggcaactgaacagttggaaaacctcggcagtgaggacgccaagtggctggggaagtactcccgggtgcacatgaacgtgttcggtactccgctgcgtgttatggaccatggagaaggtgcgcatatctgggacgtcgatggcaatgaatacctcgatttccttgcgggcatcgcggtgaacgcactcggctacgcccacccgaaatgggtgaaggccgtcagcgagcaggccgccaaagccgcccatgtgagcaactacttcgccacggagccgcagatcaaactggcgtcgaagctcattgagcttgcgggcgctcccgagggatctcatgtgtatttcggcaactccggagcggaaggcaacgaggcggcattgaagcttgccaaactgtatggacgcaccttgccgggcgcatcgcctgccattggaggcaaaccggcgcgtatcatcgccatgacccatggcttccatgggcgtaccatgggcgcgctgtccgcaacgtggaagccctccatccgagaagcgttcgagccgctggttcccaatatcgaattcgtcgaagctggtgacgaggccgcattgcatgacgcgtttgccgaaaccggtcccggcaaatatggcaaaggtcctgtcgccgccgtcatcatggagctgatccaaggtgaggctggcgtgcgtccgcttggggccggctatgtgaagaaggcccgtcagatgtgcgacgacaacaacgcgttgctcatcatcgatgaggtccagacaggcatcggacgcaccggatcctggttcgcattccagcgtgaggatcttgcgggcggagtggttccggatattgtgaccttcgccaagggcgttgcaggcggtttcccgatgggtggcatgatctccttcggcgccaagctttccgcactgttcaccccaggctcccacggctccacctttgcgggcaatccgctcggagcggccgccgcgatggccacgttggaaaccattgaggaagacggtctcgtggccaacgccgaggcacgtggccagcaattgcgtgacggcatcatggcttgcggcaatccgcttttcgtctccgtgcgtggacgtggcttgctcgacgcggtcgaactcgcccatccatgcgcgcatgcggcgatgaattgggcgttggaacacggtttgatcgtcaacgcggtggcgccagatgcacttcgtcttgttcctccgctggtggtgaccgaacaggacatcgatcaggccatctccatcctcgcgaagattccaacggatcttcccaacgactgaacatagccggcaatcaaagcagactggatatttttgaaaggagccaacaatggcaactcctgaactgcgccacatgttgcgcgatgacgatctcaaccatgaagagcagaagcaagtgctcgaactcgccatcaaattccacaacgaccgtttctaccatcagccattcgccggcccgcagggcatcgcggtgatctttgacaagccgagtacccgaacccgttccagcttctccattggcgttgccgaactgggcggctatccgctggtcatcgacaagtccggctcccagcttggccgtggcgaaccggttgccgacaccgcacgcgtgcttgaccgcatggcctacggcgtggtgtggcgcaccttcggccaggatcgtgtggaggaaatggccaagtattccacccatccggtggtgaacgccttgaccgatgaattccacccttgccagattcttgccgacttccagaccattgccgagcatcgtggcggcgtcgacaatctgaaaaaccagaccatcgcctacctcggcgacgcggccaacaacatgtcgaactcctatctgcttggtggcgccgtggccggcatgaacgtgcgtgtcgcagggccgaacggctatctgccggatccgcagatcgttgccgatgccgaagccatcgcatccgaaaccggcggttccgtgttggtgaccaccgatccgaaggaagcggtcgccggcgccgactgcgtgttcaccgacacatgggtttccatgggcgaagaatcggaatacgccatccgttccaagccgttctgggattatcaggtgaacgccgaactcatgtcttatgccaaggaagacgccatcttccagcattgcctgccggcataccgtggcaaggaagtcacctccgaagtcatcgacgggccacagtccgtggtttgggatgaggccggtaaccgcctgcatgcgcagaaggcactgctgacttggcttgccggcaaggcccgcggcgatgaaagcctgctggcctgatgacggaccaaacacctgcgctgcaacgtcctgccacacgggccgctcgattgagcgccatcgagcaggcgttgctgacgcgcatcgtcacctcgcagtcgcagctgtcccagattcttgcggatcagggcatcgaagtgacccaggccaccctgagccgcgatcttgacgagatccatgccaccaaaacccgtttggctgacggaaccgtggcctatgcgctgggcagacagccggaggaaagcgcgtcggccaatcctgatgcaaaaacggaacagcagatgaatcgtgtgctttcgggactggtcacttcggtcgctgcggccaggaatctggtggtggtccacacgccgtctggcgcggcccagtatgtggcaagtgtgatcgacaagcagtccatcgatggagtgctcggcaccattgccggggacgataccgtcatggtgatctgcgccgatgacgattatgcgaaacagcgtgcgcaatggctattggacgtcgtgtccaaaggctgaatagccgtatagtggacacgacgcaccgtatatgcataaatatacagagcattgcatatactgatgaataacgtttgatgttagaaagggaaaccatgagcgatcagaatcgtctcgtcttggcatattccggtggtctggatacctccgtcgccatctcatacctaaaggaacgcaccggcaaggatgtcgtggccgtgtccctcgacgtcggccagggtggcgaaagcctcgaaaccatcaagcagcgcgcgcttgcctgcggtgccgttgaagcgtatgtggtagacgcccgcgacgaattcgccaatgaatactgcatgaaggcgctgaaggccaacgccctgtatgagggtgtgtatccgctggtttccgccatttcccgcccgctcatctccaagcatctcgtgcgcgccgcccaccagttcggtgccgacaccatctcccatggctgcaccggcaagggcaacgaccaagtccgtttcgaggtgtccatctcctccattgatccgacactgaaggccatcagcccgatccgcgacctgtcgctgacccgcgacgtcgagatcgcattcgccaaggagcacaagcttccgatcgtgcagaccgagaagagcccgttctccatcgaccagaacgtgtggggccgcgccattgaaaccggcttccttgaggatccgtggaatggcccgaccaaggactgctactcctataccgacgatccggcattcccgccagtcgaagatgaggtcgtcatcgaattcaagcagggcattcctgtcaagatcgacggtcacgacgtcaccccgctgcaggccatcgaagagatgaaccgtcgcgcaggcgcacagggcatcggccgtatcgatctgatcgaggaccgtctggtcggcatcaagtcccgtgagctgtacgaggctcctggtgctatcgcactgatcaccgcccaccaggaactcgagaactgctgcctcgaacgcgagcagcaccgcatcaagcgcgatatcgacaagcgctgggccgaactcgtctacgatgcgcagtggttctccccggcaacgcagtccctgaacgccttcatcgaagacacccagaagtacgtttccggcgaaatccgcatgatcctgcatggcggccgcgccgtcgtgaccggtcgtcgttccgacacctcgctgtatgactacaatctggccacctacgattccggcgacagcttcgatcagaagtcgtccaacggcttcatcgacatctacggtctgccgagccgtgtggccgcagcccgcgacgtcaagttcggcaatggcatcgaggttccggaaaacagcgtcgagtaagcgagttttttacgccgaatcgtcttgataatgggggagagcgtaccgttaggaccatcctgactggtatcctctccctcagtcatatctgcaaggagaatgaagtaacaatgaccgagagcacaaccaatggtgaacacctcgccctgtggggcggccgtttcaagtccggcccgtctccggaactcgcgcgactgagcaagtccacccagttcgattggcgtcttgccgacgacgacatcgcaggctcacgcgcccacgcccgtgcgctcggacgtgcgggactattgaccgccgacgagctgcagcgaatggaagacgctctcgacgagctgcagcgccgtgtcgattccggtgcgttcgctccgatcgaagacgatgaggacgaagccaccgcattggaacgtggactgctgcagatcgccggagacgagcttggaggcaagctccgcgccggccgctcccgcaacgaccagatcgccgcgctgatccgcatgtggctccgtcgccacagccgcgtcatcgccaaaatgctgctcggccttgccgcaacactgaccgaacaggccgaaaaggccggacgcaccgtcatgccggggcgtacccacatgcagcacgcccagccggtgctgctcgcacaccagctcatggcccacgtgtggccgctgctgcgcgatgtggaacgtcttgccgattgggacaagcgcatcgatgcaagcccgtatggttccggcgccctcgccggcaacaccctcggcttggagccggtggccgtggcccgcgaactcggcttctccaaggtaaccgcgaactccatcgacggcaccgccagtcgtgatctggtcgccgaattcgctttcatcgcagccatggcaggcgtcgacatcagccgactgtctgaagaaatcatcatctggaacacccaggagttcgcgttcgtgcgccttgacgacgcctattccaccggctcgtccatcatgccgcagaagaagaacccggatattgcggaacttgcacgaggcaagtccggccgtctcatcggcgatctggctggtcttctcaccacgctgaagggcctgcccaccgcttatgcacgtgatcttcaggaagacaaggaagccgtgttcgaccaggtcgacacgctggaagtgctccttcccgcgttcaccggcatggtcggcaccatggtcttcaacaaggaacgcctcgaagcggaagcgccgaccggtttcgccctcgccaccgacatcgccgaatggctggtaaagaacggtgtgccgttccgccacgcgcacgagctttccggtgcatgcgtgaagatcgccgaagaccgcggccaggaactgtgggacctggccgacgatgacttcatcgaggtcttcaaggaattccttccggccgacaaggctcccgaagtgcgcgaagtgctatccaccgaaggttctgtttccgcccgcaatggcaagggaggcacgtctccgctgcgcgtgcgcgagcagatcgtttccgcgaaaaccgccatcgaacagctgcgtgccttcgccaactccgtcagcgacggcccggcatacaagacgccggaatcattgctcaaataattacagcaacagtacatagcaaaggcaaagcggtgccactgacacgaacgcagatacagcagcttgttcgacttcacggccaggagatactgtgccatgagcatatgcagatcgaaagagtctgttaccagcatggcgtggtcaccacgtttgctcattccatccgtgtggcttgtctggccgtatggatcgctgacaggctgcacttatggcatagggtggatttgcattcgttgattcgcgccgctctgctgcacgattattttctttacgactggcatgcgcatgatggcggccgtcatcgtatgcatggtttcacccatggtggcaccgccatgcgcaatgccgtgcgcgatttccatctcaatagagtggaacgtgacagcatcgagaatcatatgtttcctttgacgccgataccgcctcggtatcttgaagggtatttggtgactgtcgcggataagatcagcgccacacgggaaacggtcagtcttgagcgcttctacaagccgaaagtcaatatgcatacaagtggaaagtgacggcgcgaaagcatgctcatgctggaatacctgttcttatggttcctgttctattcatttgccggatgggtatatgaatcgattctcgtgtccgtttcggaacgtcgcttggtgaatcgtggcttcctgaatggtcccatctgcccgatctacggttgcggagccgttcttgcgattgtgctgctgcatgatctgcataatcctttcgcggtttttctcatttcttcaatcggtgcatgcatgcttgaatatgtcacgtcatggggcatggaaaagctattccacgcacgatggtgggattacagtcatcgccgattcaacattcaagggcgcatttgcttgcttggagcgattgtggtcggtctgctgggtgtgctcatcaccgatgtgatacagcctgaagtgaatcgcattacacagatgattcctttgccagtagtgcactggatgtgcgtgattttcatggcgtttatcgtcgcggataccattattacagtgcttggcatcatcgatttggccgacaatcttgcgaagttcagcgaaaccgtgcaggcatatgcggagaaagccggtgattccctgcaatggggcaaagacattttccgagacaaattccgcgacaaggtgcaagacaaggtccaggattggtcggactcctcgcaggagattcttgccaatatgcaggccactgccgcatctatcctgaacaagcagcagcgtcgtatgattaacgcattcccgcgtctgcgtttcacggattccatcaaatacagcaagatcatcgaaactctgcacgaaatgctgcgtcgcaaataatcgcgcgataagcaacagcatgaaatcgcctgccgctcgaaagaacgacaggcgatttcattattgtttgcgatatgcgatttgcatgacaatcacgctatgacagtccatcggatcatttacggatttcgtatggagtgggcgcttccagcgacgtgtccgatcccttgtagtcggtgatgcccgcaccgacattcggatgttgcgcggaatacacttggtcggcgcaatacagcacgagcagcacggcggccacgatgccaagctttcgcgcatcgattctgctgagcaggttgtcgagggccggagccagcagatatacgatggccaatccgccaaggccgaacgtcaataatccttcggcgcagatacggccgttgatatttagaaagtatccggtgtaatcccaccagcgttgaccatcatgcgtcatctccagataccacgatgagaagtattccaagcagccgcacagcaccatagccgcgacgaattcaagcgctggcttttcgcgcagctttttgagcagaaccagaatgatcactccgccggtgccatagatgggcagccaagggccatgcagcgtgccacggttcacgaacatgtcttcggaaataaatgcgagacttacctcccacacccagccgacgaagcaaaagatgaagaacatcatgatcagattgaccagtgagtagctgtggtcggcgctgatggtacgtgattcacggaatttgaacggcatcggagcaggcgcaagacgccccggataaatggagccattcagaatattctcgccgatctgcatctggtgaagatcctcacgatactcttcatagcggttcactgcgctggcatgcagaatgcggatgccaagccactcagaaagaaatcctgtgaatccatgcggcttgggcgctggaacaagattctgttccagctgtgctacggattgggcgacatcggcgtacgtggtatggagcgtctgcgggtcggccttgaagtacaggtattcgtcgttgagcatctcactgcctgcaatgccggtagtcttggccatcgaacgcacgtacacatagtattccgcgaagaacgcggcattgtagccattggaatagaagatgccgctcaagccgaaggtgataaggttgagcaggtaccagccgaggaacgagcagtccgccacgaagcattcccatttatgccctttcatcatgcgtcgggacaagcgaatggcgtccaaagcctcgatattcggattctccgcaacgatgtacggcaccatacggtaggaatattgcttgatgaagaagccgacgatggtgagactccaaaggaacaggaacacgttttccacaaacatggtccatgccatgcgcggccatttgcgcgtgtgaatggggtagaagaagcgacttgccggaagcttgttataggaacgtccttccaacagcatacgtgccatgacgatgcggtatgtttcttgaatgaacagccagacgaaaatgtagacggccagcgagagtattaccggcacggcgatggagacgccgccgttatgggtgacggaattaatggcgtcggccacggcgatcaccatcgagccggatgcaaacgagttgagcagggacgcgattactccgcggcgacggccgaacgtggcatcggtatcgttgttgacgatctgctcttggttttgcttgaccttttcacgggcatcgttttcattgcctacggcaagatcctgcaatacgtcatacatgtcgttggattgcgtggaatcctccgtttgcggggtgctgatcgaaatgttggtgctgaccgagagcgtcgatgaagtgtacgcaacaccgaacaccgaagcgaacaggcaaatggcgactatcatccaataatgttttctctgggctttcttagccgcaaccttcatgcctttgcggtccatgcaggtatctcccttcttgatatggggatgctccttctaactttacccgtatgcacgatggttggtggatgatggggaaacaccgcgtgcgcctgtcttcatcttctgcgaaactgtagggtgcgtaaaacgcagtatcatccgcaattcaatagggagaaagcacagctatggctcacgtcatcgatttcaaggaggccggtttcgagtccgtcctcgatgaactggaatggcgcgggttgatttcccagtccactgacagggatcgactcgccgaagcgttgaacggagatcccatttcctattattgcggtttcgatccgaccgctgcctctctgcatatcggcaatctggtgcagctcatcaacatgcgtcaccttcaggcagcaggccatcatccgattgccctggtcggcggcgccaccggcttgatcggcgatcctcgccaatcgggcgaacgtacgctcaatccgaaagacgtcgtggctggttgggccgagcgtctgaaagcgcagatcggcggcattctcgaagtggaaggcagcaatccggtccgtttcgtgtccaattacgattggatcgcctccatgaacgtcatcgacttcctgcgtgacgtcggcaagaacttccgtttgggtaccatgctcgccaaagacaccgttgcccgtcggctgaattctgaagatggcatttccttcaccgagttcagctaccaggtgctgcagggcaacgacttcctgcacctgttcgacgaataccattgcgtgcttgagcttggcggatccgaccagtggggcaacctcacgtccggtcttgacctgatccacaaggtacgtggcgtggatgtgaacgtgttcaccagcccgattatcaccgacgctcagggtaagaagttcggcaagtccgaaggcaacgccgtctggcttgacggcactatgctgagcccatacaagttctaccagttctggttcaaccgccctgacagcgagatggagaacctgctgaaggtgttcacgttcttgccgaaggcggagatcgaacgtcttgtggaggaaagcaagaccaatccgggcgcgcgtgaggcgcaacgcaccttggcttgggaggtcaccagcctggttcatggtgaggaagccacccgacaggccatcgaggccgccggtgcgctgttcggccgtggcggcgatcttgcgggcgttgacgagtccacgctcgaagctgctcttgacggcgtgaagatcgacggcgagttcgccaaggccgcggtgggcgaccgtgtggcggaagccggcatgaaggccggactgttcaagtcgatttccgaggcgcgcaagacgattaaggctggcggcgtgtacctgaacaacgcccgtgtcgaagacgaagagcaggttttgaacgaaaatgacttcctgcatggacgtttcgcattgattcgtcgcggcaagaaggccctcggcgtcgtcgaaaacgtgtgaggcaatcacgagcggcgcaaacaaacgtaaacaaagaacaaacgaagaccattttcaaggaatacaaggaatataaggaacagcatggcagaagaacagcgcggatcgcgcggcaagtcctacggcaaccacaagtcctacggctcgggcaagccgggcgatcgcggcggcaaaggattcaagccgcgtggcaatggcggcaagtcctacggccacaagtccggcagcttccacaacgacgatcataagggcggataccgcaagggcaatggcggcaatttccaccgcgaccgcgatttccgtcgtgacggtgagggggaaggccaggagcgccgcttccataacggtccgcgcaagttcaaccgtgacggcgagcgtcgtgacgatcatcgcgattatcgtggcggtcgtggagacaatcctcgctaccagcgcgatggcgagcgttccggtttccatcgtgacgatcgacgtgacggaaaccgtaaagacttccaccgtgatggcgatcgccgtaacttccaccgcgacaacgatcgcagggatttccatcgtgacggtgaacgccgcaattaccgtgatggcgagcgtcgtgacttccgtcgtgatggcgatcgtcgtaacttccaccgcgatgaccaccgtggcaatgatcgtcgtgatggcggccgccgtaatttccgtgatggcgatcgtaaggatttccgtcgtgacgatcagcgccgtgacttccacaaggatcgcgaccagcagcagggcgaggagcgtcgtgagttcacccgcgaagagaagatggcctaccgtgaggagaagcgtggcgagtacatggccaagccgcgccgcaattccgatggcacggtgagcttcccctcgcagaacccgtacacgcatcgtcgtcctgatgagccgaagatgccgaagggcatcgaatggcgtatgctcaccaccgacgatcgcgaacgcctgcgtggcctgtcgaaggaacatgcggaaaacattggtctgcacattcttgccgcgtacacgcttgaggagagcaacccggagctggccctcgaacatgccaagtgggtggcccgccaggcttcccgcatcgatttcgcccgcgagacactcgccttcgtggcataccgtcagggtgattacaagcttgccttgcgtgagttccgcaccgcgttccgtatgaacggtttcctggattatttgccgttcatcgccgactgcgagcgtggcatgggcgagccgaagaaggccatcgaagtggctgtgagcgacgatgccaagtatctgcgcggtgaagccaaggctgaaatgttcttggtgtacgctggcgctctgggcgatctgaagatgtgggacaaggccatcgagatcgtgcacacgctgggccgttccaagggattggccggcgaataccgcatgcgtgcggtgcaggccgaacagtatttccttgaagaggccggccgtaccgatgaggccatcgcattggatcgtctgctcgacaagctcgaactgcagtacgccgatgttgaggatgatgagacttccgacgatctggttgtcgaatacgacatgcaggagctgaacgacgaactcatggacgtgcttggcatttccgaagatgacgcgcagtacgctccggaagaccctgagaatgaggaagacgaatccgaagccatcgacgagaacggcgaaaccaacgacgaaacccagcttgaggccgaagagacggaagcaggcgcggaatccgatgacgagccggcagaagctgacgatgctgcggaagatgacgccgatgatgacggtgaggctgaagaggccgaagagtcttcggatgcttctcccgaatcctccgaagataacaagtgaggtgacgtggcccgcatgctgaagtccacgaatcagccgctcagcgaagcatactcgctggcactgcttgatcttgacggcgtggtctaccgtggtaagaacccggtggaacatgctgccaagaatatccgcaaggccgaatccttgggcatgacggtggaatacaccaccaacaattcgtcccgacttcaggccgtggtggcagaccagctgaaggggttcgatttggatgtcgaaccctggcaggtcatcacctcgtcggttgtcgccgcgcgcatggtggcacgtgccgtgcctgaaggttcgaaggttttcgtgcttggcgcccagcatctgcgtgaggaagtggccaagcaaggtcttgaagtcgtcgattccgcagaagcgcagccggtcgccgccatccaaggatggtatcccgacatgtcttggaacgaaatggcccaaatcgcctatgccgttgagcatggcgcgacctatttcgtgaccaatcgtgatctgaccattcctcgtgaacttggcatcgcgccgggatgcggttccatgatcatggcggtgatcaatgccaccggtgtggaaccggtttcgtccgcaggcaagccggaatccgccatgtatgacgaggcgcgcattctcgcagcccatgatgatggcgagccggtggacaaggaacagtgcctcgccatcggcgaccgtctcgacaccgatatcgaggcgggcaatcggggcgggtacgattcccttgcggtgttgaccggcgtcaccgatccgcgcgaactcatgttcgctccggcgtatcttcgcccgacctacatcgccaaagatctgcggggcttgaacgagcccgctcctgaagtggtgcatgatgagggcgcatggctgtgccgcgatgcgaaggcccgcgttgacggcgaccgcctgtatgtcaccgacatcaccagcgtcgacgggttgcgtgccgcatgctgcgccatgtgggccgcggccgacagcgggcgagatgtgagtagcgtgatcgttccggaattccgtatttcctaacgaacaattcgtaccgattattggaaaaccattgcgaaacagtgattccactcaggttgttcgtcttgacgttgcgttgttggaacgtggtctgaccgacagtcgttccaaggcgcaacgtctgatcgcggatggcaaagtcagtgtgaacggtgtcaccgtcaccaaagcatcggcgaaagtcggtggtgatgacgtcatcgccgccgataggggagacggctacgtttcccgtggcgcatacaagcttgtcggcgcgttcgaacggttcgccgacgtcggattgcgttccgcgcaaggattacgttgcttggatatcggcgcgtccaccggcggtttctgcgacgtgctattgcgcaatgatgccgcgcaggtcatcgctttggatgtcggccatgggcaattggatccgaaaatcgcgcatgacgaccgtattatcgaaatgagcggcgtcaatattcgcgacgtgtatgcggaggatttgccgtatcgtccggaaatgattgtttccgacgtatcgtttatttcgctgacatatgtgattccggtgatcgcaagaatcgccgcaccgcaggcgcagatcgtgctgctggtcaaaccgcagttcgaggtcggcaaaggcaaccttgggaaaaacgggattgtcgaaagccaggaattacgcgaacaggcgctgtcctccgtcgtggcatgcgcggaacgcaacgggcttgacgtgcgcgccacaacagtatctcccattgaaggcacgcatggcaatatcgaatatctgctgtacgcggtcatgcagtgaaacagcgaccggttgagagaaccgtgtctgcagtgtaatcaaggcaaataagataagtaaaagaaaaaccggaaatcatgattatgaaattccggatttttccatatggaaagagcgtgtcagctgcgtaggaaccggtcgatttgattctgcttgcccatgatgatgagttcgtcgttgcggtgcatgatgagctctttcgaaccgtattcgaattccttgcccggcgatttgatgccgaccacggtaatgccgaagcgttcatgcacgcgagcgtcttcgattgtgtagccgaccacatgcgcgggggtatggattttgacgacgttgtatgcgccttcaagctcgatgtagtcaagatagttgccggacacaagatgtccgacgcgtttgccggcgtcggtttccgcgttgatgatgtggcgtgcgccgatgcgttgcagaatgcgggcgtgttccttcgacacggacttggcccaaatgtcggagatgccggcgtcgagcagattgccggcggtaatgacggaagcttcgacgctgtcgccgatagccacgacggccgtgtcgaaatcggatgcgttgatctgctccaacgccatcacatcggtcatgtcggcctgcacggtgggaatctgcgaagaccaacggttcaccagttcgccgtctttgtcgacggcgagcacatcctggcccatcatgtcgagcgtggtggccacagagctgccaaaacgccccaaaccaactacgagaacgcttctggtgttgttggccatgatgttatgcacctttcgaaattccatcttcaaaaatctatattcatgtgtgattgcaggcaactgtaagtatatgaagccgtatcgtcagccgaccacgatctgctcggtggggtagcggacggcctcgagattgtgtggacgcgaaatcgcgtaggcgatggtgagcggtccgagacgcccgatgaacatggttgcggcgagaatgtatagcaccgtggggctgctttcactggctacgcccaccgagtagccacccagtccgaacgcggagcaggtatcgaacagtgcgtcgcacagcgagcagccggtgatgatcatcagtgccatcgacaccacggtgaccagcatgagacatgccgtgcttacggccacggcggtcataaccgcctgcgtgtggatgcggcggtggaatgcgttgatgtcgtggcgtccggtgaatgcggcacgacaggtcagcagggtcaccgcgaacgtggtgacgcggatgccgcctgcggtcgaggtgctgccaccgccgatgaacatgacgatggacaggaacactttggttgcgtcgctgacgcctggcatccacgacaggtcaaatccggagcttcgtggcatgacggccgcgaccatggcgtgccagaggcgcggctcgatgccgtttccggcgaacagcagcttgttgttccattccatcagcaggaaccacgtgaacgaggcgatcacaatgcagaacgtggtggtcagtgtgagcttggtgtgcaggctccaacgcttcggaggacgacgcatacgccaggaacgcatcaggttcagcaataccgggaagccaagggttccgcagaaagcactggctaggatcggcaggccgaccgcccagttgttgacatgcagaccggcgccgtcgggggtgaagccggcgttgttgtacgccatgaccgcgaagaacagcgattcccacaatgtgtggcgcacattaccgtggttgaccttgtagaggccggggaacaatgcgacgaatgtgatgccttcgatgacgaatgcggtggtgatgactacggtgagcacgcctttgatttcaccgagcttcgtagtgccgagttcgttggcggtcagcatgcgctgcgtggccttgagatggtggttcacggccaatgcgatcaaggaggcgaacgtcatgacgccaaggccacccatctgcacggcgaagatgagcacgccttggccgaaggtggtccaatgcgtggtggagttgacgatggagattccgcatgtggaaatggcggatactgcggtgaagaacgcggtggtgaacgtggtggtttcgtctttcggcgtggcaatgggcgtcatcagcaacgtagtggacaacgccgcgagcgtcagaaagtagaagatggtcagacggcctggatggttgacgagtcggcgcgtgaggccgcgcttgcgtggcttgcggtcttccgccatggccttctcgaaagtatctcccgagaaccaccatgcgtagccatgtgaggcctcacgattggaggaggactcgtcaaagacgaggtttgacatgccgttcctctctccttttcttacgatattcggtcttcgttcctgtgagctattgtaagcatatgtgcgactaacaggctatttgacggctgacattcctgattcgtggcttgcatcggagacggatttgaggcgtgttcgcgggttttggcatgttttcgacgcgcattgccggttttcgttcatttgttcgattacactggaggtcggtgacgtcttcatgggcgttttccatagggcgtttccttttgctggaaagggattaacgatgttcggtacccgtcatgcggtggtggtgacgcatagtcgtctgagggagagtggcacggtggttgaggaggctgtcgggcagctgacccaggccggtttcgaagtgtcgatcattgacaatatcgaggcgccggatttcggcaagcagccgccggtggtttccgaacgcactgagatcgtggtggtgctcggcggggatggcaccattcttcgagcggctgaactggtgcactgcaccagtgtgccgattcttggtgtgaacttgggacatgtcggctttttggcggagtttgaaagcttccagatgagtgaggcgatccgcagggttgccgagcatgattattccattgacgaacgcatgattgcgcatgtcgacgtgtggctgccgggagcaagcgagccgattgaggattgggcgttgaatgacatcacgttggagcgtgcagaccgtggcaaaatggtcgaactgtcgattcgtgtggatgatgtggaaatgagctccttcggctgcgatggcgtgatcgtgtcgactccgaccggctcaaccgcatacgcgttctccgccggaggaccgatcatgtggccgaacgtgaaggcgttgcagttggtgccgttggccgctcatgccctgttcgcgcgccccttgattattggctccggttccacattcgccattgatatccttgaggattccacgtcggatggttggatctgctgcgatggccgtcgccaatgcgcgttgccgcggggcactagggttgaggtgcgcgaatcgaagagcacattgcgcctggcccgtctttccggcgtgccgttcacgaatcgtctggtcacgaaattcgatcttcctgttgtcggttggcgcgagcaggcgcgtaaaaccgggggagtgcatcatgggcatgtgtttccggaagataaagaaacgaacgagtaaaaacactgatgcttgaagaacttgagattcataatcttgggccgatccgttccgcgctgatcgcgcctgccggcggtatgacggcgatcaccggtgagacgggtgccggaaagtcgatgctgctcagtgcgattcggctgatttccggcggtccttccgacggtgggcgcgtgtcggtcggagcgaacgaggcgtgggcgcagggcgtgttcgaggtcgcctcgtcaccggccgcggtcgcagccgcgcacgaagcgggtttcgaacctgaagacggagaactgttcctgtcgcgcaagatgcctgcctccgggcgctcccgcagcatgctgtctggtcgtagcgtgcctcgttccgtactggggtcgatcgcagcggagctggtgacgattcatggtcaggcggaccagttgcgtatcgcatcttcgacgcggcaacgtgagtttttggaccgctatgccggcgatgatgtagcgttggtcgcatacggcaaagcttggaatgcgcttcgtgccatggatgatcggttgaaacgattgtcgagccaggagtcgtccatgcgccagcaggcggattacctgcgcgagtccatcgaacgaatcaaccgcatcgatccgcagccgggggagatggccgagttgcgtgctcgccgtgatcgcattgagaacgcggccgagatcgccgaaggggtgaaccgtgcgttgagcgcgttggatgcttcgcaggttgttgacgatgttgaatcatccagcgccaccgatctgattgatcgcgcgtcgcaggcgcttcgcgccattcatgtggacggcgtgttttcggaattggctgatcggcttgattccatcagcactgatttgtctgatgtggtgttcaccttgtcgggcgaagtcgacaatgatctcggcatggaagacttggacgccatcaacgggcggatccatgagcttgacgaattggttcgtcgttggggtccggaattgtcggacgtgattgcgtggcgagatcaagcggtgttcgacttggaggatctggacgcgtctccggaaaaagttagtcaattgcaggcggaacgtgaaaaactgttcggtgaagcgttgaaggcggcgcgtgcggtaagcaaaaggcgtgtcgctgccgcgaaggaacttgccgccaaagtcactgcggaactcgaatctcttgccatgagcggatcgaaactagagatccatgtatcggaacgtgaacatttggacgcttccggcgctgacggcatcgattttctgttcacgccgttcccgggttcgccgcaaatgccgatgggcaaaagcgcgtccggcggcgagctgagccggctcatgctcgcgcttgaactcgttgcggcggaaaaacatgtggtggcgggcggttccgtacctcccatgacgttcattttcgacgaagtcgacgcaggcgtcggcggcaaaaccgcggtggagcttggcgcgcgattggcgaaactcgctcaatccgcgcaggtcatagtcgtcacccatctgccacaggtcgcatcctgggcggacgaacagtacgtggtcgccaaaggtgaaatggatgacggatcaatcgccaccaccatcaatcaagtgcgtggggaggcgcgtgtgcacgaaatcgcccgtatgctctccggcagtgaaagcgaagcgtcgctggaacatgccgaagaactgctcaaatcatcggttctcgattaacgtaagatgcacaataataaaggaggatatcgatggcaggcaatcaaggcaagggcgccattttcgatcttgacggcacgctgcttgattccatgggcgtttgggatcaggttgacatcgattttctttcaaaacgaggcattgacgtgccggacgattacatgacgaaagtcgcggccatgcaattccgccagatcgccgaatatacgattgcgcgtttcagccttaccgacactcccgaagagctgatggatgagtgggatcatatggcccgcgtcatgtatgccacagtggtcgaagccaaaccgtatgcacgtgaatatctcgctcaattgaaagagagtggagcgaaacttgccgttgccacatcgctgccgccgatgctgagagagccggcgatgaagcatgttggcattttcgactacttcgatgaagtggtcagtgtcgatgatgccggcgacgtcggcaaagaccagccggacgtgtatctgttggctgcatctcgcctcggagtcgagccggaggagtgcaccgtgttcgaggatttgctgatcggcatgcgttccgccaagtcggttggcatgaaggtatgggccatgcacgacgattcgtccgatgccgattggccggctatttgcggtctggcggatggtgtcatgttcgacttccatgacgcgcctgccgtattgtaggaaccggcgtcgtacggagatatatgcatttggggctttccgttgattcggaagaccccaaatacgttccataagagtctaccggctggctcggttcagatgtccttgctgccgtaaatatgcagcgatatcttgctggagaacaccaaggcgagtacgtcgatgatcaagaatgtcgctaatgcaatggcttggtgccggctgatcgcctcggccagctgttcgacggtcttttcgagttccggcaatgccttgcacagtccgatgaccgtgcccacgatcacgccgatgctcagaaaaatggcggccatggcacgataaggggagaaccggtacaggaacggctgcacgatggcgttgagcagcacgagggtcagcacggtcatcgcggcgaagccgatcgcatccgtcactttaactggctcgtgcatgatggtgccggcgcaggcgatgctgacggccacttccaatcccgccaccagatcgcaggcgataaggaatgcgaatcgtccgaggatctggtggttgcggttgatgggcacgatgccgttcatccaatgatggttgttcatttgttcataggagaacagggtgatattaagcatcaggaagccggaggccgccccgccgatggcggctcccgcaacgctgtcgagagtggaccctgtagccgccatcaggcatgtgaaacctggaacgtacgcgaagaagatggctatgtacgaccgcccgtagctgatggtacggttccagtccaaggaaatctgcctaaggatggcggtcatggcgtccgcgttcgctgtcgtgttcatcgtacgtctccttcgttggtattgccgattgccgtatgtgccgcggcgttggtcagtctgatcacatcctcaatcgaagcatgctgtgtcaggagaccgtcggtgccgccgatgtgtgggatatcctgcgtgcggaccaacgcgtcgaagccggttgcgtatgtgcggatgccgaccattgcccgccgcagaccatcagtaagctcatccggaccgcccttgaccaggcggaacgcgtcttcgaactcgtctttcggcccgctgtaatacagcatgccgttcgttatatacgcgaggaaatccgcgcaacgctccaaatcggcggtgatatgcgtggagaagattacgctgtgtccgccatccgcaacataatcggacaggatgtccatgagctcgtcgcgggacagtacgtccaggccgctggtcggctcgtcgagaatcagcagtttcgcatcgtggctcaacgccacggcgagcatgagcttcatctgcatgccgcgcgacagatccttgatcttcttgttccgtccgagtccgaaccgtctgagatatgcgtcgaacagattgtggtcccacagcgggtacattgggctgcttgtccgttccaccgcgtcgaccgtcatgtattcgatgaaatagctgctgtcgagcactacgcccagctgctctttggcccgctcctcatcggccatcgcgtcaaggccgagcacttcgattcgtcccgcgtctcgcgtggtcatattgaggatcagtttgatcaacgtggatttgccggctccgttcggaccgaccagacccatgatgtagccggacggcaggtcgaaggtcacgtcatccaatgtgaagccggaatcataatgcttcgtcaatccggttacgctcaaggccaaggttggccgcgttccttgggggagtgaggaatcgttcatgattgttccctgtacgctttctcgaacatgccaagcagatcaagtaggctgatgtcggcggctttggcctcgatggaaacttcacggagcttgtccatgatgcgttcacgcgcacgttccttcatgagttcgttgcctcgttccatcacgaatgtgcctttgccctgcacattctccacgagcccctcgtcggccagttcgttatacgctctggtcacggtgagcacgctgacgcgcagttccttggcgagcttgcgcagtgagggaagcgcctcgcctgctgtaagctcacccgacatgatcgcggacctgatctggttcttgatctgctcgtaaatcggttctccggacacggatgagatgatcagcttcaatctgtgcctctttttctgtatgtttcgtaggtgatatatctcccggccgaacagttagatgcaaactgtttagctgttatatataacagtaacacagaaaacccgtactgttattacgtgtcgcataacagtacgggttttgttggaatataaggaaatccgccgctccatgaacgcctcttgcggtcgacgattgacggaagcgacatttacttgcgttcgaggattcccgtatggacggttatgcgcgagtcggatggatgatacggcggaaacacaggtagatcagctacgccaacggcatggtcatcaacataggcagtgtagggaaccggcgatgagtcccacgccaatcatgattgcgattttcttcgcgccgaaggagagagcgtccgtttcggcgcgatccgtcgcctgggtggtgttgctatcttgctgcatgattgtttgttggggaaaccatctgttattccattcccttatagagttctttggctagaccaatcagtgacttgtctgagcctgctgggccaataaggcatgcgccgcatggcagtccatctgctgtttccaatatcgcgtatcgtccgttcatagtcgggtagttgttgaaacatcgacagatcaatcagaccgtgaacgcctttggtgtgatatcaacgacttgcgtcacgttgaagtcgatgtcagccgacagcagcaggtacacttgttgacgtggcatctcgaacatggcggcaatcatattgatggcgtgttcgacgctttgcgataatgcgtcatccagcgtactgctgaaacccattggaatcagcgtgccatgactgatcgcaaatggcagaggggctgcggacgttttcttggagatgatcacgcagccattccctggctctgacggtattgtaccggactcatccaaccgagcgaccgtttgatgcgctcgtggtcgtaccagcggatgcagtcgtcgaccgggacgagcacctcgtcgcgggtacgttcctcccaatgcccgggatggacggactccatcttcatgcgtccgaaggacccctccgcgccgtcgttcctcgggaccgaacatacgataatcctttcattcagtctccaagaaaacgtccgcatcctgtaacgtccggattcttgcatactttgggttttcggtcctgacgtgaaaggcggggacgtttccacgtgtcaagtcgacaatcggccagccataatgatgtgcgttgattgggggtgtccgcagcgaaatcggtggaacttgtccagcaggttctgtgatacgtcgagcatcgtgaatccatggggtgggggagttgcggctgtgcaacttacttgagttctaagcgacggttcgcggattatttgtcgatcgttcacgtttaaggcgttgcgtgttcgccttccgagcctattttgtcgcccgggctggcttgtctgacagcttcaatgtggcaaagcagaagaggtagaagaatgaggataatggcgaaaaaccatacggcaacaaaggaacagcggcaggcaggagcctggcgcaaacgcggtaccaaatcggtgggcggtggcatgctcgcgttgacaagcgctgtagtggcagcggccatgctcgcaacgccagcggctttggctggggaaggaaccgcccggtattacagcagcaagcagccgtatgttgcaccggcgagcacatcatattcagcaattccgagcagataccatcttgcatacaccgagtctgtggcaaggcatggctcgcgtggcctgtcgagctacaagtatgacgctttgctggcactgatggctcagtctgctgcggaaaacaattatgctggattcgttagcccagaggttggcaaggaattcatcaacaatgtcaatgccattactgcggtcaacgtgggcaacgggtatggcatgctctctggtcagggcgccatacagcatcagggcattggtgagagaatataccagcgtgatgctgatctgttcgccaatgccgcaaagcagggactgcgcgtctcataccagagctcgggtgagcctcgtgcaaccgaatccggagagaatttcaaactaggattcgatcaggcttccaacggtttgctggcgaatgcggttgtagcaccgaataatcctgcggataacaattccggcaagaatttcgacaagaacaccaccacgttgtatttccataagactgataatccggatggtacgcagaaaacgggcgaggccaaggagcgcgcggaacgttaccagcagttcgtcgcgaatgatgggggcatcgccgaagctgaggaaaacgtgacgaacgatccgtccatgaccaccgcttcgcataatctgctctctcaaatcttcactgacgatttcctcgcgtccatcggcaaggaggaaggccagcgcatctggtacaacacggctgacggcacgaaaaagggtgcggccaattgcgctgctggcgccgaccctgccaaggatgcgaacgcgtgcggtgacgccaagaagaagatcgcgtcggaacaggatgcggcaatggatttgtacaatctgtacatcatcgcggccgatatggaacaggagaacaccggatcccacacgttcaatttcgaccagtacttccaaggtcagcacgcccaggaggcgaagacgtttgcttggtcgcttgatgccgaggacttctatgagaagggaccggggcgcgcaggtcaggatgagacctaccgcattgcccagccgttgctcgacgatttcttcaatgcgatcgacacgagggagcgggccggcaccgccgcgacgttccgattcgcacatgccgaaaccattattccgtttgcggcattgctgaagctgcctggatcgcagcagcaggcgagtgaactgtacacgtatgagaataatccgtggcgtggcgaaagtgtgacgccgatggctgcgaatgtgcagtgggatgtggttgtgcgtgatggtacggacgtctcggggcagccgtatcagccgttggtcagaatgctgtacaacgagaaggaaatcggattcaacgattcctgcacgccaattgcggatggttcgacctggtataaggaaagcgagctgaaaagctgcctgaatggtaagggaaccacggttgatgcccgactgacggatgaggaaggtcagcctgaaacgccgggccatgaatcgacaccagatgattcgcagaaggctccgggtgcgaatgatgcgaacggccagcggaagcatccggtgaaatcgtccgcgaacggcggcgatgcggtcaagctcgccaaaaccggttcaaacgtgacgcccgccatcgtggcgaccgtcgtgatggtgtcctccgcgatttttggaggaagctacgcgcggcgttcccgccggaaggcttgatttgaaaccttatctcgaccaggttacggcctgacttgcaacttggccgcagccggacttcggtctagcgttttacatctgatgcgctgttcccaattcccatcctcgggcttggaagcagcgcatcattgcgtcaaggtgcggtatgaggtcagtgcgtatgcggctggggcttttcgcgtactttggcggtgagatagtccgcttccaccttccatacggtgacggcgcgtacctgctggtcggtgaattccgcatgttccatgccggcctgctgcttcatcagcagtgcgagcccctggcgtgcctcgtcaagatcgtcgatgatggatgcggtgccattgccgacgatcgacttgaacgcctcgccccaattgcacaacgtacgtccttcgaccacctcgcagtcggtcgccatctcgaacgccatgggaagcgcgttgtttgcggccttgaccgcgtccatcttacgtccggtcgcagaaccatggaaatacaaggtgagatgattggattccgcatcgaacacgtatccgaaattcaacggcacgatggtgatgccttccgcatcggtgtatgcaagactcacgatcttgcacgttgcgataatcgcatcgatctgctgtggttcggttacctcacggtcggcacgcctcatcatgcgatgccttcccgcaaccgtccgctcatcattacgacgcgtcaccatggcacgttcctctctgctggatttacacacccagcctaccggctccctcagccgatgctgtatacgccggaaccatcatcccaccaagcatgatccactggctccggctgcacaagacgtttcggtcccttcagcatttcaatcgccttcaactccaaacgttcacgctcctcagccaacgcatcgccaacacgatcaagcaaaccgcacacgcaagccgtgggctgacatgtcggaagacgatgatttattgtcggaagtctgagtctcatcgcgctttttctcttctcttacgaggccgtgccccgtgccgttacgagaccttcgaaaggctcgccgaagagcccatgttcgaagacatcggcacactgcacgaccactatcaggaattcggcatctacccgctactgacactgcttgcgtcattcgcatgaaaaagctgatttataaacaaagcggcatcgcattccagattagaaaacggaaccatcaagcttatcaagcgcacgcagcagagaatcaacatgacctttcgcgcgcacgttgtatcgggcaacacgaatcactccatcaccgtcaatcacaaaagtcgaacgaatcacaccctcgtaaaccttgccatacaatttcttctcaccgtacgcaccatacaaacgatgcacggtcaaatcagcatccgacaacagagggaacgtcaaatggtcgcgctcgcggaatcggatgagcttgtccagcggatccttcgatataccgagtacggtgaatccgcgggagcttaggcgtgcgaggttgtcgcggaagtcgcaggcctcggtggtgcagccgggagtcatcgcggcagggtagaagtataggatgatattttggccgcgcaatgcggagagcgtgacactaccgccgttgtcgctgggaagtgtaaagtccggggccgttagtcctgcttcgagtcgtgcggatgtacgggagtcctgcgctgctggggttgctggcgaattgatgtcggacatgattatctccttactgttctttggatttcaagtgccgataccaagcgagaataaacgtcatcatacccgcctttgcgtgtgcacagttcgttgactcgttgcgcgccgccgcgaactccaaacagtaggcgtcagacctgtcaagggaacaaatcggaaaaagatcctgcgcgaagtatggtttgaaacgtgtcatcgtgcgcattttctggatctgtcggccttgtgctgagcaaagcaggctgtatctcgcctatgtatggcagatttcgggatgtgacatgaggcatctcgcttatatatggcagtcggtttcgcgaaaatgaggtttttcatgcccccctacctactgctttgacggactgacctgccatatataagcaagatatctccggacaagttcgcaaatctgccatacataagcgagatatgagcaaaacggtgttcaacaacaaaggaaacgtcaaatgatcgcgctcgcagaatcgggcatgagtactcttagctactcttcggaattcagaagccaagtggaaaacgaacggtcatacaattccgtttatctcctatgatgttttccagaacggggaaatttcggggaagcatggcgcgttgaagagagggacatccacgtcgcaccgtacgacaacggagaacaaagacgcggcagcgaacgtcaccgcgaaatccatatggttcaaacgacagctcaacatggcggttgcggcggtaggcagcgtcgcattgtgcgccaccatggccttcgtcgcggcactcaccggctacgtttcctcaagcgacctagactccgcagcatacaagatggcggcctcccaagctgaaatcaccgagagtctcatcaccgacagcgacggcgtgcggaaggtctacaattctgccgccatagcgttccctgacgggcacaccgactcctaccagaagatgcatcgcgccggatccgaggaaaccgcatggccgttgcctggcagcacgccggtcatgttcgagatgcccgagtggaccggctcggacggcaagccactcaaggccggtatcgacatttgttgagacggtcacttctatccggaactcggtcgttattatgccgcgtccggagccgaactgttcctgcatccgacggccacgaccggcaacgcatggcatcgcgaatcccgcatgggcagctataccgaccgtgacggtctcgcagtgatcaccgacaacgtgtggggtcccgacgggtatccgctcgacgtcgacggcaacccgatctacttcgtcgatgagaacggcgacaccgtttcctccggcaaggacattgcggtctacaactacgcaggagttggatctgacccgttccgcacgtcgagcctcatcatcaacgcatggagcggcaaggatggcaccccgttcgactactccacgggcagcgcgctcgacaccagcggaacaggcaagggcgcgtccgacagcgaatcggccgacatgacgttcgccgaaggcgcctgcgatccagacaatctggaaatccgacagatgaacttgtcccgcgcagggttcagtgtcatgaacttcaacgctcgcctctgctccaagatgtacgatcagctcgccaaactgaccatcccaggatatcaggccatgtatgatgatccgaccgaactcgacaagagcgcgctcgaagctccgatcgcggcggcacaggccaagcttgccgaattcggcaaatacacggacgatacggtcgcatctctcacggaagcgtacgagcaggccctctcgctgtggaacaacaccacgttcagcagcgaacagaacggtcttgtctccaatgccgccacgctccttaacacggcattggacggtctgaagcttcgggaaacgaagcctgatgaccagccgggcggtggcgaggccaagccgaatgacaagcagccctcgaaagacaagaatgccagcaaggccgatggaaaaccgactgcggacttgcctcgcacgggctccgacatcgttcccattatcgcggtcatgcttctccttgcaggagccggaaccactgccggtacgttgatacgccgcaagcatgtgtagcggtatgttctagaaaccatcaccagataaatggccggtcgaagcacattagctgcgaccggccatttatcagatggggtatggtgattagaagacgctgtagccgccgtctacgcgaatgtcagtgccagtaacgtacgaggacgcgtcgctggcgaggaagagcaccgtgctggcaatctcgtcattcgtgccgaaacgatgcatcggcacgacctcgagcatggcgtcgtggccaggcatgtcgatacggccattgaaaattccagaccacacgtatccgggggagatggtgttggaacggataccatccttggcgagcgcggcagcaaggtaacgtgagtgttccatgatggccgctttggtggcgccatacgcgttcaccggcgtcggacttcccatcatgtagttcgcgttgtgtccggacagggaggctgtgaagatcagtgagccgccatgaccgtgttcgcgcatgatttcatgcgcgatgcggccggtacggtaggtgccgttgaggttgatgttgatggtgcgcgtccatacttcttcggtggcgtcttgatcgtcgcccggtacgttgactccggcgttgaggaacgcgaagtcgacggtgcccagctgttccaccaattgtgttttgagttcggctacttgttcgacgttggtgacgtcgcaggtgagcgcgatgacgttggtgccgaaacgttcgctcatgtctttcgccagttcggtgagcttgtcttcttggctgggcaggtcgactagtgcgacgtctgctccggcttgggcgagcgcggccgccgcgttgcgtcctagaccgcctgcggctccggtgacgaagcctttgcggccgcgcattgagaatttgtcgagtatcgagtagtttgaatcctcccatttgtcgaggggataacgttcgtcgaagatttgttcgacggttttctctggaatcttcgatgattcgtctgccatgtttcgctcctttgcgtgatggtgaccgcttttttggatgcgtccgcgcatcatgttttgcgcatctatggaccatgtttgcggttgcctatgttcgtgcctgcggtcgttcggcgtccgtgccgaaccaatccgagtatagcaaataaaacgatggcggtgctgtcagtatttgtcaggtaaaacgtaatgaggaaaccgtaaggtcaatataagaagatagttgatgattgaaaggggagtggtgatgacggatttgaaaatgttttccaagcctgtggtgttcacggatttcgatggggtgctcaacgcctttccggatgacaagcttttgcgcaggggcggcgtgaacaaagttatgacctgggcgaagcccgacagtccctacgcgaaaatgtacaatcctgaaaaagcgttccacctggacggcaacgaaaaagcccacacgcccgtaggctcatggcgcatccactggtccagcgaactatccgacgccatgtacgcgttggcagttgacggcattgtggaattgtggtggctgtccacctggcagccatactgcagtcagattctcgacccgatgctcggatgggatcccatgctggtcgatgtcatcacctggtacgatcctgtcaccaaatggggacgtgaggcaggcaaatggcagaccatccaacgacgcgtacgcatcgaatgcgaagagaatgaacccgcgccgatcgtatggatcgacgatgatgaatgcttcgaacagcgcgcgcagctcttggaggaactccagccgaaagcgccggtgcttatggtccgcccggactatcgtatcggcatcagccgtcgccaatggaaactgatcgatacgttcgtacaccatcccgaacagttcgacacggtcacgttcgacatggaaccaacctgcaggatatacgacatccaccacggtttctagcctaaatgaattaccatgggaggatagtcgagcggaatgaaggaaggatggggttatggcggaacgtatcgtggagcgtcttatccgagagcgtgatactcgatatggtgacggcatttacacgaccacgcaaatccagttcgcatggaattccaatcatatggaaggttccacccttactgccaaacagaccgcgcagctatttgccaccggtacctataccacggatggcagcgaacaggtcaatcctgatgatgcgttggaaacccgtaatcattttgctgcgttccgttggattctcgaccatgctgatgagccggtggaccgggatatggtctgtcacctgcatgccattctcaagcagggcaccagacaggtctccgactcgcttttcaacgtgggcggctacaagactcggccgaactttatcggcaatcctgtcactccgacaaggaccgcgctgccgcaggatgttcccgaatttatggacaggctgtttgatatgtgcacgaaacttgaggacgagccatatcagatcgcccgtgtccattggacgtttgagaagattcacccattttcggacggcaacggtcgaatcggacggcttatcatgttcaaggagcttttgcgtatcgatgcgttgcctgtccttgtccatgacgcgtatcgtgcggagtacgtcaatggcatcagtaagtttccggacgagccaggatggctggttgatacgcttctattcgaacgggacctttaccggtcgcatgttctgaaaacggatgccgaggcattgcgttacacgtaccatgaccaatggaatatggctgagcatcgggtggaacgagatgaggatctggaattcgccaagctcatcgacacgaaggcccagccgttgttcgatgaggagtatcagcagcgcgaacggctcctatggggcgaatagcggtccgactgtgtgttcctccttccaaacgtgacatgaaccgaatgtgcattgagatgtgcaatttgtgcacattgcggtcgccggccgttcaccttggtgtaagaaggaatcagccttcggactttagcatgaggtgcaatggcgcgtattgaatgcgcgcatacgaggaagtgagagctgcatacatgcgtgtattcgacttcgatggaaccatctatgacggagaaagcctgttcgacctgtacctgttttcggccaaatacaatccgaaagtattgcggtacatcgccccggtactgcgctatgccatcaaatacaagctcggacgagccacgttcgatcaaatggaatacggtgtgggcaagctatgccacggatatttaagcgaacttgccgaatcgttggaattcgaagaattggtcaacgccttctgggatcagaacatgaagcgcatcaaaccctggtataagccacgcgaagacgatgcgatcctcaccgcctcgttcgatatcaccgtgggcgaggcctgccgcaggcttggcgtgcaacatttggtctcgtccaccatcgacggcaacacgttgaacgtaaactacctcaacttcaacaccaacaagcccaaacgattccgcgaactctacggagacaacgttcgagtggacgaattctacacagacagccgattcgaccagcccatgatcgacatggcccgacgtgcctacatggtcaaaggcaacaaaatccaccaagtcaaatagccggaaaggctggaacggaatacggcggcaaggaccgatcctgacatctccccttcggcatggacgccttgcacgagccaggatgggcgtcggtcggtcatattgccgtatatggaaaatacgaccgaccgcaaaaacagttagaacgacacgcgcttggactggtttacggcagaaacctcgcacacgatgccaacaactaccgcgaaacacgcttcacacacaacaaataaatcaaccaagcaacaggcatcgccaacataaacaccggataaaaccacacagcaggcaaatgcccatacaccaaaccacccacaaacggaccaaccgacatacccaaatcaatacccgcataatacgtactattcgcaataccactgcgctcgcggcctgcgattaccacggcctgcgcctgcgtgactgaactcatcagaccgtagccgacagcggtgaaaatcgcagccaacaacagcatccaatcattgaacaggaacgtcatgcatgcgagcatcgccagcatgcccaacgagcagaccgtcagccagaaacggaagcccttgctgtcgaacaggtcgcgcaagcccagtcgcaacaccaataacgcgaccgcgtaaaacatgaaaaacaggtcggatgataccggcagatgacgagactgaacataactcacgatgaaggactgatttgcgaaatacgctatcgcaaacatcatgaacgtcagcgacaacggcaccacacgcggttccagaatcgaacggatcggaaaacgatgctttttggttgcgctagcagaaccgtcaatgtctacggcagtggagggattctccgttatggaagtctgctttttgcgtaccggctgtccgccattcttcaccatcagtgtggcgagcagcatgatcaccgccagcaccagcgaactcaaaaacgtcagacgataaccgatgtatttttgcgcgcgaatacccaatgccggtccgaccgccatagccagcgcgttcatcgtgccatacactcccatgcctgcacccatatgccggatcggcagcaaaagcgacatccacgtggccaggcagaccgagcagcatgcgaaaccaacgccgttgatcacgcgagccatgatgagcatgatgggggagtttgcgaaatagtacagcagtccggcggcgaaatagagcaccgtgccaaccgccacaagtgtgcgcttgctggttttgtcggaaagattgcctgcgatagggcggcagaacagtgagatgaaactcatcgacccggccaccgcacccatcagcatgccgtccgcgcccaacgattccgcatatccggcaacgatcggattggcaagcatattgctcgacatgaaacagaacgtcgcaagcatgaccaacgccatatcacgggtgatgagacgatcatgcttacgccggggctgttcgggctggttcgattgttgtgccggttgcttctgtcgtaccgattcagatgcgggtatcgttggtgctgtcatgctcgttcgcctccgagcatgcaactgtagcagccttgacgaaaaacggccgtccacatatcgcggacggccgatggagatggctttaacgatgtgaaagtatgcttcgcttacagagtttttacagagctttagcggcctgctcgacaaaaccttccataccgtcgatgtcaacgacatggtcgaaacgcacgtcggcggtctccaaaccgcgcaacgcggccggagcggtagtgccggtcgcctcggcaagcacgtccatgcattcgaaatccgtgccggaagcatccaaacccaaggactcgttgaccacgcgcgggaacttgtacgggctggcggtgctcagcagcacgcgcggcgtcagcggatcgcgaggcatctgctgcatcacgtaataaccgcacgcggtatgcgggtcgatcacataatggttcttgttccagcaatccgcgatcatctcacgcacctgatcctcatcggcccagccggtgccgaacagggaacgaatcttggccagcatcggttcgggaacctcataggcgccccactggttcaaatcgttcatcagcatggcgatcagacgagtgtccttgtcggacatgtaatacagcatgcgttccagattcgaggagataagaatgtccatcgacggggaaatcgtctgatagaacggacgctgacggttatacgtgccggaagtcaggaaatcgaacagcacattgttcttatcggacgcaacaaccagatgcttgaccggcaagcctaacagcttcgcataatatccggcgagaatatcgccgaaattaccggtcggcaccacaaactcgacctcatcaccgacattgatgacctgctgttcgagcagctgcgcgtaagcggagaaataatagacgacctgcggcaccaaacgtcccacattgatcgaatttgcggaagacagtaccacatgcgaatcggaagccaaacgattggcaagctcacgatcaccgaaaatgcgtttgacagcggactgagcgtcatcgaaattgcccttcaccgcgcagacattcacattcgaaccagcctgcgtgctcatctgcagttcctgtacctggctaaccttgccttccggatagaacacggtgatgcctgtgccctcggcatccgcgaaaccagcgagcgccgccttgccggtgtctccggaggtggctgtcacgatcatgattttctcgttgccgtcgccgccggccggggtggtgcgtgccatgaaacgcggcaggatctgcaatgcgacatctttgaatgcggaggtcgggccgttaaacagttccatcacgtagtcatcgccgagcggcttgaccggggtgatcttttcgtcggaccattgcgcgccgtacgcttcatcgatgcatgccttgagttcggtttcggagaagtcgggcagcagcacgctcagcacgtcgaatgcgatctgctggtaggacttgcctgcgagagatgcgacgtctacgtgggtttcgcccagtgagtcggttacgaacaggccgccgtcgtcggcgatgcctttgcgtatggcttgcttggaggtgagtgaatcggtggtgctgcgagtgctgtggaacgtggtcactggatttccttagcaatagaacggacaatgaacgtcaaacaatattgagtgtagcgttatgggcgggaagaagcgtgtttggcgtccgtggaatgggacgatgcgtgtttatgggtggtgattgtttcctgcttgtttcgtgattgcttccatgtttcgaaacgccctattccctcatgcgatttgtgcacgtacacttcatcgttaagcctgcacgttcgtacgggcaacgtatttatcctccaagccaaggagagctcaatgaccgcatcgcctctcgcgcaaactccgaacgacatgttcaacgcgcctatcgccgaagcagaccccgaaatcgccgaggtactcaacgctgagttgtctcgacagcagaacggcttggagatgatcgcctccgaaaacttcgtgccgcgtgccgtgcttcaggctcagggttccgtgctgaccaacaagtatgccgaaggctatccgggacgccgctactatggtggctgcgagcaggttgacaagatcgaaaccattgcccgtgagcgtgccaagagcctgtttggtgccgaatacgtcaacgtgcagcctcactccggcgcacaggccaatgcagccgtctaccaggcgctcgtcaagccgggcgacaccgtgctcggtcttgccctcgaccatggcggacatctcacccacggcatgaaaatcaacttctccggacgtttctaccatgccgaagcctacggagtcaatcctgaaaccttccgcatcgatcctgaaatcatccgccagcgcgcgcttgaaacccacccggccatgatcatcggcggctggagcgcctacccgcgtatcgaagacttcaaggccatgaaggaaatcgccgacgaagtcggagccaagttctgggttgatatggcacacttcgcgggccttgtcgcagccggactgcacccgagcccggtcccgtacgccgatgtcgtatcctccacggctcacaagactcttggcggtccgcgttccggtttcattctcgccaagcaggactatgccaagaagctcaactccgcggtcttcccgggtcagcagggcggtccgctcatgcacgtcatcgcaggcaaggccgtcgcgttcaaggtcgcagcctctccggagttcaaggaccgcatgcagcgcaccctcgacggtgccaagatcctcgccgaacgcctcatgtccgacgatgtcaagaacaacggcatcagcgtcctcaccggcggcaccgacgtccacctcgtcatggttgatctgcgcaacagcgaaatggacggccagcagggcgaagacctcctcgcccagtgcggcatcaccatcaaccgcaacaccgttccgttcgatccgcgtccggcaagcgtggcttccggtctgcgcatcggcaccagcgccctcgccacccgcggcttcggcaacaaggaatacgaagaggtcgccgacatcatcggaaccgcactcgcagcaggcaaggatgccgacgtggaagccctcagggctcgcgtcgacaagctcgccgaagacttcccgctgtatccgggtctcgatcagatccactgattccatgtcgaataacggttgatcgagaacggtttcggatataaatctctgaggacacgtgacgtgcgaaatcgcgccctgtttccgatgctacgacgaaataatggtcgaagctacggaacaaggcgcgatttcgcgctaatctaggaaactatgacgaacccacagacccaatccaacgccatggagcccgatgtgctcaacgaggtgtgcgccaaagccgacgccgcccgaatcgcgcaagcgcaacttgcccaaaccaacacgcagcgtaaaaacgaacttctcaacgccatcgctgacgcactcgacgcgcgcgccaatgaaatcgcggaagccaacgccatcgacatgcagaaatccgccgaacatggcatggacgcaggcaaactcgaccggctcaaatttgacgtaccccgcgtcaacgcagccgcacaaggtgtgcgccacgtagccaccctacaggatccgatcggtgaaatcgtgcgcggataccacctcgacaacggtctgcgactcgaacaaacccgcgtgcccatcggcgtgctcggcatgatctacgaagcacgacccaacgtcaccgtcgacgtcgcgtcactctgcatcaaatcaggcaacgcggcactcctcagaggaggacacgcggccgaacgcaccaacgcagccaccctcaacatcatcgccgacgtattgcacgaacacggatatgatgccgcactcatcgcttccgtcgacgaatacgggcgtcaaggcgccaacgccatgatgcaggcccaaggccacatcgacctgcttattccacgagggggagcgggcctcatccaagccgtcgtgcaaaactccaaagtacccgtcatcgaaaccggagcgggcaacgtacacatctacgtcgaccgaaccggcgaccaaaacaaagccatccccatcattctcaacgccaaaacgcaacgcgtcggcgtctgcaacgccactgaaaaactcctcgtgcacagtgacatcgccgaagcgttccttccgcaaatcgccacagcgcttgccgcagccgacgtcgaagtgcatgccgacgaacaggcctacgagatcatcgacaaaaccggtattgacggggtgaaactgatacatgccactgaggaagactgggataccgagtatctcgcgttgaagatcggcgtcaaagtggtcgactcactcgacgaggccatcagccacattaaccgccactccacagggcataccgaatccattatcgccgaagactattcggccattgaggaattcacctcacgcatcgactcggcggtggtgatggtcaacgcgtccacgcgtttcacagatgggggagtgttcggcttcggcgcggaacttggtatctccacgcaaaaaatgcatgcacgcgggcccatgggactacgcgaaatgaccacgaccaagtggatcggctacggaacaggccaggtacgggcatgaacgaacacaacaataatgacggccagatggaggaaacaatgactgacgctaagaacccatggaatgcggatctcaatgacccctatctgggattgaagctcgcatccgaacgattaagcatcgtacgatacgtgtttctcgtgcagatcgaggacggcatcgcatcggcggcacagcgtgcttcactcgaatacgccgacgcggtgctgatcggttggccggaagtcgatgccgaagacgtggtggaactcgacgaagagaagcttaaaagcgtcgatgagcagatgcggctcatggaacagtacatcgccaaattcagcgccatggagcgcgaacaggatattgacggcatgaccgatacgctgattcgcgtcaccgaacgtgtggcggaagtgcgtcgcgcctatcagccggacttccctctgccgactttcgcggagatcaggcgcgtcgtgcaggacgagtgggatgaggatatgggcaaaatcgacccggacaacgcatcgccaacggcagacagcatcggccgtgagaccgcggacgccgatcaggaacaaaaaaacgaggatgcctcatgaccggcccgaaacgcatgcggcccgaatccgccgaagccgattccgaacttgccatcagctatgtggtggaaccggaacggcgcatgtccgacctttccgtggaatcagcaggttccgcggtggccacaggccgacgttcagcacgcggcaactggcatagcaggcctcgcatcggcatcatgggcggcacgttcgaccccatccacaacggccacttggtggcggcctcagaagtgtcgtgggtgtacgacctcgacgaagtgatcttcgtgccgacgggacgccccgtattcaaactcgacaagaacgtcaccaacgcggaagaccggtatctcatgacggtcatcgccaccgcgtccaatccgaaattcaccgtatcacgcgtggacatcgaccgtccgggagtcacctataccatcgacacgttgcgagacatccgtgcgcaacatcccgacgcggaactcttcttcatcaccggagctgacgcggtcgcggaaatcatgcaatggaaagacgccgacaaaatgtgggatctggcccacttcgtggccgtgacccgccccgggtactcatcgccggaaggggtgaaactgccggaaggcaaggtcgatacgttggaaataccggcactggcgatttcctcgaccgatgtgcggcgacgtgcggagcatggggagcctgtttggtacctcgtaccggacggcgtggtgcaatatattggcaagcacggactgtaccggtaaatttcaggtgaacacgcgcgggtgagacggtctgcgcagatggttaatatgggtcacgtccacttgacgcgaaaacagacgtttggagacatggtgagcgcaatccttgaaggaaagccggataaaaaccttatccttgtcacaggcagaacacatccgaaactggcggcggaagtcgccgaacaacttggcattgatgttctggaaaccacagcatacgacttcgccaacggcgaaatgtacgtgcgctacaccgaatccgtgcgtggcgcggacgtgttcgtactgcaaagccacgcagccccgatcaaccaatcgattatggaacagctcatcatgattgatgcgctcaagcgtgcatccgcgcgttccatcaccgcggtctgcccactgcttggctactcgcgccaagacaagaagcatcgcggccgcgagcccatttcctgccgtctcatgttcgacctgctgaagaccgcaggtgccgaccgcatcatgagtgtcgacctgcatgcggcgcagtcccaaggcttcttcgacggtcctgtcgaccaccttatcgctatgccggtgctggtcgactacattcgcgaccgtttctccaaccagcttgacaatgttgccgtcgtctctccggatgcgggccgcattcgtgttgcggagcagtgggcgcagcgtcttggcggtggtccgctcgcattcgtccacaagacgcgtgacatcacccgtccgaaccaagcggtcgccaaccgagtcgtgggcgatgtcgaaggtaaggactgcgtgctcgtcgacgatctcatcgataccgccggaaccattgccggtgcatgcagcgtgcttaaggatgccggtgccaagtcggtgactgtcgtcgccacacatggcgtgctgtctggtcccgccgtcgaacgtttgaagaacagcggagcccgcgaagtcgtgcttaccgacaccgtgccgattcctgaagagaagcgttgggacggtttgaccgtgctgtcgatcgcgccgctgctggccagcgccatccgtgctgtgttcgaagacggctctgtggctgagttgttcgacacatatccggagcatcacggacagggcttcttgttcgcctgatgacgcgttgcgcgggcatgcttagcgtacgttccgcatgtttgtggggtaactcccatatcagtgaagcgagtaccgttgtttaaggtgcgcataacactttttgtgcaccttaaacaacgttttttactagtgcgacacgtcgagacacgcggtgttggcgacatgtggcataatagacacttggcggtaaccgcaaggttttccgccattcccccatggtgtaatggcagcacacgggtctttggaaccctttgtcttggttcgagtccaggtgggggagcccattctcagacggctctgcggcgaatgccgcagagccaatttttttttatttttcttgagcgcacttagaggagtgtatgcccggtaacataactttatgtgagcatatacgaacaaacatgatcattatctttcagtgaaggctaatgccgttcatttttactaagcgtttttgagacgaacttagggtttttcgccaaagaaggattctctttgctttttcaacgatatgccaccttttttgtaatgttttaggggtataaaatttatctttagggtgttctaaagtgtttgaaatatctgaagttatccacttatccacaagaatcaaatgtcaacttgacgggggatggcttttgtgccttaatggttcttacaccccctctcaacgatgagtcgggcgaataagaaagggattcatcatggatgattcatgtgaaaatgatgttccgccgccggaggctaacgagcccttctcggaggttccaccttctgaccagggatcagcggccaatgcgaagcgcgctgataaaagtgggaagaaacgcgagggagaaaacctgacagagtgggaaaggatatctcttgagcttggcagaaagccggttttcgattacgataaaacgcttccctcgtatgatgggtttcttaattcagatcttttcggcaggaaaataccattccattacatccagataatgcctgggccgtgcgatgctgaatttgcctactccatgaacatgttcgcggcgcagttgatctgcaatgttgtcgatatcttccgtggcaggcagaaagaagcacgcgtggaaagggtattgagcgaggcctgcatgagaaagctgagaaatgcctccgctcagatcgcagcacagatgaagaaggatgtgaggatatacgcgcagttgggtctgcttccgatcaccgtatattacgttgacagctggttggtctctccgacatgcttcgaaagcaccgtgctgatgggcattggaggacgaaggctgtgcagcaatttgaagtgcgtcctcaagggatctgcttggaagtgcgaagtcgctgatttcggcgtgtgacgtataacaagtaaccattcaaaacccttggaattggctgaattcagccgttttcaagggttttcagcgtgccttgagcatactgcaactactatagggactcatgttgagagaatttgtaccggaacctgcgtatagcactacggatgaggataccgttttcgcactgctctccagacgcgctaaacgtgatcctgatgatctcatcgcccaatggcaggacgacgagactcgtcgatggcatgacgttacggcgggggagatgcttgagcgtgtgcgcgcggttgcgaaaggtcttcttggcctaggggtcaaggccggaagcatggtagtcatctattcgcctacctgctacgaatggggagtcatcgattttgcctgcgccgcaatcggcgcggtaagcgtgcccgtgtatgaaaccgattccgccaggcaggccgcgtccatcatcgaagaggtggatccgatcatcgcctttgccggtgatttcgcgcatacacaaacgcttgaacagattcgcgatgagcacagcagcctgcgctacgtcttcaacttcaaggcggatggtcttgatgccgttgctgattttggagaaggtgtcggcgaggacacgctcgatcaggtgatttccagggtcaaggccgatgacatgctcaccattgtgtacacgtctggttccactggcaagcccaagggagcgatgctgtctcaccggaatttcacgcatatcgtgctgaacggctacatcattctcgatgaaatgctatatcagccgaatcgtctgatgttgttcctgccgttggcgcactgcttcgctcgctatattcagtatgttgcgattggcgggcagggggtggtcggctatctgcccggagccaagcatctgcttgccgatctgcgtagcttcaagccgacctatctgctgggagttccccgtgtgttcgagaaagtgtataacgcggcttcgcaaaaggccggagcgggtattcgtggaagagtgttcgccaaggctttcgatcattttgtgcaatggtcgaaggacgagcaggaaaccggacgccattccattgtggctcgtgccgaacattcgttctttatgtctgtcataggcaaatccattcgttctgctttgggtccgaacatgagatatctggcttgtggcggcgctcctttgaacgtcgatctcgcccatttcttcaacggtatggatggcattaccttcattcagggctatggcatgacggaaaccgccgctcccatgattgtcaactggcaggacgccaaccgcgtcggttccgtaggcaagcccgggccgggcatgggcgtgcgcaccgatgacgacggcgaactgcaggtgatgggccccaacgtgttccttggctactacaagaagccggagctgacagccgatgtcaagatggctgatggctggctgaagaccggcgatttgggaaccatcgacgacgacggattcgtgtacattacgggtcgcaagaaggatatcatcattacggccggcggtaagaacgtcagtccggcacctatggaagatgtcatcaacacttgcccgatcgtgtcgcatggtgtggtggtcggtgatggcaagccgttcatcggagctttgattgagcttgatcaggagatggttcgttcctggcttgcacagcagggacttgatagcaacatgcccatggagcagatcgcgaagaacgatgccgtgcgcgcattcattcagcagtatgtcgaaaaggcgaatgcgaatgtctctcgtgctgaatccgttcgcaagttcgaaatcctcgacgaggagttcagccaggagaagggcactctgacggcgagcctgaaagttgtcaggccgaaggtgcttaagcggtacgaaaatgtcatcgacaatgtgctgtatgcgccgaagccatccaacaaaccgctgccaaagacggtgcagattcttgaccgaaccaccgaaacggtcaagcaggcttccgaatccatgcgtcaggcttccgaatccgtaagtccgaaggttcggcaggcatttgataccatgcaggagaaaattaagaagcagaccgaagacgccggcgagttccaaacgccggaagactcatcggaaactgaggaaacaaccatgaacgaggagcgataatcttggcaattcgtgagattcgagtcgtacctgatccggtgctacgtaccccctgtgatcctatcaaggaaattacgccggccgtgcgtcatctggtacaggatctgcttgataccgttgacgatccaggaagggctggcttgtcagctaatcagattggcgtgaatctgagggcattttcctataacatcaacggcaagatcgggtatgtgctcaaccctgtcctcgaagagaccagcggtgaacaatacggagatgagggatgcctgtctgtgccgggattgtggtacaagacccgtcgcgctgattacgctcgtgtgcgtggcatcgatttggaaggcaagacggtcgtgctggaaggtcatggcattatgggccgcatgttgcagcatgaaaccgatcacttgaacggtcatgtctatcttgatcgtttggagaaagaggaacgccgagaggcgatgcgctacatgcgcaatcaccacaagtgattgttcgcatctcaccgatatgacgacttggggtcacgtctttgcgaaaagacgtgaccccatggtattttatgccttgtgtgccatccggcgaagggctttgtcgtgaaagtcctgagccacccaatattgtcaaccggcatacaaccaattcgcgtcatgttcgcgacgacctgtgtcggtcggccgacgccgcaaggctttggctgcacgcaggaacgcatgaccaggcaagaaccgacagaaagaggtagtaataccatggctcagatcaatatgagcgacatgctgaaggcaggcctgcacttcggccaccagacccgtcgttggaatccgaagatgaagcagttcatcctcacccagcgcaacggcatccacatcatcaacctgttcaagtcgctcgacatgatcgacaaggcctacgacttcatcaaggctaccgtcgctcacaacggcaccgtgctgttcgtcggcaccaagaagcaggctcaggaagccgtttccaatcaggctgtccgcgtgaacatgccgtacgtttccgagcgttggctcggcggtatgctgaccaacttccagaccgtgtccaagcgcgtctcccgtctcaaggaactcgaagagatggacttcaccgacgtgcgtggttccggtctgaccaagaaggaactgctgcttctcgagcgcgagaaggacaagctggctaagcagctgggcggtatccgcaacatgaaccgtactccgtccgccatgttcgtggttgacgttaacaaggaagctttggccgttgaggaagctcacaagctgggcattccggtcgttgccatcgtcgacaccaacgctgatccggagtccgtcgagtacccgatcgcagccaacgatgacgccatccgcggcatcgaactgctgaccagcctcatggctgacgcagtggccgaaggcctgctggagcgttccggcaaggccgctaaggctgagggcgagaccgagcagccgatggccgcttgggagaaggagctcctcactgagggcgctccggccgccgatgcaccggctgaagccgaagccgaagctgaaggcgaagccaaggctgagtgaaaatatccactatgatgggaggtgttgtgcctcccatcatatggggcatcactatttttcagaggagacaaatcaatggcagcaatcactgcagctctgatcaagcaggtgcgcgaggaaactggcgccggcatgatggacgttaagaaggctctgaccgaggctgagggtgacgtggctcgcgccaaggaaatcatccgcgccaagggcatccaggccgctggcaagcgcgaaggtcgcaaggctcaggaaggcaccatcgcctcccaggtcgtggaatccgccaatggccagaccggttacgccgtcgaactgaattccgagaccgacttcgtggccaagactccgaagttcgtggagttcgctgacagcgtgctcgaagacgccgtcaaagccgaggccgcttctgtggacgaagtgctggcagccgcttccggcgaagccaccgtgaaggaagccgtcgaagaggcggccgctctgttcggtgagcacgtcaaggtcggccagttcgccaaggtcgagggtccacacgttgagatctacgcccacaagaagtccgctgagatgccgccgagcatcgtggccatgatcgccaccgatgaggccggcgctgctgtggctcacgaagccgctctgcagatttccgcaatgggtgcccagtggctgacccgcgaggacgttccggccgatgtggtcgagtccgagcgccgcgtggccaccgagaagtccttggccgaaggcaagccggagaagatcgttccgaagatcgtggaaggccgtctcaatgccttctacaaggagaacgtcctgctcgagcagtcctatgtcaaggatccgtccaagaccgttggcgacctgttcaaggaagtcggcggcgcagccgtggctttcgctcgtgtcgaggtcggcaagggcgaggctgagtgaattcggcttcaatggtgaatccgtgcgttagacgctagagattccatgaggttggccatcatccacagggtgatggccaactttgttttcttctcgacgctgtgtcgttgcggtgtggtgtctgtgtttgccgatactcttgagagcggtaaatttcgtgagttctcgggcaagaaaggcttttcatgactggcgaaaacactggtgataatccacgcagagtgctgctcaaactatccggagaggcgtttggcggcggcaaagtcggcattgacacgtccgtcatccgccgtatcgctgaggaaatcgttcccgcggtgcagcagggcgttcaggtcgccatcgtcgtcggaggcggcaacttcttccgcggcgcggaacttcaacaggctggaatcgaccgctcccgcggcgattatatgggcatgctgggcacggtgatgaattgcctcgctctgcaggacttcttggagcaggagggacaggccacgcgcgtgcagaccgccatcaccatgggtcaggtcgccgagccgtacattccgctcaaggccattcgtcatctggagaagggccgtgtcgtgattttcggcgctggtgccggtatgccgtatttctccactgacactgtgtccattcagcgttctttggaaatccattgcgatgaggtgctgatgggcaagaacggcgtggacggcgtttataccgccgatcctcgtaaggacgagaacgccaagcgtttcgccacattgagctataatcgtgccctcgtcgacaatctcgccgttatggatgcatccgcgctttccatggcccgcgacaacaagcagcgcatccgtgttttcgggctcgaaggcaatggcaatgtgacccgcgcccttctcggtgaggaaatcggaactatggtttccaccgcggagtccacactcgctgaataacgacattcaacgtcgaatatcgatcaaacaaccaacaacaaggagtacaaatggcaactattgtcgaacaggccaaggcacagatggccaagtccgtggaatccaccaaggagaacttctccggcattcgtaccggccgcgcgaatccggcgctgctcaacggtatcaccgttgattattatggagctccgaccccgctgaaggccatcgccaccatcggcgtgccggaaccgcgtaccctgtccgtcactccgtttgacgcgtcccaggccaatgccgtcgagaaggcgttgcgtgattccgatctgggcgccagcccgcgtcgcgacggcaacgtcattcgcctgaccatgccggagctgaccgaggaacgtcgcaaggaatatgtcaaactcgccaagggcaaggcggaagatggcaaggtcgcagtgcgcaacatccgacgcaaggccaaggaatcccttgacaaggccatcaaggacggcgagatgggtgaggacgagggcgatcgtctgctcaaggagcttgacaagatcaccaagcagaccactgatgaacttgataccctgctcgaagccaagcagaaggagatcatggaggtctgagagacctttatctcctgaaaagaatcgacgcacagccagacagggaacatgatggaacatcaggaacagctcgaaaaagaaaccgaagaggccatcaacgccatcaacaagaagacggggcgtaatatgccgcaggccatcgccacaggggcggtgctcgtcatcctcatcttggcgtgtctgctgatcagcattgacttgttcgtctatctggttgtgctgttcatggtgcttgccctttgggagctgcgcgtcgatttcgccactgcgggacttcatattcccgtggcggtgttgtgggtatgttcggcggcgacgttgctgtccacctattacagcgaacgtcatatcgtcgccatgacggtatgcgtgctggtgtctttggtggtcgtagcgatcgccgccagcgctaaagtgacgttcggcagccgcatctctctggccgtggcggataagctttcccacaccgatgcaggcgcaagacttgaatcctccttcaaccatgagcagggagaggtaagccatagcaggctgagccatgtcgcggtctccatgttcaccgtgctgtacattccgcttctggcttcctgcctcatcatgccgttgacattcaatgatcatcccgtcgcgcatgctattatgatggtattcatgcccgcgttgagcgataccggtggtttgttcgccggggcatggctgggcaagcacaagctaagcccccgcatttcgccgaagaaatcgtgggagggtcttgcaggttccattctgttctccatgatcggatcttttgccgtgatgttctgcacgtacgggtcggatgtgtggatttcccgctggtgggtccctgtcgtggccggtttcatgatcggcatcgccggaacgtttggcgatttgtgcgcatccatgttgaagcgagatatcggcatcaaggacatgggacacctgcttaagggacacggtggcgtgatggatcgtgtggattccattctgctgtgcgcgccgttcgtgtgcgtgctgctgtgggcaactggaatgtgagaaaggcaaacacaagcatgagcgactccgtgaattccacgaaggatttgccggaaaccggtattactccaggaggcactaccggtgccttccgcgacgtgctttccaaagatcatgcgcgtcgaggcaagccgccgctgcattttgctgatatgactgaagacgaacgtatcgcgaaagccaaggatcttggacttccgaaattcagagtcaagcagcttgccaatcattactatgggcatttcgacgtcgctgccgaagagttctctgactttcctgcagcgaaacgagccgaagccgcagaggcgtttttcccaacgctcattaccgaagtgacccgtcaagtggccgatgagggcactactatcaaaacgctatggcgtctgttcgacggttctcttattgagtccgtgctcatgcggtatcccacccgcaccaccttatgcatttccagccaggtaggctgtggaatgggctgcccgttctgtgccacaggtcaattgggtctgacgagaaacatgtcggcaggcgagattctggaacaggttcgtgtggccgcgaaagccatgcacgacggcgaagtcgctggtggtctcgggcgcctgagcaacatcgtgttcatgggcatgggcgaacctatgggcaattacaagtccgtattgagcgctgtacgccaaatcagcgccatgccacctgaaggtttcggcatttcggcacgcaacatcaccgtctccacggtcggtgtggtaccaggtatcaagaaactcacggcagaaggcattccggtgcgtttggccgtgtccttgcacgctccgagcgatgagttgcgagacgagctcgttccaatgaacaagcgtttcaatactacgcaggtgcttgatgcggcacatgactattacttggcttcgaaacgtcgcgtaagcatcgaatatgctctgatgcgcggtatcaatgatcaagccgagcatgccaaattacttgctaagcgattgaaccattatggtgacaattgggctcatgtcaatccgattccgctcaatcccatcgaaggatcgaaatggaccgcttcgaagcctgaggatgaacagcagttccttgatatccttcataaagcaggcattactgcgacgttgcgagacacgcgcgggcaggatatcgatggtgcatgcgggcagctcgcagctaaggaacaagattagatttcaaggaaagatgcttgttctgtccgctactcggacttccgacgaacatgcgtaacgtaaaacggttactcttgcattcgttgcacacatgattatgcgcgaaggagtaaaacagcatgtcactggcagtccgagtcattccatgtcttgatgttgatgcgggacgagtagtcaagggcgtgcatttcgagaatcttcgcgatgccggcgatccggttgaacttgccgcggaatactaccgtcagggtgccgacgaactgactttcctcgatgtgaccgcttcgagctcgcatcggcagaccatggtcgatgtggtgagtcgaactgccgaacagattttcatcccattgaccgtgggtggaggcgtacgtgcccctgaagatgtggattctctgctgcgttgcggagctgacaaggtaggagtcaacactgcggccatcaatgatccgacgctgattggccgtgtcgcagaacgattcggcaaccaagtgctcgtattatccgtcgatgcacgccgtgagcagggcgagcgacacactcagtcgggctttgaagtaaccaccatgggaggccgcaaatccaccggcattgacgctatctggtgggtcaagcgtgctcaggagttgggcgcgggggagatcctgctgaattccatggacgcggatggtacccaacagggttttgacttggaaatgattaaagccgtgcgtaaggaagtgaagattccgatcatcgcttccggaggtgcgggcaaggctgccgatttccccccggcgatcgaagccggagcggatgccgtgttggccgcgtcgatcttccattacggcaaagtcaccatcggcgaagtcaaggatgccatcaaggccgccggctataccgtgcgatgaaagccgaaaaccgcaaaacaggcgaataacgtaatcaataatcgaagaaacaaatcaataacaccatcatgaccaacgaagcatacgacaacagcactattcttgacccacgaatcgcagaacgtctcaagagggacgataaaggactggtggcagccgtcatccagcaattcgacaccaaagaagtgctgatggtcggctacatgaacgacgaagccatacgacgcaccctgatgactggtcgcgtcacgttctggtcgaggtccaggcaggagtactggcgcaagggagacacttccggacatgcccagtatgtgaagtccttcgcactggattgcgatggggatgccattctggttgaagtcgatcaagtgggagcggcctgccataccggcaaacgatcctgcttcgaagaaggcgggcaactgcccgtggtcgtaggataccgtaccaaggaacaggagggccagcgatgagtgaatgcagcgtacaagcactcaagtggggcgccacctggccgagtcgcgaacaattccacgaattggctgatcagggatatcgtgtgattccgattgtgcgccgacttctggctgattcgttgactcctgtcggattctatgaacgccttgctgcaggacgttccggcacattcattcttgaatccgcggaatttggcggcacgtggaacagatacagcttcatcggtgtgaattccatggctcagttgcgttccaacaacggcaaggccgattggttgggtcaggttcccgcaggcgtgcctaccgaaggcgatgtgatggaagtcgcgcatgctgcgctgaaaacactgaaagcgccgcatgtcgaaggactgccgaacctgaccagtggtctggtcggtaccgtcggttgggatgcgattcgccattgggaaccgaccttgcgtgccgaggcgccgaacgagaccgggcagccggaaacagttctggcattggccacggatattgctgtggtcgaccatgtgtccggatcggtatggatgatcgccaatgcggtgaacgtagacgatcgatccacccgtgccgatgcggcatacgacgaggcggtggcgcgattggatgatatgcagcgtaaggccgccacgcctgtcgaaggtgaagctcgcgtcaatgtgttggatgagaccattagccagcccgagcttcgtttccgtacggagaagagcgattatgagcgttccgttgaaatcgccaagcagcacatcatcgatggtgacgtgttccaggtggtcatttcccagcgtcttgacattgattcgccagccgatccattcgacgtgtaccgcgtgcttcgtacgctcaaccccagcccatacatgtatttcatgtcgttgaccgatgcgcaggggcgtgacttcaacgttattggatccagcccggaaacgctgatcaaagtggacaatggccatgccatgaccttcccgattgccggttcgaggcctcgtggcaccactattgaggaagacgagcaacttgccaaggatctgcttgccgatccaaaagaacgtagcgaacacatcatgctcgttgatctttcccgcaatgatctgagccgtgtatgtcttccggaaagcgtggaagtcgtatccttgatggatatcaaacgattcagccacattatgcacatctgttcgaccgttaccgggcgagttaaccccgacatgacgtcgttcgatgtgttcacgtcggcattcccagccggaacgctttccggtgcgccaaaaccacgtgccattgaaatcatcgacgagcttgagcccgcagatcgtggcatttatggcggcactgtcggctatttcgatttttcaggcaacctcgatatggcaatcgccattcgaacggcattcatccgcgaccatgaagcgagcgtgcaggccggagccggaatcgtacttgattccgtgccggccagtgagtggcaggagactcgcaacaaggccgaggccagcgtcgaagcggtgcagatcgcctcgcagcttcgccagttgtgagtcaaatcaagctaaccaatcgagtaaaatgctgaaaggaacaccatgtctgtactcgatgaactggtggcgggagctgtcgaagaccaacgagcacgtgaacagaacatttcccttgatgaggtgaagcgtcagacattcgaagcgccggcccctattgatgcgcgacagtggctgaaaaaagcggatggcattccggtgatcgcggagattaaaagggcttcgccatcgaaagggcaccttagcgacattcctgatcctgccgcattggccagagaatacgaaaaaggaggtgccagcgcgatttccgtgcttaccgagggacgtcgctttttgggatcgctagatgatttcgataaagttcgtgcagctgtgaaaatcccggtattgcgtaaggatttcatcgtcacggaatatcagatttgggaagcgcgtgcgcacggtgccgatctggtgctattgatcgtcgccgcgttggacgacggcaagctcaagtccttgcttgagcttgcacatagtctcaatatgacggtgctggtcgaaacgcatacccgtgaggaaatccagcgtgccattgatgcgggagcgcgagtcatcggcatcaacgcgcggaatctcaaggacctcaaggtcgatgtgaacaaatacaacgagctggccgctgatttgccgaacgatgtgatccgtgtagcggaatccggagtgttcggttcggttgagctggaggattatgcccgcgccggagccgacgcggtgctggttggcgaaggtgttgcaaccgcagccaaccatgagcaggctgtggagcgactggtaaaggcaggagcaagagtgaaagcatccgaacaaaccccattggcaagccacgaaggaccatatttcggccaattcggcggacgttacgtgccggaagcgctgatcacggcgcttgacgagcttgaacgcgtctatgaggaagccaaggccgatccggagttccataaggagctggcacgactgaaccagcagtatgttggacgtccatcaccgttgactgacgctccgcgtttcgccgagcgtctcaaagaaaaaaccggtctcgacgcgcgtgtgttcctcaagcgtgaggatctcaaccataccggcgcgcacaagatcaacaatgcgcttgggcaggctctgctggtcaagcgcatggggaagacccgtgtcatcgctgaaaccggcgcgggacagcatggcgtggccaccgctacggtgtgcgccatgctcggcttgaaatgccgcatctacatgggtcagatcgatgcgcgtcgtcaggcgcttaacgtcgctcgcatgcgcatgctcggtgccgaggtggtggaagtcactttgggagatcgcattctcaaggacgccatcaatgaggctttgcgagactgggtcaccaacgtcaaagacacgcactacctgcttggcacggtcgcaggtccacatccgttcccggcaatggtgcgcgacttccagaagatcatcggtgaggaagccaagcagcagcttcaggattggtacggcatcgaccatccggatgcggtttgcgcatgcgtcggcggcggttccaacgccatcggcatcatgaacgctttccttgatgacgaacgcgtgaatctgtacggctacgaggcgggcggcaatggccccgaatccgggcgtcatgccattcgtttcgctccgggaaccggcgaactgggcatgttccaaggtgccaagagctatcttctcgagaattccgaaggccagaccctcgacacgtattccatctccgccggtttggattacgcatccgtcggcccggaacacgcatggctcaaagaaatcggacgcgtcaactattcctgggcaaccgatgaggaagcgatgagcgctttcaaggatctgtgcgaaaccgaaggcatcattccggcgattgaaagctctcatgcagttgctggcgcatacaaggcagctgaggatctcaaggccaagggatacgagcacccagtcatgatcatcaacatttccggtcgtggagataaggacatgaacaccgctggcaaatggttcggttatttgaccgatgaacaggccaaggcgctcgaagccaatggagcccagggcaataacgcggacggcgagtgaaagaaggagtatccattatgacgaacgcaacagtaaccacgccgtccgggcagcctctcggcatcagccataagccgagtccgacggaagccatgttcgatgaattcaaagcggcgaacaagcctgcattcatcggttatcttccatatggattccctgattctgactattcgttgaaagcattccgcaccatggttgagcatggtgtcgatgccgtcgagattggtctgccgtattccgatccggttatggatggtcccgtcatccaagcggcttcgcagatcgccattgacaacggcgagaaaatcgcgaacgtgttcaaagccgtcgaaaccgtggccaacgccgggggagtccctctggtgatgagctattggaacctcatctaccattacggcgtggaacgtttcgcacgcgattttgaaaatgccggtggcgccggcctgattactccggatctcattccagacgaggcaggtgaatggatcgaagcttcggaccgtcatggacttgaccgaatcttcctcgtgtccccggactccaccgacagccgtttgaaggtcgtggcaggcaacgctcgcggcttcgtctatgcggcagcccgtatgggcgtcactggcgaacgttccaccatcgatgcttctccggaagagttggtggcacgcacgcgcaatgccggcgcgaagaacgtctgcgttggcatcggcgtttccaccgccgaacaaggcgcgcgagtcggctcatacgctgatggcgtcatcgtcggatccgcattggtgcacaccatgcttgacgaatccgggaaaaacgcagtcgatgaggccacgggtctcaaggcgttggccgccaaagccgaagagcttgcggacggcgtccataacgcgcgtgtcgcaaagtaaaccattctgacgatttcggtggtccacgcaccatatcggatgcgtggactaccatcaggaaaccatgacacttgcatacattccatcgccaacgatttcgcagttttccatcggtccagcaacgattcatatctatgcgttgtgcattttgatgggaatcgtccttgcagtatggataaccaccacacgttggaaaaagttgggtggcaatttcgaccaagtgcttgatatcactctggtcagcgtgcctgcgggcattatcggcgcacgactttatcacatcatcaccacgcctgaacgtttcttcggaccggatggcgactgggcggaaatgttccgcatttggaatggcggacttggcatctggggcggcgtgctgttcggagcgctggccgcatgggcatggtgccgtcataagcactatccaatggccttgctggctgacgccatcgctccgggcctgttggtagcgcaggctgttgggcgtttgggcaactggttcaaccaggaactgtatggcgctccgacaacgcttccatggggtttgaaactcaacatggaaggcactgccatcgggcatagcgaacagtgctatgacggagccacatgcccgagtggcacgctgttccatccgacgttcttgtacgagatgatctggaacctcatcggcgccgcgattatcgtatacatcggttccaaagccatgaagaaactcaaggcaggttccctgtttgccgtgtacatcatgtggtacaccctgggacgcacttggattgaatccctgcgtatcgattatgcgcacgaattcttgggcgtgcgcatcaatgtgtgggtctccatggcggtgttcgtgctcggcgcggtgtcattcatcgtcgtgcagcaaatgggcaaagacactgacctgttggcggagaagcttcgtaccgtcaccgaaatcgagcagcgtcttgaaaacggtgaatcggaggattcttcggattccgtggtgtctttccccgagcaaacggttgatgaaatcaaaaccaacgatgccgaaactgtctcgaataccgacaagcagcccggcatcaaataacagcaagtcgattacctttcatagaataagagccatgactattcaaatcgcaccaagcatcctgtccgctgatttctgcaaccttgagcgcgacctcaaggccatctccaatgcagatctcgttcacgtcgacgtgatggatcatcatttcgttccgaatctgaccttgggcgagccgattgtggctcgtatctgcgaagtcaccgatcttccggtcgacgtgcatctgatgatcgaggacccggatcgttgggcacccgaatatgccaagttgggcgctgcatccgtaagcttccacatgggggcaacccacgctccggtgcgtctggcgcgccagctgcgcgagatgggttgcaaggcttgcttcgcggtgcgtccggccgaacctgtcgagccgattttcgatattctcgacgaattcgacatgattcttatcatgaccgtcgagcccggcttcggtggccagaagttccttgacaaccagatggccaaggtacgtcgtctgcgtgacgagattacccgtcgcggcctcgccaccaagattcaggtcgatggcggtgtcagcccgaagaccgcgcacattgtagccgaggccggtgccgacgtactggtcgcaggttccgccgtgtatggtgccgaggatcctgcggaagccattgattccatccgtgagaaggctgaagccgcattcaaggcctgaacctaccaatatttcgaggatagatacgaataatgaagacttttgaatccctctttgctgaattgagcgagaaggccgcagccaagcaggctggctcgctgactgttgacgaactgggcaagggcacgcatttcatcggcaagaagattgtcgaagaggcgggcgaaacctggatcgcagctgagtacgaaggcgccgatcgtactgcggaagagatgagccagctcatctaccatctgcaggtcatgatgatcgaccgaggcatcacactcgaagacatctacaagaatctgtgagtttttggccgtgccataggaggcgtggcctttttgggagggaaaatgctgagaatcgccgtgcccaacaagggcatgctgtccgaacctgcatggaacatgctggccgaggccggctatcgcctgaggagcaatccgcgtcagctggttgtggaggatcccgacaatgacgtggagctgttctacctgcgtccgctcgatatcgctgtctacgttggccgaggcaccatcgacgtcggcattaccggtcatgatctgctgctcaactccggtacggatgccaaggagcatatggagcttggctttggcgcttcaacgttccgttttgcagcccccaatgattctccgattagcaagctcgaagatatcgaaggcaagcgcgtcgccaccagtttcgacaagcttgtgcatgattatctggctgagcatggcatcaacgctgaaaccgtacaccttgatggtgccgtcgaatcgtcagtgcaactcggtgtggctgatttgatcgccgacgtggtatccacgggcaccacgctccgtaacgccggcctgcgtattttcgcggaaccgctgttgcattctgaagctgtgctcattcgttccccgcgtcttgctgaagatgatgatcgtttgacgattcttagccgtcgtctgcagggcgtgctcactgctcagcgttacgtgctcatggattacgatattccagtcgagaaggtttccgcggctgtggacatcacgcctggattcgaaagcccgacggtttccccgcttcatgacaagcagtgggcggccgtgcgtgtcgttgtgccgaaggccaaggtcaaccaactcatggaccagttgtatgaagttggtgctcgtggcataatcgtcaccgctttgcaggcctcgagaatgtaatgttgctcgaagtatgagcaaactgattatcaaaaaacagtacagtccggaaccgcgggatatctatttcacggttccgaaccttatcagcctgttgcgaatcatttcgattcccttcatctcggtattggtctctcgccatgagatggtgcttgcattgattgtgcttgcgctgtcggcggtgtccgatggcttggatggtctgattgcacgctcgttcaatcaggtgagcaaaatcgggcagatcctcgatcctattgcagacagattattgattttctgcagtattctcgcgcttggagtcgctgacatcattccatggtggatgctgatcgtcgtcggattgcgagatttgatcatggcgattcttgtactggttttggcgcagcgtgattacggtccgctgccggtgcatttcgttggaaaagcaggcaccgccatgctgatgattgccattgtcgccttgattttcgcagatatctggtctaattcggctacggatactttgcatttgtgtggtctcgccaccggcatatggggtgtgggattgtactggcttgccggctatatttacatacgtcagggaatccagcttctgaagaacgataaggattgactcacatgatgcatgatgctccggaacgtgcgtcgttcccggtgtctccggagaatacgcctacgaagcggcgcgccgttttctcggcgtccttcgccgggctgacttcgcatcatgtgcagcctgatatcgtgacatccacttcgcgcagaaggcggaatctggatgatgactcattgcggcttattgacgatttgaccaatcgtccgatggacgtgatgtacacggactcgaggctggccaccaaaactccgtcattgttttcggtctggttcacccgggttttggtattccttatctgcattgccgtaggcacggcgggaagcgtgttcgtccgacagctgagtaccgatccacgtaaggaagtacgcaagcaactgtcaagtcagttatctgatcaaacgaaaaacgtcgaaaccctcgccaaagacgtgaacgcgctgcgagcccaggttgaggaagaatcgaaatccgtgtcgaactggtctctgaaccagaccatacaggatgacgaaatggtcaatggcgtacttcctgtgcaaggcgaaggcatcacgctcaccatcgccaatccaatatcggtgagcggagacaacgcggattcgtcactgccaagggaaaacggcagccaagtccgtgtggtcacggattccgatctgcaggtgcttgtctcgctgctttggcagtccggtgcggaggcgatcgccattaacgggtatcgtctcggtgtgcagacttccatacgaacggcagggacgacgatccttatcggcgtcaattccgtgcaaagcccctatcgcatcgaggcgatcggcaattccagtgcgcttgccaatgcggtgagcaagaaaacgcaaaaacgtttgtacgatgatttcaaagaagccggtatctatccgcaggtgagcagaagcaaatcgattacgctggaagcggcggtgaccggcgaagtgacatatgcaaggaaggtcaagtaatggcagcggtcttgggacttatcataggcgtggtcattggcgtgttcgtccggccggacattcccattgcgcttcagccgtatctgccgattatggtgctggcggcgctcgatgcgctgctcggtgccgcccgagcctattttcagcgtagcttttccgataaggtcttcgtgatttccttcttctcgaatgttattacggcaacattgttggttttcctaggcaaccagcttggcgtcggttcccagctgcagactgcggtcatcgtcgtgctcggcattcgaatcttcaccaatgtgtcatccatccgacgtttcatcttcaagggatgacggcgtatgagcagacgcaacgatgccaacaaggatgtactctccaagatccacgagcagatcgtcaaagaccaaaacaacgacagcacccaaaccggatcgtttcctgtggtcaggcgcaaaccgaagagggtttcgctgaatgcgaaggccactcgcgcgcgcctgtattcaagcgtgctcgtaaccgtgctttgcgcgttgctgggcttcagctacgctatccagctgaacaacacgacctccacatatgagacgatgagcgaggacgagctgaccaagcttattagcgaaacgagtacgcaggtgcaaaagctcgaacagcgtaaaagcgaactatccaatcagcttgactctctgaaggataccgccgacaagaacgagaaggcagcggaaatcgccaggcagaacgctgaatcgaatggcattctttccgggcgtttaccagtatccggcgaaggcgtggtcatccgtatttccaaaggatcaaagcgagatattgacgcgtcgattttattcaccctacttgaggaactacgcaatagcggcgcggaagtcattgaaatcaacgatattcgcgtgattaccagtacatacatcagcgatacggcggatggtctcgattgcgacggtacgaatatcaaggcgccgttcatcatcagggcgattggagacagcgacaatctgcagaacgcggtcaatctcgctggaggcgtcggttcacgtttgaaagtgaaatacggagccaccgtgtcgatcgtgccatccgataaggtggagatcacgtcgacacgaagcgcgccacaatacacgtacgcgcatgtcgtcgaatagcatcaaatacgatccgttaaaatataatcgcgctgtagcatgctgttcactctttcagcgtgccgatgtctgcactcaaccctatcttgttcatcgttgacatacagtccaggcctgcacattagtaccgcggaccccgatagcaaaggacaactcatggctgaacagaccatctccattacactcaacggcgaagcgaaggaggtggcagcagatcagactggcgtccagctcttcgcggaagacaagaatatcatcgcagtgcgtcttaacggcgaaccccgcgacctgtataccgaactgcacgacggcgacgtcgtggaaccgattgcattggacagcgaagatggcctggccatcatgcgtcactccgcaacccacgttatggcacaggccgtgcaggagatccgtcctgatgccaagctcggcgtcggcccggtcatcaaagacggtttctattacgatttcgatgtcgagactccgttcactcctgacgatcttaaagagatcgaaaagcgcatgcagcgcattatcaagtcctcccagtccttccgccgccgcgtggtgaccgaagaggaggctctggcagaagagtccgatcagccgtacaagattgaactcatcaaagacaaggaagcccacctcgatccagaagccgccaccgaaatcagcggcaaggaactgagcttctacgacaacgtcgaccgtgacggcaatgtggtgtggaaggatctgtgccgcggaccgcacctgccgaacactcgctatatcaaggcgttcaagatcgagcgttctgcagccgcatactggcgcggaagcgaagccaatccgatgctgcagcgcatctatggcgcggctttcgccactaaggaggacctcaaggcatatcaaacccgccttgaggaggccgccaagcgtgaccaccgcaagctcggcgcggaaatggatctgttctccttcccggacgagatcggtccgggcttggctgtgttccatccgaagggcgccgctgtgatcaacgcgatggaggattactcccgcgaaatgcatcgcaagcaccactacagcttcgtgcagactccgcacatcaccaagggcggtctgtatgagacttccggccacctgcattggtacaaggatggcatgtatccggcaatgcgtttggacgaggaaaaggatgagaacggcaacgtcgtcaagcagggcttcgactactacctgaagccgatgaactgcccgatgcacaatctgatcttcaaatcccgtcagcgttcctaccgtgagttgccgttgcgtctgtttgaattcggcacggtgtaccgctacgaaaagtccggcgaagtgcatggtctgacccgtgtgcgcggcttgactcaagacgattcccacatctactgcacccgcgagcagatgaaggacgagctgaagaacctgctgaccttcgtgcttggtctgttgaaggactttggtttggacgacttctatctggagctgtccaccaaggatccgcacaagtacgtcggctccgacgaaatctgggaagaggccaccaatacgttggctgaagtcgccaaggaatccggacttgaactggttgacgatccatgcggcgcagccttctatggtccgaagatctccgtgcaggctcgcgatgccatcggccgtacgtggcaggtgtccaccatccagcttgacttcaaccttccggaacgtttcggcttggagtacatcgctgccgatggcacccaccagcgtccggtgatgattcaccgtgcactgttcggctccattgagcgtttcttcgccgtgttgctggagcattatgccggtgctttcccggcgtggctcgctcctgtccaggtgcttggcgtgcccgttgccgacgaattcgccccacacctgcagcagttcattgccagcttggaagaggagacggttcgttgcgaaatcgacatgtccgatgatcgtttcggcaagaagatccgtaacgcttccaagtcgaaggtgccgttcatcctcatcgtcggcgaggaagacatgaacaacaacgcggtgagcttccgcttccgtgacggcagccagctcaacggtgtgccggtcgatgaggccaaggcgcagatcatgaccgtgctgaagaagcgcgttcaggtcaacaacgtcgacgatttcaaggccgccatcgcagactgatctgattcgttcacgttcggtcgcatacggttatgaattatgggggcgtgcaagcatcacatactgacgcttgcacgcccttttgctttccgaagaacaggaattcgcatgttagaacatctccgtgcaccattcaaaagacttatcgagccattcgccaaggcactggtatcccttggcctgacagcgaatgcggtgacggttattggcgctattggaaccattgtggtggctttcgccactggcattacgggatggttgttcgccggagcggtggtgctgacgttgctggtgctcgccgattccctggatggctcaattgcggcactgaccacgggaggcacccaattcggtgcttttttggattccacattggatcgtatcgctgattgggcattgcttgccggagtggtcatcttcttcatcctgcatgccgattggtggtatgacatcaaccggtcaagcccggattgcattagttggattggtatcgccgcagccatggtgtcgatgatgacgtcgttcgtgacgtcgtatgcgcgcgcccgtgccgaatccgtcggtttcgaagtgaaaaacggcattgcaacgcgtgccgacagattggtcatcattctggtgggcatggcgattaccgggctcacgcaccaagggttatggctggccatcgccatggtattgcttgcggttttgggactcattaccgtattccaacgcattcttgaggctcgttgccagatggccgtcggtcataagacgtatcagttgtgaaccggctgcatgaaacggccgttgacgcgcctgacatacgtatgtcgggcgctttgtcttagaaccgctttagaatcgtttcgtttgaaacatccgcaacctgcctaggagcattatgtcaggtcattccaagtgggcgaccaccaagcacaagaaggccgccatcgacgcaaagcgtggcaagctgttcgccaagctgatcaagaacatcgagatcgcagcacgtatgggtggtggcgatcctgacggcaacccgtccctgtacgacgccatctacaaggccaagaaggcttccatgcctgccgataacatcaagcgcgcagttaagcgtggctctggtgaagaagccggcggtgccaactatgaagatatcgtctatgagggttacgctcccgcaggcgtcggtctgatcattgaatgccttaccgataaccgtaaccgtgcggccgccgaagtgcgttccaccctgaccaagggcaatggctctttggctacctccggttccgtgagcttcaacttcgagcgcaagggccagatcatcgttccggccgagggcgtcgattttgatgatctgtttgagaaggccgcagaagctggcgctgaagatgttacggacgacggcgacgtgttcactgtcgtcaccggtccgtccgagatgatcgacgttcgtaaggcccttcaggacgctggattcgattatgattccgctgatctggtcatgatgccgaagaacgaggtcgaattgactctcgaagatgcccagaaggtgtccaagctgatcgacaacctcgatgatctggacgacgtgcagaacatctactccaactggaccgcctctgacgaggtcatggctcagcttgacgaggagtaatcaagcgtgattattcttggcgtcgaccccgggctgactcgctgcggggtcggcgtgatcgaagccggcgcataccgccggctttcttttattcatgtggacgtggtacgttccgatccgaaaatgtcgcaggacttacgtctgttagccatctataacggtttggtggaaaagatcgaacggttcgcaccggatacggtgtccatcgagcgtgtgtttgcacaggagaatcgcaacaccgtactggggactgcacaggccgccggactggccatgctggctgcggcccagaggggcattcccgtcgccttgcatacgcccactgaatcaaaaatggcgattaccggcaacggcaaggccgaaaagattcagatggaacgcatggtcgcccgtattctggggctcaataccttgcctaagcccgccgatgccgccgatgcgttggctatagcgatttgtcatgcgcttcgccccgcaggcgcgttacaggggggagagcgtgaacaacacttgaccgatgcacagcgtcaatgggctctggcctcacagaaggcggcgcgacaacgcggcgtccgtaggggaatgtagactatcgaacagatgttctacagttgtatgcgggaggtgacggcatgataggcatgttgcatggccaggtcgatttcattgacgccgcttcggcgattattgaggtcgggggagtgggatatgagacccgtatgccttcggcggatttggcgtccatgcacgctgggcagacggtgaaggtatacacgtcattgaatgtttcgcaggatgcgattacattgtatgggttttcttcgcttgcctcgaaacgcatgtttttgcaattacagaaggtcagcggaattggtccgaaagtcgcgctttccttgctttcgacgttgcctccggaacgtttggcgaaagctgtggcggacggggatgccaccgcgctggcgaaggcgcctggtctaggcaagaagggtgcgcagaagattattctcgaactcaaggggtccatcgatctcagtcagatcgagggggcttccaaagaggttcgttctgcggaagatgccggttcggaacaggtcgtggaaggtctgatgtcactagggtggcgtcagcaggatgccttgcatgccgtgcagacagtctgcgagagcaatcatatcaatgttccattgagggacgatgatgtgccccgcgtgctcaaacttgcattggcttctcttgaccgaggtaggtgaaacgcatcatcatgacgaacgacgtcgcattcgaacagtcgaataccggtgccaatgaggaatcgcttcgcatggtttccgcgtcgcctgtcggcaacgagccggtaagcgatgaggaactgcgtcctcacgtcctcgatggttttattggacagccaagactcaaggcgcaattgcagctgtttttggatgctgcccgtaaacgtgacgttccccctgaccacatcctgctggcggggcctccgggcttggggaaaaccacgttggccatgattgtagccaacgagcttggagtgccgattcgagtcacttccggacctgctatccagcatgctggtgatttggcctcgattctaagctcccttgacgcaggggaggtgctgttcatcgacgagatccaccgccttccacgggcggccgaggagctgctgtatatcgccatggaggatttccgtgttgatgtgatggtgggcaaagggccgggtgcttcctccattccccttactttgccgagattcacggtgattggcgccaccactcgcgaaggcatgctgccatcaccgttgagggctcgttttggttttaccgcgcatcttgacttttatccgcatgaggagcttgaaaagctcatcgaacgatcctcttcggtgctgggcatcagtctcgaagagggagcggcccatcagcttgccatgcgttcaaggggcacgccgcgtatcgccaaccgattgcttcgccgcgtaagggattgggccattgtgcacgatttagaaactgtgcatccggacgatgtcaaggaggcgttggcactgtaccagattgataccgagggcttggatcgtttggatattgcggtattgaaagccattgtcaccaatttcaacggcggtccggtcggtctgaacaacctgtcggccatggtcggtgaggaatcggagaccgtggaaacggtgtgcgagccgtatctggtccgagaaggattccttgtgcgcaccccgaaagggcgtgtggcgacgcgcaaggcatgggatcatctcggcttgacttctgacgaatctcaggttgatgtcagcaagctagcttagactcggtgttctggacatagagtcctgttcgagcgtccatcccaaggagttgtgctttgaattacatgtttcttatcgtcatcattgtcgtcatgtttggcatgatgttctggcagtccaagaaggctaagcagcagcaggccgagcgtcaggatttccgtgccaacctgcagccgggcactgaggtcatcaccattggtggtgtgatcggcaaggttgtttccgtcgataccgaatacgaggagatcgtcatcgattccgaaggctctcagattcgtttcggtttcaacgccatcagccgcgaatacgtgcgtcctgcgtacgtacacgacgatgaggtcgatgaaaacggtaatcctctttccaccgattccacagacgaagatcaggctgctcaggagccgattgaaggcgaaatcgaagcggcgcagactgagaccgagcagaagaacagctgacaagctcattaaggcatcggcgaaaatctcatttttgaggttttcgccgattttattcctgacggaaacctataatgcaaagtgccgtagcactacaaaagaaggacaatacagtcatggcatcgtcggatattaccgtttccggtcttagcaagattggaaacgaaaacgccgagtaccttgtttcaaagattcgcaccattccgggattccccaaggaaggtattctttttcgtgatttcatgcctgttctggcagatgcgcgtgccttcggattgctacttgacgcactcgaagccgcgttgccggtcgctgccgatgaattcgatatcatcgcaggtttggaagcccgcggattcctttttggtcctgcgttggcagcgcgcctgggcaagggcttcatcgcagtgcgcaaggctggcaagcttcctccggaaaccgttagcgaaagctatgaccttgaatatgggcaggccaccgtcgaaatcgagacgaatatcgtgcatgagggatctcgtgtgcttgtcgttgatgatctgattgccactggaggaacagcgcgtgcggctgcttcgttgatcgaaaagtgtggcggcacggtggcaggtttcagcttcgtcatggagcttgtcggcattggtggcatggcatcgctgggagactgcccgacaagttcactgatcaccatgcctgcgtgagttaagtacattcttcgtaaataaccaatagcatcaagggaaaagaatccatggatctctatgagtaccaggctagggaactgcttgaagagcagggtattccaacgcctaaggcagtgttcgcgcagaactctcacgaagtggctgaggctgccgagcagattggctaccccaacgtgattaaggctcaggtgaagattggccaccgcggtcaggctggtggcgtcaagctggcgaagaatcgtgatgaggccattcttgcatccgaagacatcctgccgatgaccattcacaagcacaaggtcagcggcgtgttggtggccgaggcaaagaacattcttcacgagtattatgtctctatttccgtggatcgttcgtctcgcgattttgacgtgctcgctactgcgaatggtggaaccgaggtcgaggagatcgccaaggaacacccggaatctgtgaagcgtctgcatatcgacgctctggaggatttcgatatcgaggctgcgaccaagatggcggaaagcattggcttctatcatgccgacgtcaaccaggcagcacagattctgctgaagatgtggcagtgcttcaaagagaacgacgccacgcttgtggaaatcaatccgcttgccaagatcggcgatccggatgacgagtcttccaagacattgtgcgccctggacgccaagatttctttagatgacaatgctgcgttccgtcatgatggctggaagcgcttcgctgacccagtgcatgtggatccgtttgagcagaaggcgcgagagcatggtctgcactatgtgcaccttcggggttccgtcggtgtcattggcaacggtgctggtttggtgatgagctcacttgacgcggtttccggagctggagaagatcagggcaccaatgtcaaaccggcaaacttccttgatatcggtggtggtgcgtccgccgaagtgatgtgcggcagtttggagatcgtgctgtccgacccgcaagtcgaatcggtgttgatcaacgtgtacggtggcatcacatcctgcgagcaagttgccaagggcattctggaagcccttgacaagcttggcagttccaagcctctggtagtccgtttcgacggcaacgcggcggcagaaggtctgcatattctggctcaggccgatcgtgtcaatctgcatgttgcacagaccatggaagaagccgcacagcaggccgcgcgtcttgcggccaatggcaaggaggttcgctgaaatgacgcttttcattgaggatggcgcacctgtcatcgtgcagggtatgaccggacatcagggcatgacccataccgcccgcatgctgaaggccggcaccaatatcgtcggcggcgtcaacgcccgcaaggccggccaggaagtcaatttcccagcggccaaagacggcgaggatgttacgttgcgtgtgttcggcaattgcgccgaagccgtggaagtcaccggcgcccaagcgagcgtcgtgttcgtgccgccgcgtttcgccaaggatgccgtggtcgaagccattgaagccggcatcaagctgattgttgtcatcaccgaaggcattcctgttgccgatagcgcgtactttgttgaactcgcattgcgcaaggatgtgcgtattgtcggtccgaactgccctggtctgcttaccctgccttctacggaaggtgtgaatggttgcaatcttggcattattccggacggcatcgtctcccgtggacctttgggtttggtgtctaagtccggtacgctcacctatcaactgatgggagagttgtctgacattggttttaccgcatgtttgggtgctggcggcgaccctatcgtcggcactacgttgcaggaggcgcttgaggcgtttgaaaacgatgatgccaccaaggctgtcgtgatgatcggtgaaatcggcggtagtgccgaacaggatgcggccaagtgggcatccgagcatatgaccaagccggttgtcgcctatattgcaggcttcaccgcgccggaaggcaagcagatgggccacgctggtgccatcgtttccggaggcaagggaactgcgcaagataagaaggaagcgctcgaagccgtgggtattcgtgtcggacgcactccggggcagaccgctgaaatcatgcgcgaggtgctcgcttccaagtcgatatgatggcgaacctgaagtattggttgaaggggcttgccgtggcggcattgtccatggtcgtctatgccggtgccctaggctgctacattgcgctgatgcttctggttatttccatggaagaaggcggcgacaatctctccgccttctctgtttccttgaccgaggcggttgtgcttctcagccaagggaacggtttcaaaaccggatccatcactttgacgattatgccgttgctgcttacggttttgctgatcgctcttatcgcatcgctcgccaaacgcgtcggaacgagtctgtccggatgcgtggcaggaaccataggctgggtgttgatcaatgtgttcttcgccaatagccttgacatcaaactcgttgatacgacgggcgtggttgctgtgaaaacagcgatcgtctttgtacttggctatgccattgccgcgattcccgaatcaccactgatcaaacgagatttggattggatcagcgagcatgtttcgtctccggtccgtaaaaccgtcaccattggtgttgccttgggtgtgctgttgatcacggtctatctggtcattggactgattgtggtcttgtactgggcattcagcaaccagtcggccatggtgaagttgtatgagctatcgggaatgcagaacggttctcgcatcctcaccacgatcgccatgatcgcttggattccaaatatcgcgatttgggctatttcctgggtattcggggctggtttttcgattggcgatctagcggaattcaccatgtggagcggtcaggggtcggcattgccgtctctgccgatattcggtttgcttcctcaagcgattgaaacgaattggattcggatcgcgttgatgtgcgttcctttggctttagcttgtgccgcgggcatggtggtcatgctgttcaacaagggctttcatatcagagtaggcaactccgatcagcagattgatgtcaagagggtagtgcttggctttgcctatccagcgggagcgttctgcatttcctgcaccgttgtatcggtatgttcgagtctgctttttgccatctctagtggagcgttgggctcaaaacatcttgcgcacatcggcgtcgacgtgatttcatcgacccgtaagattggacagcctactgccgtgggactgttttcgtcatggctgctgactttggtggccgtatccatgttttttggaatacgctggatagtaaagcgtgtccgcgagagcaggagtggtgcgtccactgcggctcttgaatcagataatcgtgaggtcgcaaatgcggcccgcacagtgacctcaaccatcaataacaaggaggatcagggtgacaacaacgaatcgaccgatacggcgagctctggtatcggtcttccataaggaaggcatcgaggttcttgccgaagcgttcatcaaggccggcactgaagtggtttccactggttccactgcgaagcgtcttgcggaacttggcgtcaaggtgacggaagtctcggaagtaaccggctttccggagtgccttgacggtcgcgtcaaaaccctcgacccgcatatccacgcgggcattctcgctgacatgaccaatgaggaccacgcggcacagctggaaaagttcggcatcaagccgttcgatctggtggtcgtcaacctgtatccattcgccgatacggttcgttctggcgcggatgaggctgccaccatcgagaagatcgacatcggtggtccgtccatggttcgcggtgcggccaagaacagcgccactgtggccatcatcaccgatccgaacgattacgcactggtagctgcgcgcatcgaaaacggagagggcttctctctcgaagaacgtcgttggctggccggcaaggcgttcgcccatactgccgcctacgatgccaccattaacgagtggactgcaaagcactggccgaagcctttgaccgttgagcagccaaccgccgaagacgagccggaagtgaatgagaccaagttcccggccgcattcactcgtacttgggaccgtgcccacgtgctgcgttacggtgagaatccccaccagcaggccgcgctgtatctggatccgctgaaccaggatggtttcgcgcatgccgaacagctcggtggcaagccgatgagctacaacaactatgttgatgctgatgctgcttggcgtgccgtatgggattttgctccccagattgccgtcgccgtggtcaagcacaacaatccgtgcggcctcgccgttggcgccactgttgcggaagcgcacaagaaggcacatgcctgtgatccgatgagcgcctatggcggtgtgatcgccgcgaacagcaaggtcaccatggaaatggcggaaagcgtccgcccgattttcaccgaggtgattgttgctcccgactatgatgccgacgctctcgaactgctgcagaccaagaaaaagaacctgcgcattctgaaggtttccgagccgccgaagtccaagacgcagttccgtcagatcgacggcggtctgttggtgcagtccacggatcttatcgatgctccgggcgacgatccgaacgcttggaaactggtttccggcgagcctgctgatgagcagaccgtcaaggatctggttttcgcttggcgggccatccgctgtgtcaagtcgaacgctatcctgatcgcccacgatcaggccactgttggcattggcatgggtcaggtgaatcgtgtcgattccgcgaacctgtccgtcgaacgcgccaacacgctggctgatggcgcaaaccgcaccaagggcgctgtcgctgcatccgacgcgttcttcccattcgcggatggtgcggaaattctcatcaatgcaggcgttaaggctatcgttcagccgggcggttccattcgcgacgaggaagtgttcgaagcggctcgtaaggccggcgtcaccatgtatgtgaccggcacccgtcacttcttccactgatacgccgcctctcatgtgagggtattggtcaacgtggcgtccgattccgtattggtttcggacgccacgttttattatgattacggttgttgtacagcaagcaagatgaaaggccccggaatgagccatccttacgtttccgaagatcatgagggcaaaccgtggttcgaatggatcgtcgccgcggtagtgattgttgcgacggtgcttgcggtcgcaggatatacaaaagccgccaccgctgcgattgcggtgacggccatagcgactggactggtcagactggcattgcgtgagcgcagtccatggaaggttcggtcagttgctttcgacgctttcatcggcattggcttgggcgtaggactgttcatcctgctcaccatcgttcccgtcggcaactgacgcttcgccaagaacggtattgccttcgaccttatcgatggtctcgacagtatccggcacgttcttcttcgtaccaatcatgccggcgacgatgacgacgagagcaacaactgcagcggcaagaacagggcaaatccagaagacccacagctgttgcagcggctcttcattcagtccttgattctgtgcgaaaatggcaatgcccgtggcacgtgccggattcagtgcggctccggtcaccggataggtgatagcggtgccgatgccgtaggcaaggcccatggcaacggcgtggtttgttttggactcgccgtgtccgtccgtggtgcgcagtgcggaggcaacgataatgatacctgcgacgacttcaacggcgatggccagagtgatgccgagggtcactccataattgccgagggtggagtaggagacggaattcttatcgaaaccgttgaccgttggtgtcatccagatcttgaatgtcacctgctcggaagtcggcagaaggaaccggatagcggcacccgcgccgataccgccgagcacttgggcaatgatgtacagaatgccatcaagcacgtgggttttgccagtgagcatggcggcgacggatacggccggattgaactgtgctccggaaatggaaccgaagattacggtgacggcggcgtatacgatgcccgtcaacagggcgatgaacgccatgttaatgccatacaccgcggaaccaagcgagcagatcgcataaatcgcgaagcaaatgatgaagcttcccacaagttccgctccgacacgaagtgtcaacggcttgctttgttcttccttggttatgggcgttgcttcaacagcagtcatagtctttcctctgtcatatagtggacaagttgcgattttgggaaatcgccaaacgactgccatagtaccagcagtccctataagtattatccggccacgttgggagaacgatgccaaacgcatattcccgcgccgcgaaggcgcacacacacgataatgaaggtatccgtctgcagaagcttcttgctcaggcaggattcggatcccgtcgcaaatgtgaagagatcattactgaaggacgtgtcgaaatcgacggcgagcttgttaccgaattgggcactcgcgtcgatccgaaacatcaggaagtccgtgtggacggctcccgtgttcgcgtgaatcccaatcatgtcacgctcgctttgaacaagccgaagcgtgtgctgagcgccatggaggatccgaagggacgctacaccctgagcgatatcgtcggcgacaagtatgaccgtattttccacatgggccgtctggattatgattccgaaggcctgattctcatgacgaacgatggcgagctcagccagcacgtcatgcaccccaagtacgaggttgagaagacctacatcgccacgttggaaggtcgcatcagcggtcaggtgtgccgccgactggtcactacaggcgtgcagctcgacgatggttggatcaagctcgaccgttgcgcgattcttgatgccagccgcgacagcacgctggtcaaggttgtgctgcattccggcaagaaccgtatcgtccgtcgcattttcggttcgatcggattcccggtcaagcgtctggtacgcacccagatcggcccgattaagcttggcgatctgaaatccggatcgtaccgtgtgctttcgcagaccgaggtgcgttccctgtccaaggcggtgggcctgtgattcgtgtagcgattgatggacctgcgggtgtcggcaagtcttccacatccaaggcgttggccaaatattacggtttcgcttacctcgataccggtgccatgtatcgtgcctgcgcatggtggtgcatgaacaagggcattgaccttgacgcggagacgatcgatgaacaactggtcaccgaaaccgtgggagagttctttaccgaaggtcatttcgacatcagcgtcgatccagacgattcgaaggtatatgccgacggcgaagacatcagcgacgttattcgttcctccgaagtgtcatcccatgtgtccaaggtgtcgaacatcattcccgtccgtcacgtgctgattgccgctcaacgcgcgtacatcgcacgcgaagctgcgtctgactctttttctgagggtgccggagtggtcgccgaaggccgtgacatcactacggttgttgcgccggatgctgaagtgcgtgtgttgctcaccgcccgtgaagaggtgcgacaggctcgtcgttccggtcagtcaactgatggtgtcggatcagaaaatgttgcggcgcgagatgcagctgattccaaggtcacgaatttcacatctgccgcggaaggcgtgctgaccgtcgataattccgatttgaatttcggcgaaacgcttgatgtgcttgtgcgcattgtcgacgatgccatcgaagagcagcagtatcgccagtacgcttccaatcttgacgattatgagttggatgagggcgatgaaggactgatcgatggatcgtcgttcgttggcggcgaacgccggtccggcccgaagccggttggcgtgcttgccgtcgttgggcgccctaatgtcggcaagtccacgctggtgaaccgtattctcggccgtcgcgctgctgtggtggaagacactcccggcgtgactcgagaccgtgtgagctacgatgccgaatgggccggcaccgatttcaagctggttgataccggtggctgggaagccgacgtcgaaggtatcgaatccgccatcgcatcccaggcgcagatcgccgttcagcttgcagacgctgtggtgcttgtggtggatggccaggttggtcttaccaacaccgacgagcgcattgtcaagatgctgcgcgcctccggcaagccggtcacgctggcggtgaacaaggttgatgatcgtgagagcgaatatttgaccgctgaattctggaagatgggcttgggggagccgtatggcatttccgccatgcacggtcgcggtattggcgaactgcttgacgctgccttggattcgttgaagaaggctgagaaaacatccggtttccttactccgtcccatttgcgccgtgtggcgttggtcggtcgaccgaacgtcggcaagtcgtctttgctgaatcagctggctcacgaggaacgtactgtggtcaatgatttggcaggtaccactcgcgatccagtcgatgaagtggtgacggttgatggggaggattggctgttcatcgacactgcaggcatcaagcgtcgcctgcataagctgtctggtgccgaatatttctcatccttgcgtacccaggccgcgattgagcgttcggaacttgcgctggtgctgtttgatgcttcccaaccgatttccgatcaggatttgaaggtgatgagccaagcagtggacgccggtcgatgcatcgttttggtgttcaacaagtgggatttgatggatgatttcgaccgtcagcgaatggaacgcttgtggaagacagaattcgaccgtgtaacgtgggctcagcgcgtgaatctgtcggctaaaaccggatggcatacgaaccgtctggccagagccatgcgtggagcgctggaatcatgggacgagcgtattccgaccggtaagctcaatgcgttcttgggtaaaatccaagccgcccatccgcatccactgcgtggaggcaagcagccgcgtatcttgttcgcgacgcaggcttcgacgcgtccaccgcgtttcgtgattttcgctaccggcttccttgagcatggttaccgccgatacatcgaacgttgcctgcgcgaggaattcggttttgaaggttccccgattcagatttcggtgaatattcgagagaagaagaaacgcaagtaagtttctatggatggtggccgcacaccattccttgggtgtgcggccaccatccatatttgctagatcagtgcacgccaatcatgcgtgactcattgtcacatgcttaaaacagcggctgttcctcagtatcccgttgacgtagatatccgctgatcgcacgccgcgcgagcgaactcaaggatatgccttcctcggacgcgcgctcccgtgccatcttgccgatggcataggggagtttgattttccattcgtctccgagctgttctcgaccgtcggtgttcttcggtcttcgtccagggcggacggtgtccgtggtctcattcagatcgtcgcattcaagcgccttgcgcgtcagttcggtaagggtgatgccatcatgcttcgcccgctccctggccgctacgccaagttcccgggacagacgtatcttccactcatcctcaagctcggatgagtcaaacacgtgggcaaagccgtcaacgtcgtcaaactgtggctgggcgtccatcgacttcaagacaatcaccccttacctgcatgcgtaagactgacatcctaaaaagaaaacccgaaatcgcatgaattcgggtttttctggtcggaccagcgggatttgaacccgcgaccccttgacccccagtcaagtgcgctaccaaactgcgctatggtccgaacgatgcaaaaagcaccgaacatgaaacatagcacaacctgctctatttttcaaattcatcgtgtcgcacgattcgcgaaacatgataaaagagttcttgggatgtcatttttgtcaagaattttccctttttgccaccaaaagcccccgtcatgggaattttgtcgtagtattgcctaggtacgatgagaacaggacgcccgcacgaaagggaaagacattgactgaggacgcatttgaacattccgccgcaaagatgcgggacaacgggatgaccgatatggccattgcgcaattcaaacgactgtacgaggtttggcgcagtgaggaagcaagcacatggatccgtgaggatgatgttgagcctctggtgggagtgcctagcttccatgatgtctacgagaccatcaaccatgacaaagccgtcgatgcttttgccaaaaccgcgttcctcaaacttaatggtggcctcggcacgtccatgggcttggattgcgccaagtccttgctgccagtgcgtcgccataaagcacgtcagatgcgcttcatcgacatcatcatcggtcaggtgctgactgcacgcactcgtcttggtgtggaactgccattgacgttgatgaactccttccgcacgtcgaatgacaccatgaaggtgctgcgtgccaacaaaaagttccatcaagaggacattcctctggaaatcgtgcagcatcaggaaccgaaaatcggtgcggaaaccggtcttcctgtcagcttcccggcaaatccggaacttgaatggtgcccgccaggccatggcgacctgttctccaccatttgggaatccggcctattggacgtcctcgaggagaagggcttcaaatacctgttcatctcgaattccgacaatctcggcgcacgtccttcgcgcacgctggcgcagcacttcgaaaataccggtgcgccattcatgatcgaggtcgcaaaacgtactccagctgatcgcaagggcgggcatatcgtgcgggacaaggcgaccggccgcttgatgttgcgtgagatgagccaggtgcatccggacgataaggatgatgcgcagaacatcgaaaagcatccgtattttaacacgaacagcatctgggtgcgtatcgacgctctgaaggccaagctgtccgcatatgatggcgtgcttcctcttccggtgattcgcaataacaagaccgtcgatccgaccgatccgacgagcgagccggtcatccagctggaaacagccatgggagcggcggtgacgttgttcgacggggctacctgcgtatgcgttgaccgtatgcgtttcctgccggtgaaaaccaccgacgatttgtttatcatgcgatccgatcgattccatctgacggaccagtacgagatggaagatggcaattacgtcttcccggatgttcacttggatgcgcggtattacaagaacatccatgatttcgatacgagattcccttatggcgttccgtcgcttgccgcggccaattccgtcgacatcgatggtgactggaccttcggcagggacgtgatactgttcggtgacgcgcggctgaccgacacaagtgagccgagttatgttccgaatggcgaatacgttggcccgcaaggtgttgagcctgatgattgggtctgattcgaggggtagcctcaacacgaaaaactgtattttttcgtaaaatagacacaatctgaacgaaaaccctctatcatagagaggtgtgtgcagagcctgaaccggctaggcacttaagatgaaacgttaacgagacgtgaggactaatggcagagggcagtaacggaaggcgtcgtttctccgacaaatggggcaagcacgaacttgatgtattggctgtgctttcctcagctttcccgcaatggctcacttcccgtcagattgcccagcgtgtgaaggcgtatgccgattcctatggggagctggctgatcaggcggcgaaggcggcttttgccaagcaattccagcgtgaccgtgccaagcttgcggccatgggcatcgccatcgaatcgaggcagcctgagtattcatctaagtcggaaggccaggatttcgcatcctatcgtctgcagcttggagatgagcctcgcgttcgtctgctgttcggcgacgaggatttgccgattcttgccgcggccaactatctggcccgttccatgtcgatttcctcagctcccgcacatgagacgcagcatacgtcccgtaccgcgcctcgcgtccctcagactccgactccagggcttggtcttgattccatcgctccgggtctgggaacgcaatccattcccgacgaattggtcaaggtcgttgaccagcgtcgtttcgcggcgactgtagatgttgacggcgagcatttgaacgtcgcctacaccgattccgatgatctggccatgttcgtgctttctcatccgggtgcttccatcgtcagtcctcaggaggctgtcgacgcgttcaaccgccgtttgaatgccgccacgcagttcgtgcctgccgacgaatccacaggaggcgatagctccactgtcacagccatggaaatcaaccgcaacagcgctgacgacgatgcagaggagtgcaaggggcgtccgaagaagaattccgcattccagacgggtagtgaagtcgaccgtcgtctgcgtctgatgctgttcctttcggcgcacctcggcgaagaatattcgcttgaggaacttgcggaacgtttcattggcaaaccgaagtccgatgacgagctgaagaagttcgtcaatgtcattcataaagacatcaacacgctgactacggtttccgacgatggtgagatggcaggaagccagttctttgacatcgactggtcgttgcttgacgctgaaggcattgtttccgccacgaattcgcttgggctggaacgcttggcaggtatctcccagcagtatttgagcatgcttaccgcatcggtgagctatcttgcgcattcgtcgttgctgccggacaagttgcgtgaacaggctgaatcgttgtacagccgtcttcgtcaacatgttgagccgggggacatgccttggctgagtctgaccggttatgagatggaaccgcgtaatttctccattgtgaagagcgcgatctccaagagcttgctgcttgacatggaatatacggatggcgccggaaggacccagcgtaagcttgtcgcgccagataagatcttcgtcgatgagggagtcttctacgttgccgtatggactgacgtcgctgccgctgcaccggctgacaaagctaagtacgtgaagaaagacaccacgatcaacaaggccacaggaaagcctcgcatctggcaggtgcttcgcatttcccgcattgaaaaggccgaactggttgaacctaccgcgaaaatcgacattcccgacgttcccgcatccgaattgcgcaaatggagcttcgataatggaactccagctgtgttcgtcaccaatcaggatgatctgtcatttattgacgggctgtcgggagcaacagtcgagaagtgcggagagggcgagaaggtgcatctgatcgtctcgtccgattcctggtatgtcgcattctgtatttcccacgcacggcatatcactgccgtagctcccgaaacgttgcgtaccatgattgtcgcccgtgcccagcatgagctgagcattggcgatcgtgagaatgaaggctgacgggggagagactatgccttggtggatttggctgttgctcgctctgttcatgcttgcaatggttgtttccggagtcgtctacgcatgtttacacggctatcgagcattcaaggacgtggcgaagctgggtgaacggacggcaaaacgaatcgaggcgatgggcaaaccattgccccaaaacaacgagaatgaagcgcctttctttaccagacctttaaaggatgctgcagatcgttatgcggatgcccatgccggagtcattgagaggcatgaagcgaagcgaagccgtcatgctcaacagtgggcacaatggcgtcattgtaacgattgacccaaccatattaaggaatcatgacccatcatcgtcgtcgtaataacggtattgacccgtcgaaaatcaatgagaccgtggagttgtctcccgcgcaacggtatgccgcattcaaacaaacgcaggccaagcagcgcacggttgcggccgaattcgcaagatccatgccattcgagcttgacgaattccagatgcaagccaacgatgcgttggaggctggcgataatgtgctcgtggcagctcctacgggagcaggcaagactgtcgcagccgatttcgccatctatctggcgcagacgcggaatgtcaaagccttttataccacgccgatcaaagcgctgagcaaccagaaataccatgatctggtcgaccagtatggaacggataaggtcggattgctgaccggagacacgtccatcaactctgaggcggatattgtggtcatgaccacggaagtgttgcgcaatatgctgtatgagcattccgtgacgcttgaagcgcttcgttatgtgatccttgacgaagtgcactatcttgctgaccgtttccgagggccggtctgggaagaagtcattatccacttgccgaaaaacgtgaacatcataggtctttccgcgacggtttccaatgtcgaggatttttccgaatggatcgaatctgttcgtggcaaaaccacgttggtcatgtcggaacagcgtccggtaccgttggagcagcatgtgctcgtacaggcagatgaccataccgaaccagaactcatcgacctatatcggcgtgacgccaatggcgaacagacggtcaaactcaatgcgcagctgataaacagacttgatcagcttgatcgtcaggcggaacggcgcaagggcgagcgacgtcctgataagcgtagggccaaaggtaaaggtggacgatgggacgatcgcccgcataaggtcgaacgccatacgcctcgacgctgggcggttgtggacgagttgaattttcttgacatgttgccgggaatctacttcattttttcaagaaacggttgcgatcaagcggttgaccaatgcatcaacgcaggcttggaactcaccaccagcgacgaagtgcaacaaatcagacggatcgtcgatgagatggtcgaaggccagttgagccaagaagacttgaaagcgctgcatttctcgcaatttcgtttcgccctggaagaagggttcgctccgcatcatgcgggaatggtcgcattgttccgccagattgtcgaacgcttgtttgaagaaggcttggttaaaatggtcttcgccacggaaacgctggctttgggcattaacatgcccgcacggtgtgtggtggttgaaaagcttgagaaattcgacggcaccgggcatgttgggttgactcccggcgagtttacccagttgaccggtcgtgcgggacgacgtggcatcgacaccatcggacatgccgttgtggtggaccaccatggttttgttcccgccactgcggccgccttgtccagcaaacgagtgtatccgcttcactcaagcttcagaccgaccttcaatatggctgtcaatctattgaattccagcgactatgaaacagctcgcgttacgcttgaccactcctttgcgcaatgggaagccaacgagtcggcatggcagcttgaagcacagatggaaaccttatgcaaggctctggaaggatacgagcaggctttccagtgtgaattcggcgatttcaaaaaattcatgcgtttgcggatgcgtttgagtgatttggagaagaacgaacgtcgcaaactcaagcatgaggtgttccgtacgcagaaggaacgcagccaggcgtttatggatcttgacaaacgcatcaagaaactcagagaagaagaccgcgaccatccatgccgtaaatgccctgatgtgcagaagcacttgaaatggggacatcgttgggctcgtgagatgcgcgagttggaacgggtacagcatcgttacgattcgcgaaccggttccgtggcacgtcagtttgatcatatttgcgctgtgctttccaatctcggctatcttcagccggtacgggaatccgcgggccatggtgattatcagctcacggaacgtggccagctgttgcggcatttgtacagcgagcttgatctagtattggcgcaggcgattgacgatggcgcatttgacgggttgaacgcctgtgaattggccagcgtcgtcgcatcgttggtgttcgaagcccgcaggggaggcgggggagagccgcgtcgttaccctggaggcattcaagggaacgtcgccgtgtgcgcagcgcagcttaagggcgtccatgcgtcgattgccatgttatgtgaggatcacatgcttgaggagcctcgccaactcgattttggcatcaccgatatcgtctacgattgggcgcaaggtgaaagcctgtcgcaggtgctgtacggcaccgatctgacgggcggcgatttcgtgcgtaacggcaaacggcttgccgacgtgcttcagcagatagccgtggctggaccgtatcttgcggatcgtgccgaaacgttggcgccagtcgcaaagcaggcgtacgatcgcatcaatcgtggcatcgtcgcatactccggcgtcgactaaaatcgaacatcaagcagacgaataaggaataaaagacacgtccgaactgttctgtagcttagacagagcagacaatccaaggaggcaaaggcaatatggcagaacgcagcctgcgaggcatgagcatcggcgcaaagtcgttggaatctgatgacaatgtggatttcgcggcgcgaaacgacgtcgcatatgtgtgcccaaagggacaccgcacgattctgccgttcgctgaaggcgcggaggttccggaggaatgggagtgccggtgcggcatgaccgcgcatcgtgaaggcgacgaggatcgtgaggccgacgagatttccaagccgacccgtacacactgggacatgctattggaacgccgtactgaagacgagctgaagacgttgcttgaaaagcgtctgcagatgcatcgcgacggctggtttccagactacgagtaaccagtagttgaacgacacttgaactgcatgcccggtcagtaagaccgggcataattgttatctgaacagttcacattgcatcgagcatttaacaaggagtgcattaatctcatgtccgagaagaccaagcaacccaagaaagtcgttctgcttgaccttgacggcacattgaccaagtctgatccgggcatcattggttgtgtggtgaaggtatttgaggaactggggtatccagtgcctgatgatgaggagttgcagcgattcattggtcctgcaattgtcgagtcgttgcagcgcaataatattccggacgacttactcgatgagggcattgccatctaccgcaggtattatgcgcaggaagcggtgttcgatgatccgaataatccgggtcaaaaggttccgggccgtttgaacaataccatttatgacggtatcccagaacagttggccaaactgcgtgctgacggatactacttggcgatcgcaagctgcaagccgcagtatcagtgcattccgatttgcgagcatttccatttggacaccatggtcaacggcatttacggtgccagcgaagataattcgcgtctcgacaaagatcaggttattcaatgggcgttcgaccacattgggtttgacgaagccgctggcgataaggcgctcatggtcggtgaccgttggaccgatgctgacggagccaaagcgtgcggtctggattgcttgggatgcggctggggttatgccgagcctggcgagctgaaagaacatggcgcgtataaggtgatcgattcggttagtgagcttgcgcaaaccatcgaagactatttcgcctgatagataacggctgatgcacgagcggatcatcttgtgcataaagacaaagaaacccctgggtatgcatgccagcgatgacatttgcatacctggggttttgagagatcgcgtacatctcaaataccccctgcacctgctcccacttttgtccgataatgtacgttatgtcagaaaagctacagcagttttcgactgacgctcttttctgtacataacatcggtgggttatgccagcacgtccctttcgggactttgctcgacataacccaccggcatgatggatggtgcgttttcgcttcgatggatgtctttttggctagtccttaatggcttggctgagttttctttccatttcgcttttcatgccgtttcgggcctgcagatacataaacaccagttccgtggcgatgagcataaccatcagtgctgccgacggccaaccaacctgttcgtagaaatgctgaaatttcaaggaaaagctgggtttgaacatcgtatatatcggatacggcagagctccgatgatcagcgatgtgaaatgcaatccgacaattgaccagcgtaccggatatacgtcactcttggtttttgagaagatatttcctcgaattgcagtaatcgaacaaatgttcaacgatatgaccgctgcgacaatccacagcaatgccggcagaatatcaaacatgtattgctcccctgttgtatgtctgtctgtacatatctatctcatatcaacgactcgtacatccgtcttagtccgcatcaaccatacggcatgcattctggtatgttacagtgacgcggcggcgcgtgtctgatgttgcgcctcgaagttctttctcatgcgcattgcagtgatatcgtcaacaggtcggtttccacccatcatggaaggcatggtggtcagatcgacgtattcctcgtgggcaagagtctctctgatctgcttccataaagatcccaccgatacgccgaataccgcccgaccgctttgcaacaacgccaccatttgctcactatccgtacattcgtgcacttgctgaccgtcgcacataatcgtgatattctcaagttgttccgcggtacgctgcgtcagaaaactgatggcagtcgtcacattttgcagattgatgcccgcgtcaagcagtcttttcgacacagcaaggatcaccacgtccttgaacgagtacagcctgcgcgaaccggatccatgcgacggcgtgatggaaggttccacgatttgtctgcgagcccaatagtcaagttgacgataagtgatgcctgctacttttgaagccaccgtacccttgtagccgcgcgtcaccggctgagtgccggtcgcggggaataactccccctgcaccgcagtcgacacatgcagacgcaaccgcgttgttggctctgcttcgttcatcacgctctcctacgacatctacaataacgcccatgagcattcgtgcgaagctcatgggcgcgaagctgttgtacacagtctatcccgcataacgtggatcaaccggcaatgacggctttattgtcgaaataaaccagacggaacttgccaagaataatctcatcgccattcttgagctcctgctgatcaacacgctggcggttcacataggtgccgttcaagctgcccgcatcaataacggaatacctgccgtcagacctgcggaacaccgcatgggcgcgggaaaccgtggaatcatccaaaagaatgtccgctcttggatcacggccgacggtaatctcatcctcgtcaagaagataccgcgaccccgacaccgctcccctagtcgagatcagcaatgccgtgccatcggcaagacgcatgatggtttcaaggtcctctttcgtcagaggacggtctccggtggaagtcaccggtacggttattgcaggaaggccaatgatggtcgtttcacctgcgcttggaatcggatcagtcatagtcgccattctagtcattacccttgcaaatagccggtattgagaccggcatggtcacgaatcatacaccgtaaagtgggtcttatccctcagtcttgtcgataattgacacgaactggtcgtttggcaacatgtcatcatagctgcgccaacggcgttccagctcacgattcgcctcgtcatgctgctgtttgccgagcctggcataagccttcaactcgttcggccccatgtctttgaccggctgattgagattcaatgcttcgtcactcacaagctgccattgtagccgtacaccttgaaagaacacggaaaaagcccggatagtgtgtattccggacttaaaactgtattcgaagttatattcgcggggattgatttcagcgctgctcgtcgatcatttcccgcaatgccttgttgcagacggctcttcttgaattaggagcatcgccggagtgaatggcctcggccaccgcgtcgctctgctgcgtcatcttatagtcttctccctgcgtggactcgatctgggatttatccgcacccatgtatttcactgcataggagttggttgcagctccaatcaagttgcccgcgacaggcggacccgcggttccgcagcgcgcccagatttccctgtgagacaactcatgccttacaacagcatcaaaataggccgtacaagatcctcatccttcaggaactggttctcataattctggaattcgtcgatgcctgcctgaacgagatcatcaggttcatcggtgctggaagacatttgataccatccaatatcaaccgattctttgtagtcagtcaaaatcaccatatactggtgaacataatcaccgccctcctctgttgcaggaacgttggccttgtcgaaaatcgttccatcatggatggtatccgaaccatttgtcgtaggtggtcagaacgagattctcgtactcctgatacaacggacgatcctgcacgtaatagatttcgcctgtggccggcagtcccagcttacctctgagatcctgctcgactttttgattgatgttgcgctgcctggaagtataggcgccatgaatcgctatggcgcccaaacccaacaccacgcaccacccgtttccgacatgccgcacgaaacggcggaaacccaacgaaaccaacaaaaaaaggcggcacgacgtgccgcccgatggtgggtgatataggaatcgaacctatgaccccttccgtgtgaaggaagtgcgctagccgctgcgccaatcacccgatgatgggttatataggaactcacgttccagtgggcgatacaagattcgaacttgtgaccccttccgtgtcagggaagtgcgctacctctgcgccaaccgcccgggtcatgcgtcgcactcgcacatgtcaagcacaacaagaggtgggtacgagagtcgaactcgtctatacggctttgcaggccgctgcctaaccgcttggctaacccaccctaaaggtcgataatcaatcggaaccttagagcggacaacgggactcgaacccgcggtctcaaccttggcaaggttgcgctttaccaactaagctatgtccgcatgttctccgcagtactactgcctgagcacgagtatctactatatccgcattctcaaaatttgcaagtccgcgtgtcgtgttcgtgttttgctgttttcaaagggcttttatctaccgaaaaaaggttttgagctttcttgacattcgggtattttgagatgctgttgtctagatcgggatgccctgctcgtcacattcaccgatggcggaagcgtgtttgcggaaatatgatttcgttatacatttaaagcatgtgtgaggagacgaaaaaacgcgagacaataatgatctccgcgtttgaggggtggaatgacgcctgccaggctgcgacgaacgtcatacggcatcttgtgtcgcgatatgattcacaggaggtgcatcatatcgacaatgagggtttctacgactatcaggtagcccgtccgatgatttgctcggtacaaggtcgtaaacgaatcatctggccacagaccacgttctatgacattgcagtctccccctcgctgcattttctcgctcagatcgcccccgagccaaattatcgttgggaggaatactgcaggcagacgttgcgcatcgcagaagactacgatgtgagcggtatcgtcacgcttggatccatgttcgacgattgcccccacaccaggcctttgccgcttgacatttccaaaaatgactgcgaaagcgaacccgacaaggaatataacggccctgtgggcatccccaacattcttgacgcatttgcggcggacgcaggatttcataccacatccatgtgggtgtccgtaccccattactgtgcgaataccgagtgcttgcagggcacgctggaattggttcgcgcattgtctcttttacttgagcatccgctgactgaaggtgatttgaacagaaaagccgccgaatggcgcaaggctgccgacgagattgtcgagcagacgcatgccggcgattatcttgcctgtctggaacgcgactacgatttgaacgctcaagcgcaacgtatcgcgtcgaatggcatgcccgcttgcgaagagctgattcgtgaggctgaatcgttcttgcgtggcaattaagttgtgattggcgataagcagtgaatatataagtcgggccgaccatcgcaggatgatcggcccgacttttttgttattcgattatcgaattagattcacgctgcagctgcggcttccagcggcgaaagcacgccggtaatcagcagcaatgccacgacgatcgccaagccgatgcggtagatggcgaatgccttgtacgagaaggtggaaacaaacttcaggaagccgatgatcaccacgtagccgaccacaaatgccacgatggctgcggcaatggtaggaccccagccggggaacataccggcatcccccgcggcaacgtccttgacggccgatacggcttccagaatgcctgcgccgaacacggcaggaatggccatgaggaagctcactcgaacggctgcctcacgggtgtatcccatggcgcgtccaaaggtgatggtgcccccagaacgggaaacgccgggaatcaatgcgagcatctggccgatgccgaagatcagcgcatccttccaggtcatttccttcatggtcttgacctgcttggaacgggcgtcgaccacccacagcagcacgccgaacaatgcaagtacggtgacggtgatccacagattacgcagtgacccttcgatcgcatgcttgaacagcaggccggcaatcagaatcggcatcgtgccgaggatgatgaaccagcccatctgcgtgtctggattgtgcgctcccatacggcttttgaaatccttgccttctttgccgaacagggagccgaaccatgctccaagaatgcggatgatgtcatgtcggaaatacaaaatcacggcaagctcggtgccgatctggatgattgcggtgaacgcggcgcccggatcggatcccagcatcaaatcgccgataatgcgaatatgcgcgctggaagaaactggcaggtactcggtcaatgcctgcaccagaccaaggaaaatcgcttggaagaaattcatgaaccctcttttatatgtatcaatggtttcgtctgcttttccgcatccaagactagcgagaggggtctaatttttcgctatggatccttgagttgtctcaaaccatgcacacaatggtgccaaaacccatcggagcttcactaacgattccataaggtctcgcaaatgtggcggatcatgcaaggaaaggtcgggcagcatgagcaaatatcgcaagagcagggcattcagtcctgaaggtttcttcgaatgcgagggccgtggcctgcagtggcttggcgaagcgcaatccaaaggcgggccacgtgtggtagacgtgtacgactggggcaaggattatctcaacattgaacgagtgaacgcctgtggtccgactttgcaggccgcgcatgatttcggcgctgctctcgcacgtatgcatgatgccggagccgattactttggatctgccccagccggatatacgggaacttgttatttcggccccttgcaggatcccgttcccatggacgcaggcgaatgggatgatgtggcgacatatttggccgaaggcaggctccgtccgatggtacagcttggtatgaagcgccgtgaactcactgattacgatatggaactgactgaggccgtcattgaagcgttgcctgaaatactgggcaaggcggccaatgacaagccagcacgagtgcacggcgatctgtggagcggcaatgtcatgtggtcggccgattccggatccgtggaagcggtgctgatcgacccagccgcgcacggcgggcatcgtgaagaggatctcgccatgcttgacctattcggcatgtcgtacttgcgggacattctcgacggataccagtccgtacatccgctgaaagcaggatggcaggagcgcaccacattgtggcagctctaccccatcgcaggccactgcgtgttcttcggcggtggctatgtgaaccagtatcgcgctatgtgccggtcattgctcaaataaacacgtagatatgcctaatgattggctgttgtaggcgtgaggcaatccgcttgctacagcagaaacattgacaaaatagccggttgcttcgtttttgaagcaaccggctatttgatatgcgatctaacgttttctcatcggatgtacgacatgaggatagggaaattcagcgcagtgcatccttcagcttggagaagaagcccttcttcgttccggaagtcgggcgtgcgcttaccgcaacatgttgggcatctgtgtcatgcttttcggcaaaccgttccatcaaggcacgctcgtcgtcagtgagctttgtcggaatcttcactgcgatatgcgccaccagatcgccacgctcgctcttgttgttaagatgcgtgacgcccagattcttcaaggtcacagtgtcgtcaggctggcttcctgcaggcactctcacagactgcttgccatcgaacgtgtcgatttccagatcatgccccagtacggcccagctcatcggcacttggatccagcagtgcaaatcatcaccgtcacgagtgaaggtgtcatcctgagcgatgcggatgtcgacatacaggtcgccggcaacaccgccgttttcacccacctcgccctgattagcgagacgcagacgggtattgttcgtcacgccggcaggcacggacacgccgacattacgggtgatacgcacacgaccatgaccaaggcaggacggacacggattttcgataacggtaccatgtccctcgcaacgctcgcatggagcggtggtcatcatctggccaagcatggtgcgcaccacgcgctgtgcgtagccctgaccatggcagtcggggcactgtgccggctgggtacctttctggcagccggtgccggcgcattcctggcacagaccgaacgttttgatttcaacatgtgcggtgtcgccgaacaccgcagtcttcaagtcgatggtcactgtggccagtgcatcgcgtcccggctgtgtacgaggggtcggaccgccgttgccaccgccgaaagcacctccggtgaacatgttgaaaatgtcacccatgtcgccgaatccgccgctgaatccgccatgcatgccgccggcgttcggatcgttcgggtccacgccggcgtcgaacatctgacgcttctgtggatcggacaacacttcgtaggcgttattgacttccttgaatttgtcttcgaattccggacctgcgatatcgggatgatatttgcggctcatctttcgataagcttttttgatctcgtcgtcgcttgcggagcggtctacgcccagcacttcgtaatagtccgtcacggttgttctttctccctattgcttttcgcgtgtcattgtgccataaggcggggtcagttgttgttttggttttcgtcgtgagccacgaatgcggtcagatatctggcaacggcacgcactgctgccatggtcgccgcatagtccatatgcgtcggtcctatggatccgacgaaggcgatgggctcggtggaatcctgcgctgcagtggtgtgattgcttgtctctctcccctgctcctccgcagtctcgccttttgttacgtcgtcagcggttgccgaggttcgaccgtacccgctggtcaccacggatgcatgcagcagaccgggcgtgtgcgtttcggagccgatggccactccgactccatcggattgcgtggtttcgctcaacgtgctcatgagtttcatgagcacgacttgctcttccagcgcatcgaacaatggtgcaagatcggccacggcacgctggtgcgcgagtcgtgaggttcctgccatatagagttcgctcgcgcgctcgtcgtcggccatgccatcgaaagcttgagcaagcgtttccgccagtttactgatggggcggtattccttgcgggatgacatctgcctgacacagtccgcggttcgcgtcaaagaaacgctggcacactgcgcgttgatttcgttgaccagatgcgacagcactgtggtgtccggcaactcggaaacgttgagtatatgttgcgccactcggccggtgtcagtgatgacgacggccaacagggtgttgattgatacgggaacgatttcgatatgccgtaatgtcgatttcgccaacgacggggccgccacaaccgcgacctgaccggtgatctgtgccagaaggcgggctgcgcgctgcaaggtgtcctgcagattgacggatcccgacagaaaactgttgatgccacggcgttgcgcttcagacatcggcaccactgtggccaagcggtccacgaagtatcggtaccctttttccgttggtatgcgccctgccgacgtatggggttgaataagatatccctcatcttccaaggcggccatatcattacggacggtggccgagctgacgcccagatcatgatctttggtcaaggtggtcgaaccgactggctcctgcgagcgaatatagtcctcgacgacggcacgcagcaccaacatacgtcttgactgcgtcatgcgtgcctcctctttatgtatacgcgatacgattcagcgggagccggttttcggaatatctgcgatattaggagaaaccgtcttccgtaaatacttctcccattgtattagcactcgcaaggcgcgagtgctaatacgttcgcttccagagtactcgtttctcgtttttcccgatagcaatctcccgaaatgctcgtcataccaccaatcgaacagagcaatcgcacgagaatgttaactgtgagcgttaacagaacacaaactaccaaaacacgccaaaaatccaccacaacgtcacctcacatcgctactatggaaaacgcaatgtgagggcgtcgagcgctcggcacaagccggatacgcggcccgaccaattggaaggaaagtaatccatgaccgaattcaaggagaccgagctggacgagcgcgccatcaagatggccaaggtcctgtcggccgacgcggttgagcgtgcgggacacggccacccgggttcccccgtctccctggcgcctatcgcctacactctgtaccagcatttcatcaagcatgatccgaacgatcccaattgggaaggtcgcgaccgcttcatcctttctggcggtcatgcttccctcacccagtacgtccagctgtacttctccggctacggcctgactctggatgacctgaagaacttccgcggcggtgctgacacccgtaccccgggtcacccggaatatggtctgaccccgggcatcgaaatgaccactggtccgctgggccagggcttcgcttccgccattggtttcgcctatggccagcgtttccagcgtggtctgcttgatccggaagctccggcaggcgaatccccgttcgaccacaacatctgggtcatctgcggcgaaggcgatatcgaagaaggtatctctggcgaagctgcctccctcgctgccaaccagcagctgggcaacctgaccgtcatcttcgatgccaaccgcatccagatcgaaggcgacaccaatctggttctggctgaggacgtgctcaagcgcttccaggcctacggctggtacaccgacgagttcagcttcatccagcctgacggctcctacaaggaggacgtcgagggtctggccgacaccatcgccaaggctcgcgaggccgctccgaaccagccgaagctcatcaaggtcgataccctgatcgcatggccgaccccgggcaagaccaatgatccgtcctctcacggctccaagctgggcgccgaagccgtcgcaggcctcaaggaactgcttggctacgatccggaagagtccttccatgtcgacgaagaggctctggctcacgcacgcaaggttgccgagcgcggcctcgaagcccacaaggaatgggacgagaagtacaacgcatggcgcaaggccaacccggacaacgctgccctgtatgaccgcctcaaggccggcgaactgccggagggcttcgacgaggccatcgatgacctcgaggctaccttcgaagtcggcaagggcgttgcaacccgtggcgcttccggttccgtgctgaacgccatcgccgctgtcatgccggaactctggggcggctccgccgacctcggtggctccaacaagaccgatcttaagggcgctgccaccttcgctcctgccgagtgcgccaccaagcagtggccggtctgcagcccgtacggccgtcagctgcacttcggcgtgcgcgagttcaccatgggtaccatcaccaacggcatcctgctgggctcccatacccgtccgttcggtggcaccttcttcatgttctccgactacgagcgttccgctgtgcgtctggccgctctcatgcagattccgaacctgtatgtgtggtcccacgactccgtcgccgtcggcgaagatggtccgacccaccagccggtggagcacctggcttccttccgtgccatcccgcagcttgaggtcgtccgcccggccgacgcttacgagaccgccgaagcctaccgttacttcttcgagaagaagaacactctgcctgcagccatggtgctgacccgccagggcgttccggttcttgccgaaaccgctgagaaggccaaggacggcgtcaagaagggcgcttacgtgcttgtcgacaccgagggcacccctgacgtcattatcatggccaccggttccgaagtgcagtgggccgtctccgcagccaagaccctggctggtgaaggcattaaggctcgcgttgtgtccgccccgtccctcgaatggttcgaggagcaggacgccgagtacaaggaagctgtgcttccggcctccgtcaaggctcgtgtctccgtcgaggctggcgttgccatgccgtggtacaagtacctcggctcctacggcaagccggtttccatcgagcagttcggcctgcagggcgacggtgctcagaacatgatcgacctgggcatcaccgccgagcatgttgtcgaagccgccaaggcctccattgcggaagtcgaagccgccaagtgattcgacggggaggggcatgatgcatgtgcctctccccttttaccgcacaataaataaagatttgatccaaaaaggtatcaaggagaaaaacaatgactgaagcaactcagcgcacctctgactccggtgtctcgatctggctggacgatctgtcccgcacccgtatcgaatccggcaacctgcaggagctcatcaaggacaagaacgtcgttggcgtcaccaccaacccgtccatcttccagaaggctctgagccaggtcggcccgtacgatgcacagctcaaggagctcggcaaggttgacgttgagaccgctatccgcgagctcaccaccaccgacgtgcgcaacgccaccgacatcttccgtgagatcgccgaagccaccgatttcgtcgatggccgcgtctccatcgaagttgatccgcgtctggcccacgagaccgaagccaccgagcagcaggctgtcgagctctgggagaaggtcaaccgtccgaacgccatgatcaagatcccggcaaccctcgaaggcctgccggcaatcactgcaaccctggccaagggcatctccgtcaacgtcaccctgatcttctcgctcgagcgttacgagcaggtcatcgatgccttcatcgaaggcatcgctcaggctgacgccaacggccatgacctgaagcacatcggttccgtcgcttccttcttcgtgtcccgcgtggacaccgccgtcgacaacaagcttgaggagatcggctccgatgaggccaaggctctcgagggcaaggccgctatcgccaacgctcgcctcgcttacgagctgttcgagaacaagttcgccaacgatccgcgttgggctgctctcgaagccaagggcgccaagaagcagcgtccgctgtgggcctccaccggcactaagaacccggcctattccgattgcgtctacgttgacgagctcgttgccccgctcatcgtgaacaccatgccggagaagaccctgaacgctctcgccgatcacggcaacggcgctccgaccatcaagggtacctacgaagagtcccacgccatcatggccaagctcgctgagctgggcatcgacttcaaggctgtcaccgacaagctggaagccgacggcgtcgcttccttcatcaagtcctgggattccgtccttactgacgtccaggctggcatcgaccgcgtcaacggctgagcttcttgcttaagtgttagcgatctaagctaaggatcccccctgccagaattctggcagggggtttctgctattgctctacatgttttcagcttattccggtacgaggcgtaaaaccagtggcctggcggatcgcttgaatcgcctgcgttttgcgcccttcaaaagttggattgtcaagcgtcaccacacggtcggcatacggtgactcctgaatgacgcgtaccaaagtctcatggaaccgataccgatccgaagcccaccgcattgcacggaacccaccatccacatattcggtgatcggaggaatcagcaacaccagatcaggcttctcctgttcaatcaccatatcgaatgtcggcttgcagcttggcgttctcatcggccggcagatagtgttccgcatagacacgcgtaaccatggcatcagtatcaagaaaaaacgatgccatgattggcatgcgatgctattgcatgctcgttctgagagaacttggaaagaatcagccgctcgtaatcgaaagcggtaagttcatcatcgtcaacattgcaggcttcctcaaattcacgggcatactcgaccgcgatcggagcgtcatacaatttcgacaagcgtgtcaccaatgtggttttgccgacggaagccggcccaacaaccaatatgatcgttgtgaactcgcgacggaacgattgattgatcagcggccaccatttgcgattatgctttccgtgcaaatacttgattgcagatcatccgatacggccatagtgctgctcttgtggaaccagacccatgcgccgtaaaaaccgttggccaacatgaccacctgaagaacgaacatcgacatggcgccaggacctccggcggaaagctggttgaaccagataaccaccttgatcacgtcaagaataatccatgcgacccactggctgcggtagccgtatgtcatgagaatctgtccgacgataccaagcggcagcagcgtgccgtcaagccgaacctgtacaccgccagtatggctcgacacgaataccacaatcagatagatcacgatggttgcgatgacggcgagaatgccttgccaccatgtgaacatgcgggcattgacttcctcatactcgttttttcctgacgatcaagctggcgctgccacacccatacgccgacgaactgcatggtgacgtagaagatctgagcgaagatgtctccgacgagatggttcatgatggcaacgatcagccaagtggcacaaccgatgaagccccacagatagttggtcagtcgcccacggtcgacgagaatgagattgaacacgatgcataggccggaaatcagaccaattcaacctgccgcggaaaatctttggacacgaagaatgacaccaactgcgccaacagcatgaccgcgatcaggacaaactcccccggcttgaagtcagtcagctcgcggaacacacgcttcggattgacgacgttgccgattcctttgagcaaatcgttcacaatatcccctttcacaatgaaacgatggctcggccctaaggccggagccatcgtagccctacttatggtcagtatgactataagtatttggggacggagtgtcgcgatgctgcgcgtacttcacaccatgaaagcccttcaagcaatcaaggtcatcatgcctgatgatatgtgctcaagaaatcaccgatctcacttacggtttcctttaacatcgtgatacgtggcagatataccaccctgaaatgatccggattctgccagttgaatgcaccgccatgactgatcagaatatgcttgtcatgcagcagatccaacgcaaactgctcgtcggagtgaatattgaacttcttgacgttcagcttcgggaagatatagaacgccgctttcggcttaactgcggtaacgccgggaatttcattgagcatctgatagaccagttcgcgctgctcgtacacacggccacctggcttgatgtaatccttgacgctctgatgcccgcccaaagcggtctgtaccaccgactgagctgggacattcgagcacatacgcatgttcgccagcatgttcaagccctcgatgtaatccttcgcaatacgcttgttgccggaaagtatcatccatccaatgcgatatccggcaatcatatgcgacttcgacagaccggagaacgttacacagaacaggtccggagccagcgatgcgatagaaatatgctccagtccatccatgaccaaacgatcgtaaatctcatcggagaaaataatgagctgatgttctcgggcaatgtcgacgatttgttgcagcagttcctttggataaagcgctccggtcggattatttggattgatgatgacaattgccttggtcttatccgtgattttagagcggatatcgtcgatatcgggataccattcggatccctcatcacagatgtaatgcacggcggtaccgccagctaaattcacgcaggcggtccacagaggatagtccggcgaaggcaccagcacctcgtcgccatcatccagcaacgcggatagcgacaggttgatgagctcgctgacgccattgccggtgaagatatcatcgatggagacgttcggaatattcttgagctgtgcatactgcatgatggctttgcgtgccgagaacagacccttggacggtgaatatccttcggtttcagggagctgttgcgccatatcatacacgacttcatccggagtccggaatccgaatggcgcaggattgccgatattgagtttcagaatatgcgttcccgcggcttccatgcgtgctgcctcgtccgccaccggaccacgaacgtcgtagagcacattgtcgagcttatgagatttcgtaaaggtgcgcatagtctttccttctgttgattgcgctgatgcaggattgctatcatgttgggcttcatcagacttgattgcgggcaaggtggcgacgttctgctccatgggaacgtcctttcccatcagccagtcctcattgacctgcagaaaagccgcaagaaaatgggcgatatcggcacgcggcacggttttgccgctcacgtactgactcatatgacttttgccaagtttgatattgaacttctcagcagcatgcacaaagtcaatttgtttgacattgcggaacgccatagcgacgttcaaccggttggagaacgattccgccatactagtcctttcagttcaattttcatcaagcgctagttcaaatcctaacacaaaccaactaacgaaattgcggaagttcaatatcaaatgtaactatttcgcatccttttgcgacaaaagttcaattcacgaagttcaactcatgtaactcttgaatatcacgagacatcacagcagattatcttcaatccactgcgccacaccgtcatcattattagatggacagatttcatctgcgatgttcaacacatccggattggcgttcgccaccgccactcccctgccggatttacgtagcatggcaatgtcgaccaaatcgtcaccgaatgagacggtattgctcatcggcgtctcaaaatgttctgccagcaaatccaacgcatgctccttgttggcttgaggattcattaacatccagagcgatccctcagagatatgtacgtcaaaatcgttgggcacaagagaaccgacctgattccgctgctcatcgttagggaagataatgagcttatcggcgatgccttcaggaacatcgtcgaagtcagtgtatcgccaggtctgtgttttccaatatttcgtaacatcgaaattggtgtatctcacatcatccatgacaatgccgacttccataccgggcagttcattcaacagattcttgcagacttcgcatgctcgctgtgaggagaatccgattttcttgagatggccgtcttccggcagcatcggcgaagtgagcatttcataatttgatgaggctggattgaaatcgatcaatgctccattgagataggcaacggcatcaaccggcagtttttccacgaacgaaaagcctgtgctgaccggacgtgccgtttccacaacgaaggtcacgccattatcgtgcatgcggttaatcacatcgatggaacgttgtgtaagaaaacgttcctcgaacgtttcgccatcatgcagcaaagtaccgtccaaatccgcgacgaccatcgtggtttcttgggttttctcgattttcaaagacgtcaaatcaatccttagctcgtatgttgtagacaatactacgataaaaaacacttcggcccatgactgtaatccagtcatgggccgaagcaaaaagccaatcagatgagatcgaacttcgtcatcagaccgagggcaatgatgatggcaacccacagcaccgcgatgatgacggtccaacgattcaggttcttttccgcgacaccggaagaacccgcattctgggtgagaccgccgccgaacatatcggacagaccgccgcccttacccttgtgcatcagaatcaacagggtgagcaagaggctgaaaataacaagaataatctgcagcacaagcttgacgatggccatagcggacacgagtgaacctccagttcgtaaacactgctgttaacaatagcgcaaggtattgagaaaatcgaataatgaccacaccttgaaaggccaactcgataaaaacattactccgcgagcatcatactgtcgcattcatggtgagctggcagattctggtgagctcatccacgttcagcgcggcaccgccgataaggaatccatccacatcgggctcgccaatcaattcttcggcgttctttgaggagacggagccaccatacagaatgcgcacggactctcctacatgcgtgccgaaagtttcagccaaatcatcccgaatcgccttggccgcgtcctgagcggattgtggagtggccaccattccggagccgatggcccatatcggctcatacgccacaatcagacgcgacgcttcctcgtcggaaagatcgcgtgtgacgtcatgcacctgccccacggcgaaatcaagctcaatgcctttgcgacgttcctcgtagctttcgccgacgcaaagaatcggctgcattccggccgccaaaacagcgcgtacctgatccacgatgttcgcatcatcttccggatggtactttcgtcgttcggaatgtccgacaatcacatacaaacagccgaggtgggcgatcatatcggcagacacatctccagtgaacgcgccctgcgatgttacggaaacagcctgtgcgccgtagtgaatcttcaaattgtcggattcgaccaacacctgcacgctgcgtaacgatgtgaaggacggcatcaatgcgatttcacaatggcggtagtcgaaatggatgtcacgaagtttccatgcgagctgctgaacgaaataggtggcttcaagatggtcgaagttcatcttccaattgccggcgaccagtggaattcgttgcgatgccatgtgtttgcctgcctccgttcttatttcattcagtgttcgtacgccgtggtttcgggttagtgaaaacaagaggtgctcccccaccttttttgttgataggggagcacctccggttatgcgttaagcaatcagtcgagcaccttcaggcccggcagttccttaccctcgaggaactcgagggaggcaccgccaccggtggagatgtgcgagaagccatcctccgggaagccgaggttacgcactgcggaagcggaatcaccgccgccgacgatggtgaacgcaccagctgcggtagcgtcgaccagaccctgggccacggcctcggtgccggcagcgaaagccggaacctcgaacacgcccatcgggccgttccaaacgacggtcttggaatccacgatcttgtcgtggaagagcttctgggaatccggaccgatgtccagacccatcttgtcagccggaatggcgtcggcagccacgacttccggagcgatgtcctcatcggacttcgggaagaccgggttcaccacgatatcggtcggcaacacgagttcgacgccgttctgctcagcgcgctcgatgtagcccttgacggtctcgacctgatcctcttccagcagggaggtgccgacctcgaggcccttggccttgaggaaggtgtaaaccatgccgccgccaatgaccagacggttggccttgtcgagcaggttttcgatcacaccgagcttgtcggagaccttggaaccgccgagcacgacggtcagcgggcgttccggctcaacggtagcgcgggacagagccttgacttccttctcgaccagcaggccggcagcagccggaagatcggcagcaacgtcgtaattggagccctgtgcgcggtgcacgacgccgaagccatcggatacgaacgcttcgccgagcgcagcaatcttcttggcataagcggcgcgctcctccggatccttgctggtttcttccgggttgtaacgcacgttctgcagcagaacgacatcgccgtcgcccattgcggcgaccttggcctgggcatcctcaccataggtgtcttcagccagcgggacctcgatgccgagcagctcgccgagacgagcagcgaccggggcaagggacagttccggaacgaccttgcccttcggacggccgaggtgagccatcagaatgaccttcgcgccttcttcgcgcagggccttaatggtcggcagagcggccttgatacgaccgtcatcggtgatcgtggtgccgtccagcggaacgttgaaatcggcgcgaacgagaacgcgcttgcccttgagatctccaagatccttgagtgtcttcatgtatatcctttcctagccgcttgtaagcgtggaatggccatattgccatttacgaataatacaagcccaaacgaacaaaaacaccatactgttcgaaaacaggcatggtgttttgcataaaagattcaatcaagccgactggcggcgcgccttttcggttttctcggcgagctgcagaagtcgacggatgcggcccgcgatggcatccttggtgattggtggatcggccaaacgtcccagctgttccagcgacgcatcagcatggtcgagacgaagctggccggccgatttgaggttgtctggaatgtcatctccaagaatctcaaacgcctgacgaaccttgtcgcatgcttccgcagccgccttggcgctgcgacgcatgttggcgtcgtcgaagttggccagacggttggctttgccccgagcttcgccgtcggaacgctttccggtccactcgcgtgcggagcgcggcgcacccataagaatgagcatacgttcgatggcgtcgggatcgcgcagggtgacgcgttcggagctgcgtagcttacgcggcttggcggtgatgcccagacgccgtgcggtggagaccagtgccagagcggcctcatggttcgggcacacgatttcaagatagctggccttgcctggatcggacagacgtccgttggcgaggaacgcgccgcgccatgcggacttgatctgcgcgattttgccgttgatgatatcgcttggaagaccaagcaccatgttcttggtgtaacggctgtacaggccggtctgcagcacgagcgccgtactgcccttcggcacgcgaatcacataacgctgcacggtgccggttggcgtctgcctagagacaggagtaagcgtggcttcatgaccatacaggttcttgatggtgtcctgcagccaagcagccgcatcttgggagtcgagctgcacctgcacgagaatgtggtgatccaccgagtgcaaaccattgccgaatcgaatcatcgctgtcgcctgcgcctttttggcgatcggcagttcgttatcgattgcggccagctcgcttttgacgtcatccagaagagccaagagccaacctcctaccttgctgttcttccctaaattgcaggcgagtcgcggaatcattccgcactgccacggcttactgtgataccgaatatcttggacaatcacagccaggtttctttacatatggacactattctctcataatacggtcatttttccgctgaccgcttatcaagctcgcgtgcggaaacggaaaccgacaaccccctcgcacgcagtcgcttagccaaagcctcactcatcgcgacagaacgatgctggcctccggtgcaaccaatcgcaatagtcacataatgcttatcttcctgcgcatatccttcaatcgcaatcgaaagcgccttttcatacgagtcgaggaagtccgcggccccttcgctggaaagtacgtaatcactcacctctttgtcgcgtccggtcagcgagcgaagcctgggaacccaaaatggattcggcaggaatctcacgtcggccacaaagtcggcgtcgatgggaataccgtatttgaaaccgaaactgaagatgtgcacggaaaccgtggtcggaccggatccgagcatggcctcatataatttcgtggacagctgatggatactcaatgatgacgtgtcgataacgatgtccgcacgttctttgagattctcaagcagatctcgttcctcgagaatgccgtcaatcagtcgattgccctgctgcaacggatgaggcctgcgtacggattcatatcgtttgatcagcacctcgttgctggcatcaaggaacaggatacgcgttttcacaccaagatcatccagatggctgagcaccgcggacaggtcatcgaaatagtcgcgggaacgcacgtcgacaacagcggcgagtttgtgaatattggatcccgtggtcatcatgtccaccaagggcaccagcagttttggaggcatgttgtcaaccacataccaacccatgtcttcaatgctgtcggcagcatgcgaacggcccgcaccgctcatgccggtgatcagcaatacttcaaaaccttcagccggcgaaggggcgctggcatgcgtgccattcgcctgtacgtcgatgtctttctgtgccatcacagagcctcctcaagcgcgatgcgcatggcttgttccaaacgcgcggtgcaatcctgatcaaccataccgctcggcggatcgtcatcccagattcccgtcatcaaccagacctgcaccatggcctgatacaacagcatctgctcgccgccaatggcgattcctccctgttggcgccatgcctgcatcagcttggtagggcgtgggtcatatacgacgtcgagcaatgttccatgcatgcgcacacctggcattctcaatgattcggcaataccgtccgcagccaatccgggaatggtgtttatcgccacatcagcctggcgcaacgcttcgatggcgtggtccatgccgacaatgctgatcggctgttccgatggcatataccgttcggcaagtggcttgagatcggcgttcttctcaggatggcgagccacaacgatgacatgtccgatcgcagacatctccacgcatgccgctaacgccgacgttgcggtgttgccgttgccgatgatcacggccgttcccgaacggtccgtcttcggcgttatcgcacgtgtctgatacgagtgttcgaaagcgagttcgatgccgcgtacgtccgtgttatatagcctgatgaaggggatgttcgaattgccattgacgcaggttttggtccaatcaaacaccgcggtattggcaaccataagctctttggcccatgtattgcacggtgttccgtatggctggatcgttttcttcaatggcatggtcaggctgagtcccgaccaggtcggatcaagcgattcaagaaagccctcaagatcaggctcgcccacctcatgcttgtcgtacgaccagtcgtcaagatgcaacgcgtgataagcggcattgtgcagcaccggagacaatgaatgtgcgatgggcttgcccagaaccgcgcaccggtggttgacctcggtcatattccctccctatatattcaccgtcatcatgctagcaatccgattgtcttttttcgctacccaatcttattccatttcatctttcggactattcgacgaaatggcattttccgtcgacggttgcccgtcgtgggcgtgcaacgcttggtaaatggctgcggctttggcttttccgacgcctttgacctgctcgaaatcctcgacatccgcctcacgcatggcacgaaccgagccgaaatggctcagtaggcgcttctggtatgcctcgccgacgcctggaatatcgtccaagacggaacgcaacgcgcctttccttctggtctgacgatgataggtgatggcaaaacgatgcgattcgtcgcggacgcgttgcagtagatacatgccttcggattgacgtttgagaatgatcggatagtcgtcatccggcacccacacctcttccaaacgttttgccaatccgcacacggccacgtcatccacaccgcaatcctcaagcgccttcgcggccgccatgacctgcggtttgccgccatcgaccaccaccagattaggcttgtatgcgaaatgatgccgattggtgttctgctggacagtcggttcatgagtctggtcaccatgctcggatgcccgacgttcattatccatgctttcgccggagtcaccggcgatattgccatgttggaatcgtcgcgtcagcgtctcgtacaatgcgctcaaatcgtcgagtgcaccctgtccgtccgctccgcgaatggcgaaacgacgatattcggactttttggcaatcgcgtcctcgaataccaccatggaagcgacctggaacgctccgccgacggtattggaaatgtcgtagcattcgatgcgcaatggagcctgttcaagtcccaaagccttggcaacatcattcatggctgtgctgcgggcgcccatatcgctgatgcgactcatcttgctgcgctgcattgcctgcttggcattatcgttggcacggtccagaagccgtctcttatcccctctgctggccacgcgaatgctcacggcaccaccgcgcaatccgctaagccatgattcaagctcttcacgccgggccggctcgatgggaacaatcacctcgcgcggcaccggagagataggagccaacaaatccgcacgaccggtctgatcctgccgctcgttacgttccctggtagcttgcgcgcgtgccaccgcatcggtcgccgtcacgatttgcgtcgatccgatggcattgcgttgttcggtgacaacagtcgactgcgaagccctaatcgtctcccctgcggtttccgaatacacctgcacaataaggtcggcaatcagctcctcatccgtcacatcctcaacccgttccacactccaattgcgttcacctcggatggaaccggcacgcacgtaaaacgcgtgcacggaagcttccagctcgtccgaatcgacgccgaagaaatccgcatcgacatcggaatcgaacaccacggcattctgctcaaccactgtggatagcatctggatctgatcgcgcaaccgagccgctttctcgaactccaactcgtcgctggcctccttcatttcacgcgtgagctgtgcgatatacgatttgccgatgcgaccggttaatacgccaataagctgttcgcacatcttccggtgttcctcgacgctgatacgtccaatgcaaggggccgaacatttgccgatggacgcaagcaaacatggacgatgagtgatttccgccttatgataaacgttctgcgaacaggtgcgcacaggaaaagtcttgaggagacggtcgagactgtgacgcagatcccatactttggcgtacgggccgaaatatcttgtatcgcggcgtttgcggcttctggtcacccacacccgcggcacgcgttcaccggatgagatcgccagatacggataggttttgtcgtcgcggaacacaacgttgaatcgtgggtcaaactctttgatccacgtgtattccaacgtcaatgactcaagttcggtaccaacgaccgtccattccaggttgcgggccgtcaataccatggtttgagtgcggggatgcagctgatacaacggttggaaataattggtcaaacggttgcgcaggtttttcgccttgcctacgtaaatgaccctgccttcaccatctcgccacttgtatacgcccggctgcgccggaatgtcggatgttttcggacgaaacaggtcacgtgaatcccccagcagaggcgcgccgttcgtgtttacgtctttgccgggagaatcatcaccaccgacactgaaaccgtcgccgttcaactgttcggcggttttgcgccaaacctcctggctgtgccgctcgatgggtgcgctcacagcatgcccttaaggaacttgccggtccaagactgttcgcattgagccacctgttccggcgtaccttcggtaacgatggtgccgcctccgtcaccgccttccggcccaaggtcgatgatccaatcggccgacttgaccacatcgagattgtgttcaatgacaataacggtattgcccttatccaccaatccctgcaagacaagcagcagtttgcgcacatcttcaaaatgcaaacccgtggtaggttcgtcaagaatatacacggttttgcccgtagaccttcgctgcaactcggtcgcaagcttcacacgctgcgattcgccgccggaaagcgttggagcaggctgtccgagtcggatatacccaagtccgacctgcacaagcgtgtcgagatagcgggagatggagggatacgctttgaagaactgggcagcctcttcgatcggcatgccaagcacgtcggcaacggatttgccattgtatttcacctccaacgtttcgcggttgtagcgtttgccatggcattcctcacagtccacatacacgtccggcaggaagttcatttcgatcttcaaagtgccgtcgccatggcatgcttcgcaccggccacccttgacattgaacgagaaccgccccggaccgtatccacggacttgcgcttcaggggttttggcgaacagcgtgcggatcttatcccatactccggtataggtggccggattggaacgcggagtgcgtccgatcggattctggtcaacgtggatcactttgtcgcactggcccacaccttccacacgggtatgcttgccgggcacgatgcgcgcaccgttgagtttgtcggcaagcaccgggtacagaatctgattgaccaaagtggatttaccggaacccgaaacacccgtcacgcaagtgaaaactcccagtgggaagttgaccgtcaaatccttcagattgttttcgcgggctccaaccacgcgcaactgcttggtcttacgtactttgcgacgggactgcgggacctcgatctttcggcggccggcaatgtagtcgcccgtaaccgaacgcggagcgtcaacgagctttttcgcgggaccggaatagatcacttcgccgccatgctcgccagctccaggtccgatgtcaataacccaatcagcgttcttgatagtgtcttcgtcatgctccacaacgatcagcgtgttgccaagatcgcgcagatgatgcagagtggtgatcagccgctcattgtcacgctggtgcaagccgatggatggttcgtcgagcacatacatcacgcccaccaaaccggaaccgatctgggtcgccaaacgaatacgttgcgcctcgccgccagacaaggttttggcggcacgagacagtgtcagatagttcagtccgacgtcgttgaggaatccaagacgggcacgaatctccttcaacacctcgccggcgatctgcgcggccgacccttcaagctgcaagctatccatccatgcgaggcttgtctcagcggacatgtcgcacacatcggcaatggattccccgccaacggtcaccgccagcacttccggacgaagcctacggccttggcatgcctgacaaggtacttcacgcatatacgattcataatactgcttcatctgatcggagtcggtctcgtcatgcctacgcatcagcgtacgcaccacgccttcgaaaccggtggaatattcgcgcatacgaccccaacggttacgatacgagacctgcaccttgaaatcacgcccatacataatggcttgacgggcctcttccggaagatccttccaaggggtgtcgagatcgaaacccatctcatcgccgagcccctcaagcacatggcgataatattcgccggtgcctttggtcatgccccacggttcgatggcgttctcattcagtgtcttgctgggatcgggaatcaccagttccggatcaatctccagcttgtatccaatgcccgtgcataccgggcaggcaccgtacggggcgttgaacgagaacgtgcgcggctcaatctcatcaagttcaagctgatgcccgttcgggcatgcgcgtttttcggaaaaaggcttacggcggtcaggatccttctcatccaaatccacaaaatcggccaccacgatacccttggcgagcttcaatgcggtttcaatggaatcggtcagacgctgacggatgccgtccttgaccaccagtcgatccaccaccacttcgatggtgtgctttttctgcttggtgagtttgatgtcgtcggacagctgcttcatttcgccgtcaatcagcgctcgtgcgtagccgtcgccccgcaagagttcaagcagatcctcgaactcgcccttacgcccacggacgaccggcgcgagaatctggaatcgtgtgcgctccggatactgcagcaacgcgtccaccatctgttgcggcgtctgtgcgctgaccaacgcgccgcattccgggcaatgcggaatgccagtgcgggcaaacagcaatctcagataatcgtaaatctcggtaatcgtgccgacagtcgaacgtggattgcggttcgtggtcttctgatcgatcgacaccgcagggctcaaaccttcgatgaaatcgacgtcgggcttgtccatttgccccaggaactgccttgcgtacgccgacagcgactccacatatctgcgttggccttcggcgaataacgtatcgaaggcgagcgaggatttgccagaacccgacagtccggtgaacaccaccatgcgattgcgcggaaactcaagatccacgttcttcagattatgctcgcgagcgccttggatggtgattttgaggtcgttgggcaggtgcttgaggtcggctgtaagtgaaccgtttttcgttttgagaggggcttttttgatttctcttgcgaggaatgcgtcgctggtgagaacgcgttcgactatgacgtcgccgtttgctgcgttgttgcgtttggttgccacggcttgcctccgctggtggttgttctttgttctagttgtttaggatacctcattttcgttatgatttcgaacaggtgttctatttgtggtgtgttgtgttccattggtgttggttgtggagtattgtcattgcgtcgttgatggggatgcgttcttgttcgattcgtaggtaggttgtgtttttcccggtgcagagttgttcgtataagtttctttcgtgttgtgtgagtcctggtgttggtttggggtcgcgtgttttgaggggttgttttttggtgtcgagtttggtgccgtatggttcgtatgttttgtatgctgtgctgtccatgagtatggagtcgcaggtgatgccggtttgtcgtagttcggagagtatttcgaggccgtctgcgtctatgtctccccagtagatgatgtggggtgtggttgtgatccaaggtagtagtgttttgattcgggtcgccgcgtgtccgctgccgaatatgcagatggcgtgttctgttgtgggtatggcttggtaggtgtctttgttttccacgatgatgatgtgggtgatgtcgtgtggcgcgccgtctgtccatggttgtgtcacgatgaggtctggttggttgtggtgttgtgtgtcgaggagtcggagtcggatttctccgtggcggtcgttgagggctagttgttctcgtttgaggagtttgcagattgctttgcagcggtttgatgttgttttgcctagccattttgcgctgaatccggggatggggaccatgcgtggggtcatgttttcggtgttgtggttggcgaagtagtgtgcggcttgtatgacgaggttgaagtcggtgtcgtcgtggtttttgaggattttggcgatgtttatggaggtgttggagtcgaggttgaattggttggtgatggtgtgtgcgcgttggtgttcgcgttggtagagtttgcgtgtttgtggtgtggtgatgttgagggccgtgttgaggtcgggtatggttaccgagtcgatgagttggctggtttgtcggacgattccgttggagatgattttggttttttcgctggtttcgcagtggtgttgttgtgcccagttgcggatggcttcgtcttgggcgcggatgtgcgtgtaatgggcttcgagttcggcttgtttgggtagtcggatggttttgcgcaatggccaggaggtgttggcgtcatacatgtgcttggtgagatagtcggtgacgtatccgttgagttggctgtggatgtcgctgttggtggtgcttctggccgttgccatgggttatgcctccgttgttggtttcgcgggtgcggtggtgggctgtgtttcgtcctgtgtgatggtttcgctgtcgagttcctgtaggtatgagttgccggtggatgggtctttgtatgcgacgtatgctctgttggcgacgttgaggatttccgcggttttgctttccggggcggagacgatgatttggaagccgagtcggggtagtacggcgagcgcgcgtttggtgtagcggccgtcggctttgatgagtgcttcgtcgaggaagagcgtggtgtaggtggggcgtgcggtgaggtcgccgccgaggaggtagatgagggccgcgccgtagacgaatgaggtgagttcttggagggctccgccggattttccgccggtggagctgatgcgttcgtcgggggcgttgtcgtggtgcacgattgcgtagaatgagctgcgtacgcgtgggtcgaggttgcgtgcgccgtatgctttgatgccgttggtgtcgtgtattttgtcgagttcgttgtgcagtctgttcacgaatgtttcgcagttgttgaatgctttgcgtgtttccgtgggattgtcgcttgcgttgcgcgtccagtcttccagttttgacaggatgcggctgagggttgtttcgaattgtcggtcgattgggctgaaggtcacgtcgagtgatagtctgccgccttgtgggccgaattgttgtcctttgagcatgctgttgatgcggttgagttgttctttgatgttttcttcgtcggtgcgtagcgcgcggttgagctgttggaagctcatgtagagttttttgacgctgttggcgtattcttcgtcggttgcggcgcgggtgacgagcatgttgagttcgtcgagttcgtcgaggaagtatcggtagtcttccacgcttgccatgacggtgttgtcgtctgtggagtggtttttgaggtagtcgtccatgatgcgttccgtgtcggcgcgcagttggttggatctggcgtcgatttcttggattcgtgtgcgtgcgatgcgtgcgatgttgcgtagcgcgcgcgtgtggaatggtgtttcgctttcatggtcgaagaggcctgcgatgagttttggccggtcttgcgcgcgtacggatgcgccgaagcagttctcgtatgcgtcggcgagtaggttcgataccatgctggatagtgtggcgtcgtcgaagtcgtcgttgccgtaggcgtcgagccatgcttgttcggcttggacggcgtgttgggccttgtcgaggtcgtcttcggcttggtactggtttctgttttcggcggtggcctgttggttgagctgtttcagttcggtttgcagttggccgagttccgggtcgttttcgatgcgttcgatctgcctgcggattcgcgtttcctgttcccgtagtccgttcacgtcgattttgctccatggcatgtctgctacgattcgtgcgagctcgtgctcgtcttgcagcaggctgatggcgttggacatttgttcgcttcgacggtcggcgttctgcaacgcctgctccgccttgtcgagttggtttttcagttcggccaggtattgttcgttcatgaagccgatgacctggtgtagtcctttgctgccgtggaatccacggtcgccggatttgatttgtccgtcggcctgcacttgtcgttcgtcatggttcatgtcgtcgatggcgtgcacgcaacgcgcgtcgaaccgtggcgacgtcgtctggtttttcagccatccggcgaacggagagtcctcccggtattgcagtttcgacgacatccagccttcgctggcggaggattcgtattgcatgccggtgtcgatgaaccgccacgtgcgtcgtgtcataagtttcgggtcgatggcgctgattttcgccgcgaatccttgctcgtggcgtttgtcgacgaggatggtctgcgcgatgggcgcgtaggtgacgttcattgccagacgccactgttcgtcctgttcgttcacgtccatcagttcggccacatacggcagttcggacgcgtccaatccggtcgcccgcatgataagcgtgcgcgcgtcgtccatgtcatcgctgatgcgcgtcctgtgcgtgagtttgcgctgatagtcccgtcgtaggctgtcacggtcgcgctggcggtcgtgacgctcccctaccagctgctggaatctggcgttcgcgtccttcaaccgttcctcgtatgtgtcgagcgtttcggcgagcatggcgcgtttggcgtcccatgtctgctcgctgtcgggaagcctgccttcgacctgttcgaatcgttcggctatggcatgacgttgcctgctcgcctcgtcgatgtcctggcgcacgcgttgaagatccttgccgagctgctgcagactgccgccgtcgatgccttggatacgttccttgacggcgtcgattcgcgtgttgagctcgccgacgcgctgcatcgcccgatcgatggcctcctgcgactccttgaccttgcgctgcgcggccggcagaccagcgcgcacttcgctggccatgcgcgagcgcgcccatgcggacagtgttgcgttgccatgttcgctgtcggggttgatgggttcgtattcgcgtcgttcgctggtttgctttgcgtattcgccgtagcgtgtctggatgttttgcaggatggcgacgcgggccattttgtcttccatgctgtggaagttttcgttgaaccggttgtagtcgtcgacggtttcgtgggcgaggcggatggattcgggtatgtcgagcacgccttgcttgaagatgtcgtcgagttttgagggggcgtccgccgattgtattttgtgcaggaggcggcaggcgtcggcgcttaggcccatgtcctgccagatggaggcgtggaatgccgcggcgttggtgtgcgtggtgcattccggataggttttttcgaacatggaccgggtgaatggtgtgttgcggtactggtccatgagtcgtgggtcgatggttcggttccaggtgatgtagcggcggcgtagtccgtcttgtccgtctccggcgttcaggtagaggaatttgccgcaggagagcagtcctccgtcggttttgttcacgtaggtgtcgacgattgcgccccagatgttctgtggggtgccgtcggcgtctttgccgcgcaggaagatcggcgtttcgccgttttcgctatcgcttacgccgatcatgccacgcaggtaggtgtagtcgttgcgttccgaacgtccggagttcgacgccttgttgtagggggttccggatgggtagaggagtgagatttgcgcgtcgacgagtgtggatttgcctgattcgctggcgccggcgagcagggtcaccggcatggtttcgtccatggatgggcggaattcgtgccagccgccgtatgagccccagttgacgatttgtcggctttgtagcatccacttgtcggaaacgatcttcatgccgtctgccatcagtgttcctcctcgtcgaaacggttgtcgtcggtgttgaaatcgaatgcgtcttgttctatgtcttccatgggcctgtcgtccgggccggcgttggtgcggccgtcggcggatgcgttctcgtccgtggtttcggatccgagccactggtcggcgaggccgcggtcgagcaccatgggcaccagtggcgtgaggacgtacatgtcgtcgtcttcgatcggcgcgagatacccgtaggtgcgcatgcgtgagatgatggacgtgattttcttcgcagtgccttcctcgtcgttgctggcggtgaggaatcccgcgccggtggcgagcaatgcgcggatgtcgtcgaagctgataagccagtcgcatggttcggcgttctggttttcgtattccaacgctttgatgcgtagcgcggcaagcgtggcggcctcctcgcgggtgaggctcatacgtgttttcaacgaacggatgcatgtctccgagtcggtgaccggcgacgcgtacatgatgcggtatttcgtgttgtcgaccagtctgagcatgtcgttgttgagcgaacgttccacgacctcacggttctcgcaggcgaggtcatacaggctgccgtcgatgtagcgttcgcgtttgagcgcgatcgcggccatgcgcgcttcgacgggcatgtcgccggtgtcgccgttgaacagcgcggtcgaggcctgctggctgccggcctcttccaataccggctcccctcctgtcaggatcgtttcctcgatgttggcttcgatatagtccgtcatgcttatctctcctcgatgatgtcgtcgagcgtcgtttcggtggtgagaatgggtttggtgcgccatacgcgttcgctgccgtcgatcgatatgcagcgccatgtcacgtatgacgagtcgtcctgcgtgcgcagggcactgaggaagccgaccagttcgctttccctccgttcggctttcggcagctggttgaagcttgccgcgaggtccacgaacatgccgtccgatgtcgtcaccggattgctgcggataagcctgatcatgcgcgtcagccgtggcccgcatatttcgaccatgttcttgaggtccggcgcttcgatggtcgccgctggggcgtcgttcaggctggatgatgcggcgcgcgccattgatctggccggacgagatggcaatgtcgggaatttcgcctgcccggcgtccgtatggtagggccggctttggtcattgggatgggctttggcttcggcgctggtctttgcgaacagctggttgagtttggcgagcatggtccggtagctcgtgtcggtctgctggcgtacgagacggctgaccgcctcgtcggacgtgcggatctgccggcgcacgtcctcgatgccttcatagatgcgtttgagttcggaacgcacctggttgagcagcacgctcggctcgccatccaaataggggtttctggcgatgtcccgcaccgcgtcgtcgatctcgcgccggccttcgtcggtgacgatgacttggaacgcgtcttcgaaacgacgtccgctgtcggattcgcggaacgcgcgtcggtattcgtcatggtatgcggtgaggatgctttccacgctcatggcgccggcctgcatgcgccgtcggagcgcgtcgccgttgtcccgttcagaaagggcgagctcgcgcaggtcgatgggcactcctcgcagagtgttgtgaatcacgccgatgatgtcgccgacctgttcggacgtgagcttttccaaggcctcgctatgttccagctcgtcgatttccttctgccgttcctcaatgtccctcttcagcaggcggatgcgctcgcgcggatcggcgatcaactgcatgcgagcatgctcgatttccatgatgatgctgttggcctgcgcgccggacagcgctttcgtggtgtcctcaagccggtcgagcgcttcgatggcacggtgcgctcgcgctgtgagacggtacaggtagcggtgcgaggccacgtccatggaattggcaagccaggcgtagtcgccttccctttcgcgggcgaggtcaagcaggaccgaatgcgcggcctcgcgcgcagtctgcccgtctttcagcgtgtaatcgccggtttcgatgagccggttgagactgcgtgcgaaccgttcttcgacgatttcgcgcggcagctcccccgtcagcgggtcgaacgtggaacgcaacaacgcgacgtacagcatggaattgttacgcagcagcaaccgtaggacaccggtttcgtatacgggtcgaagccgttccatctcccgtctgatctcagccaacaatacgcctttccatgtgttcgatgccttggcggcaagtctccattctaaacgaaaacaaggaaaagacgccgcagttacagtacgaatgcgacgtcttttcctgtcatggaagagggaacccggccccatctaatttccggctagatgctcatgctcataagctgggccgcatactcctctacgagttcgctgtcccgttccgtccactcgtggctggcggaatcgtccggcacgaaaataatgtcgctgttctcgttcatttgttttacctccgtccgttccgctctcccccggcatcgttgcctgttttggcggaacttctcctagcctctcgcatggattatctcttttcaagagaacgttcacattgtggtcaaacgttttctcaacagaggaggattccagttcggatttcggtcgggatgaattgaggatgacgcccggatttgcggtcggatatgaaaaaagcttccttccggaagctttcgaatggagcggacaacgggactcgaacccgcggtctcaaccttggcaaggttgcgctttaccaactaagctatgtccgcaagttgtttccaccgtggtgggcaacgagtagaaaatatacatgaagcatgccaactccgcaaatcgcggcgtgtcgcgctattttccaacgacttaagccgatgttatgccatggttcgcggagccggtgccaacgatacaaccggcattccgaccgatatcgcccctggtgcgtcctgttgccacatgccttgccgttccacctttgcgtccccgttgctttcttcgccttatggcaggcacccattatccaaccacggcggataaagcaaatgtcgttgggggcgtaagcggttgacacggattgaaagcgactaggcgtcccactgacaacgggcgagatcgactcgcagtccggaagctccggcgttcgagtctttcatcttgcctgactcgcttagttcgggcatacctttcggagagatgaagacaacgccttcctcttcgagcagaagccgctgtctttccggaccgccgaacgcgaatccgggtgccaacgagccgtctcggaacaccacacgatgacatggaatcacacccggctcaggattcgaatgcagggcatagccgacaaaacgcgcgttgcgtggcgctccggccaaagccgcaacctgcccataggtggcgactttacccttcggaatgcgccgcaccacctcataaacacgcctgctgaacaatcccttctccattcgttgtcccattcctcaagaaactagtcgaggatgacaccggcggagagcatttgctggcgggctgcgatgccgagttcttcactgaccggttcggtcaggttttcgatgacatgcacttcaagtccaagcttacgggcgtccagcgcggtttccttgacacagtgcgattcggccaagccaaccacgtcgacgcattcgatacccgcggattccaatgcaacggcaagcgtacgccctgtagccatgtcagaggcgacctgttcgcgggaaggaatcgaatccgtattatcctcgtatccttcgaaccccgaatatgacggcgaatactgtcccttcttgaaatgatgctctacatgcagcgcggcgatcgctggatgaagttcggcgccgggagtgccggccttgccgtgcacgggccacgtatccacatagtcgggttgctccgaccagtgtgagccgggctcgatatgccaatcctgcgtggttgcgatgtattcgtactcgccgcgatgcgcattcacgtaatccgcgatacgttccgcgacggcattgccaccggctacacccagttcgccgccttcgcaaaatgtcggctgcacatccacaatgatcaaagctttcttcatgtttgctcccttccgaatttgcctgctcaccagaataatctgattgttacgcttccgcgcaatctattccatttgcgattgcgtaccacgcggtgggattcacgtggttacaggcgttcggtatgatgttcgattggcgtttggccttatgaaatgatgggcaggccgttatgtgcggcacagccagtttggaacgacagtaacgaaagtgcagaggtgttgaggcatggcaattgaagcgcaggagcttgagattcagatcggcgcgcgcacgttgctgcatcccacgaatttccacgtcgccaagggcgacaagatcggtctggtcggacgtaacggcgccggcaagaccacgctcacccgcgtgatcaccggcgacatgctgcccaccgccggcaaagtgcgtgtatcgggcaagctcggctatctgccgcaggacacgcatgctgccgatccggaacagaccgcgctcgaccgcatgatgagcgcgcgagacatcgcttccatcatcagtcgtatccgcaaggccgaaaaggagatgaccgatccggatccggacgtcatgacccgagcgatgaaccgttacgacaaggccatgcaggatttcgaaaaggccggcggctatgcggctcagtccgaagcgaccgcaatggcggcaagccttggcctgccgcaggaggtcatgggccagcaattgggtacgctttccggcggccagcgtcgtcgtatcgaattggcccgcatcctgttctctgacgcggatacgctaatccttgacgagccgaccaaccatttggacgccgactccatcgaatggttacgcggatacctgaagaaatacgagggtggattcctggtcatctcccactccaccgaactgttggacgaagtggtgaacaaggtatggcatctggatgcgcagctcggacagatcgacatgtattccctcggttggaaagcctacctgcatcagcgcgtggttgatgaggaacgtcgccgtcgcgaacgtgaagtggccgagaagaaggcggaacgcctcatgcagcagggtatccgcctgcatgcgaaggcgaccaaggccgtggccgcgcagaacatgatgcgtcgtgcggagaaacttctcgagaacacgtccgaggcacaaaagcaggagaaagtggcggatatccggttcccggagccggctccgtgcggtcgcacgccgatcatggcgaaggatgtgtcgaaagcgtatggttcgaacattgtattcgccggcgtgaatctggctattgacaagggctcgcgtgtggtgattttgggatacaacggtgctggtaagaccaccaccctgcgtctgctcgcgcatttggaagagccggacaccggttccgtggactacggtcacggctgtaaaatcggctatttcgcgcaggaacatgacacgcttgacctgaatgccacagtgttggaaaacctcattcatgtggctccggaactgaatgatacgcaggcgcgttcgattctcggctcgttcctgttttccggggatgatgcgttgaagccggctcgcgtgctttccggtggcgaaaagacccgcttggcgttggctactttggtgaccagccgtgcgaacgtgctgctgctcgacgaaccgaccaacaatcttgatccggcctcacgagatgagatcctcaaggctatcgccaagtatgaaggtgccattgtgctcgtcacccacgatgagggtgcggtgcaggcattgaaccctgaacgtgtgctgctcatgcccgacggcgacgaagacctatggaacgattcctatctggaattggtcgccgaagagtaagccgagtaattcgagttttattcggattgtatttatgccggacgcgaaaacgtccggctttttctttccacatgcgtttcgagcacgttcggtatttccgtatttgtcttggggtctgcgaacaatctgtgatttgcaagcggccccgactcatgaatcgcatcttgcatgcccattgagggcttgagtcgattcgtttgccaggaagtcgccattgcgatcgtccgaaccttttcggatttcgttatgcgccccctagccttccgcgctcctgttggaacatgacgtgcggaacagaccagaggggccgatgcagcaacacatcgaacgcatagcgaaaggaagttccatgccacgtaacggcaaggagggcattctcttcagtttcatcatgtccgcgatcatgatttatgtgatggcggcactcaattacggcgtacgtatcggtgacgtcggtgcggcggcgtggagctacgcattgttcaactggccgttggcctacgtggccgacatgatttgcgatttgtgcatctgcacgccaagctcccgcgcgattatgaatacattcggcgcggcaaccgaccgtgcggtatggaaaggcatcacggtcaaattcctcatggtggcgctgatgaccgtgttcatgaccgtattcggcgccatcatggcattcggtttcacattcggcgcgttcacgggattctggcgcatgttcccctacaatttcaccatcgcgttgccgattcagatgctgatcgtcgcgccattgtccggcaagatagttcacgccatcggcgatgctgccggatggaacaagtccgcgcaacagcatgttcccgctttggatgtcaagaccgttgccgatgtgatgcagcatgacgtttacacggtagcctcggatgccacggtacgtgacgcagtgcgcatgatgttggaaaagaacatcagcggcatgcctatcgtcgatgacgaacgccacgtggtcggcttcatctccgatagcgacgtactgcgccgcttcgcacaagacaacgcgccggtttccgacatttccacgctggtcactggcatggcccgcggcgaattcccggaactgtctcacgcagaactgcttgatatgaacgtcatggttattgccgcaaagccggccgtcaccgtgcaatcggatgccaatatcgcgcaagtctgccagatgttcgactatcaacagtacaagaaagtgccggtggttgaacaaggcaagctcgtgggcgtcgtcaaccgtggacgcctcacccgccgttccttcgaagcatgccttggtactgccgaatagcaattaaataataactaaatactgcaataagtggagggcgccgaatctgtcaatcgacgccctccactgtttatctcattccttattgcaatcaaaccgaatcatgcgcgatatgcgcaagccttcaccggcttcgcttggtgagcggctcccaaggttcaagctcgaccggctgatcggccagtatttcgcgtgtggcctcatcgagatactccttgcgaatgatcagttcggtaacataacggtcgaaccaagcatcggacgccacataatagccatcctgaccattatccttgccccaactgttctccaccttccaacggttcggccgcccgtcagcatccaaattcacgccagtcaacgtcatggcatgattgcttgggcaatcaccatactccaatcccttggccttgtcgaacgtgaatttcgtaccgaaaagctggtcaacgcgcacggtatcgcaatcaaaaaagccatcgccacgcaacgagaactgcatgcaatcacaagcgaaccaaatcggatgaccgtcactgatctgacccacagcagccttcttgaacacgtcaagaggcacgttcacaaactccatatcacccgcttccgccacattggcggaaaaacgaatacgataccgcttgccaaacggacgactctccatcggcacattgcataacgtgaccagatcgttcacatccaccggcacgtacttcttataaaactccatcggagtgataccgaattcacgaatctgcggacgctcatccttaccggttttcgcagccttttcagacggcccctcccccgcggttttcttcttgccgtcatccttgtcatcactcgtacgcgcaagaaaatcaaaacgctccggaggctcacccaacgcaatcgcacacatgcgatacaccgtggacatatcctcattcttcaacgcacgcaactcatccaacgacgttccagccgcatgacggtcacgcaaatcggacgcgaactcacgtagcttcgtattcaaatactgcttgaacgcatccgaactcttcgaattagccgactccggataagcactcttcggcaccacaccatacttgttcaccaaatcagcgaacatctgccaccaaccaccatcatcggccggaccataattaatcgcctcgaacacacgactatccaacggctcatccaacgtggcaagcacattctccaaatacgtgttcgacttctccatcgcatcccagaaaaacaggtaggtttccgaaaactcgaaatcctccaaatcccaacgatgcatcaactcataacgcaacgtattaagcgccgcaaacatccaacaacgccccgaactacgctgattggtgatgctcccctgcttcagctcgatggagaaatcattctgcagcacgcgctcgcccttgtagtcggtggctgcggcgagcacaccggatgatactgccgcgttggctgccaccagattggcacggtcggcgttgaagtctgtggaatactgtttgagcagtgctgggtcgagtgctttgacgtcactcatggttcatggtcctttcgatatgttcgatttcggattctatgtcgcgcaaacggcaacgcaggtcggattccacgtctacgccgtcacgttgcgctttgcggatgatggcgatgatttcgtcagcgtaaggatgatcgccatcatgctgttcgtccatttgacttgcgcttgttgtgaatgctgtttcaagctgatcgcaatactgcgatttgtgtactctcgatacgattttcgtggcgcgcggcaatgcgccttgcgcatgggagatgccttcgagcacagacttgcgatgcttttccttctgcttcatcgcttcccacaatttcaacgtatcttgcgcattttccggtgctggcgcggaagcgtcggcagcgtcgtctgattggaagacgtgcggatgtcgggtgatgagcttgtcgacgagacgattgcacacttcatcaatgccgaacggatcctgcgcatccacggcgcatacttgcgcttggaagacggattgcaacagcatgtcgccgagttcttcacgcatgttgtctcgatcgttcgtttccacggcgtcgatgtattcgtaggtttcttccaatagcggcttaagcagacttgtattggtctgctcgccgtcccatgggcatccgcctggttcgtgcagaatgcgtacgacctgcttgacacggtccaacgcgctaggcgcatcgcgtacaggggcaagtttcaaacagtgttcgaattcttcgggcaactgataatcatcatgtgcggcttcagtcatgccactgattcttctcgcatgtgccgaccatgcgatcgtaaccgttaatgggcagattcctccacccactggagaattcggtgcgctcatgtactcgtcagcgggaagaatcttccagtagctggaagattcgggacgttcacagtcacctcagcgtgctggtgatctggtcgacggtttcgccgtctttgcgtgcgacgggctggaggatggtttcgtcctcggatgcgtagtagtagccttcggcggtgacttcggtatcaccgttccatgtgttgtgggtggtgccgtccacgccggtccagcggagcgtgctcgtgccggtcacgttctcgctgatcgagctgccgttacggctggtggtgaccgtgtccacgttctgcgtgtcgccggccttggtggtcgtgccggatgccttcgtggccacgctcagcgtgtagtccggcggggcgggctggtatttgtcgagcacgatcacgacgatgctgcgggtcgagtcgacatggcattccatgatcttgtcgacgctgttcgacggatcgtcgctgaagccatcgccggtgtgataagactgagatccagcgtagttgtaagtgttcggtgcgacgtacttgtaccagttgtccttccatatcttcgcgtcgtagacgccggacccgttccacacgctggtggtggacccgttgccggacgccgcgcccacggccacgacgcggcagtcgccgtcgccctcgcccggatgcctctggcggaagccggccacgcattccgcgttcgcgtcgctcaacgccttggcggccttgccggccgaatcgtccatgcgcacgccccgcgcggccatggcgcggctcacgctgttcaggtccgtcgcggaaccccacgaccccgtcgcgtcgtccttgtaggcccagaactgcgcggacgaaccgcctccgccggtgcctccctggtctccgccgccgcccgcccaggcggtgccggcggtcaggccgccggccaacgtcgccgtggcggcgagcagggccagcgtctttcgccttccgttactgttcttggaacccaatgttccgtctcctttcagagatccatctgcagatgttcaccccactcccggtggggtcggacaggagaacaaatcccgtccgaacacttcacatgcccagccgtcgacaaacgtcgatatcggattcgtttccgtcatccacctgctatgcaacccggtttcgggcgtgtcgggttggacattttcccggaaggctgcggatacgaaaaagggaccccgaagggtcccttgagaagaagagtcgtctgaatcagtgctgaataatgttccctggatgccagctgccatccggctctacgccgtaccctccgctgcttggaacgaagtcgggcgcgctgctgctggaaccaccgctggtcgaacccgacgtgccgcctgaatacgagggcgtgtacgactgttgcggcgccgaatacgactgctgcgtctgggcctgtgcggcggcctgcgcggcggcctcctcctcggccttgcgctgcgcctcctcgtccgccttcgtcttcgccgtcaccgagtcgttgaccttcttcgacgcggccgcgatcttgtccgcatccctggccttgactgccttggacagttcgtcgcgcgtcgccgcatcggcgaccttgccgtccgaatccttcaacaaccgttccgcatcggaaacggtcttctccagtttcgaatcgttcacggccttcaccgcttcttccaagctcttctcgtgtttcccgtaccagccggtgttcttttcaatcaggctgttcttcgactcgtaatccgccttcgaatcggccacgcaggcgaccacgtcaggctcgttcgccttcaacgcttcggccaacgcatccacggtcttcgcatccgccacctgcttcacggtgatctgggaggctgtggccgcgtcgccatccaccagcccggaatacgagtccgccgccttgcggtagctttccgacgcttccacacacgcctgtctcgcctcggccagctcatggttcgcgtaggtcttccaaacgaaccagccgccaccagccagcacagccacggccgcgaccgaagccacggcgatcacagcaggctttctgctcttcttcttgttttcagttacattctttgacccggcatcgcttatattcgggttggaaacttcagatagttttccctgcatacttgtgctttcgatgagttatgtcacatacgttttaggaaaaagcggatgggaatcgttcgttcccatccgcacatcattttctaggattttatggcaaaaacctacttggcgtggcgtgccataagaccgtaacggccgtcaccacgacgcttcagcatgagcgtggctccggcggtaccggcggccataatggtaaacacggcggtctccatcacgtccacgcccgtgtcgccaagcttggcctgcgtggaggtcttcacggccgccctgttcgcactgttcgcactgtccggagtatcaaccgtgatggtcgtatccttcgacggggtgacaaccttgtgggccttgtcgtacgcgtcctgcgcggattccgcgtcggacttcgccgtggccaatgcggtttcggctgtcttcagcgtggcgttcacttcagccagagcagcctgggcggcatccacatcggcctgcgcgtcagccgccgactggtcggcatccttcttagccgactgggcggcatccagttcggactgcgccgcattcgtggccgggtcggaagcatacgcatcatccaccttggattgagcgtcctgcacattctgctgggcattatcataagcggtctgggattcggatacggccgtgttggccttgtcgagcgcatccttcgtcggatcggccgactgggtctggcccaccatcggatcggcggccgtctcatctgccatggcgggcgcggccataccggccacctcggtcaagcctgcgatggtcgcaacggccagtttcttcggattctccatattctccattttctccatcctgtctcccggagcgttatgacaggggcgcatgcgtccccgaatgcaccacccaccctaccactttagggggggggtaagtgtgtctcgcatctcgagataaacaaaccaatcgcatctgagacatacctccacctagacgcctttgcttcaagaaaacgggttttacgatctattagatatgggggtaatccattagattagaggaatcatacgaaaggaaatgtaatgagctatagcattgagcagttcatactggatagcggcatcactcgcgccgaggttgatgaggctaaagctcggatgttggaaaggatgcatatgtatgggctcaaggagacgcataacaagaaagcacatgaaaaggaggagctggcactccgaactcatcggaatgccagctcctcctgaaaaccgtatcgtcgcctcatactctacgtctcataaccataggtacaccgcacaccactacgagacgattttgtggtcggcgcggtagaggtcgggctctacgtagatttcgaaacggaaccacggcagcgcggtacgcacgcttcgttcgattttgttcacggtttcaacatcgtaatcgcggtcgagcttgctggtctgcaccttgacgcacagcagaatgtcatcctcggacatatgcacggtctgcatattcagcagtcgttccacaccaggcgttgaaataacagcctgctcaatcttcttgcgcgtatccgaatcgacggcctcaccaatcaacagcgaaccggatttgaacatgagcagcaacgatcccgcaatcaatacaagaccaaccatcaaaccgccgaatgcatcaaatatctcattatcaaacagaatcgcaagaccgatgccagcccctgcgaatgccaagccgatcaaagcaagcgtgtcttccataatgacggacgcaagctccgccgacttggtacgcctccaaaaacggaacacacccatatgagccacacccgtgcgctccatacgctcgttcgcttccttgatgctttgatgcaggccgtagccttccaaacaagcgctgataaacaccacgataaacgccaccagcagttccatctggttgacgtcacgcagtgcggggtcttcggcaatggcgaacaatttcttcaccgcctccgaagtggagaagaaaccaccgacgaaaaacagcagcgtcgccactacgaacgaagcgagatatttggcgcggtacagaccgaacggatgatcgccgtccgtcttatgcttggagaagcgaccgcctgccatgagcacgatttcgttggaacagtcggcgatggaatgcaccgattcggaaagcatcgcggacgatccggtaaagaacgccgcagcgagcttggcgatggccacaccaatgttggctccgagcgccgcttttacggccgctccttgatgttctgcctcctgttggcgaatatcgttcggattgctcgtactactgtcgttggaatcttgcgattcgttcattgcctttccatttctttctggagttaatacaagacatattcaatcatacatagggtgctgtcatagggtgccacccggattgacacgcttgcaggttcagcgaaaaatcacttccttgcacagcggatagccccacgcgaactgacatgccatagtcaggaacttcaccaacaccgcattccatccgaatgcggaaggcagccatgccagcatgatcgaaccgaacaggtaattccaaacccacagcagcatgaacaaagccacgctacggccgaaattgctggacgatttgaacgtgacattgcggttcatcaggaagttgtacgaagccgacagcacgatggccacgccgttcgcgatggcggatggtacggaaagcacatgcagcaaggtgaacgatccgaattccacaatggtttgcgttgccgacaccaacagatatttgccgagcgttttcggctttttcgatgattcctgattggaggatttcggattatccgacgtaccactttgcgctgccattgcctgccgcccggtcccatcactcatatcaccccccccaccgaatcatatgtcgttcaatcgcaaaacactataatgcgcccgtctcatattcccgacgtaatcgtgcatttttctgaaggattgactagtcttccctaggtattttcactgacagcacaacaaggagcatccaatgacgtattcccagaacgcgccgttccgcgccgacgtggtcggctcatacctgcgtccggcagaactcaagcaggctcgcgccgatttcgcagcaggcaagattgacgaggccgcactcaaggccgtggaagataatgccattaccgaactggtcgccaagcagaaggccgccggtctgcacgtcatcaccgacggtgaattccgccgtggctggtggcatctcgactgcatgtggggcttcgccggcgtggaaaaggtgtcgatggacaagggctatttcttccacgatgaggagacccgcgccgaatccgcacgcctgaccagcaagatcgccttcgacccggcccacccgttcgttgagcatttcaagttcatcaagcagttcgaagacgacaccgccattgcacgccagaccattccggctccggcacagctgtatgcggagctgttccgcccggagaacatcgcttccgtgcacgagttctacggcgacacccagaaggattacgacgagcttgccgacgacaacgccaaggccttccatggtctgatcatggcattgtatgaggccggctgccgcaatgttcagctggatgactgcacgtggggcatgttctgtgatccgaacttcaaccagcattacaccgccgatgagttcgccgccatgcaggaacagtatgccgccatgaacaacgccgccatcgaggatctgccagaggatctggtgatcaccacgcacgactgccgtggcaattaccactccacgtgggcttccgccggcggatacgccactgtggccgacgtgcttttcggcaaggaaaacgtcgccgcctactacctggagttcgacgatgatcgttccggcgacttcgagccgctcgccaaggtttccggagataagaaggttgtgctcggtctgatcacttccaagaagccggaacttgaggatccggaagtgatcaaggctcgcattgccgaagcggcccagtatgtgccgcttgactgcttgtgcctgtccacccagtgcggtttcgcgtccaccgaggaaggcaacaagcttaccgaagagcagcagtgggccaagatcgcgctcgtgcagtccgtcgccaaggacgtatggggcgagtgatgatcgcacacgcgtagcgcgcttgtaaaaaacatataaggggctgtttgccaatccaatcgtgactggcaaacagcccctttcgtactgaagcgaacgaaatcctaccgcgatcagccttgcatctgctccgctgcatcgttgatgcaacgaatcgcattcagcgtacgcggatacccgatatacggcatgcactgcgaaataacggcaatcagaaatgctttctcattgcctacgcccatattggccttcgcatgagacgtcagctgcggctcgcaaccgccctgcgcggcaaggaagcacaacgtgatcatttcacgctcacgcgtgctcaagccaccgcgcgtgtagtagtcgccgaagcagttgcaggcaagccacttgttgatgtgtcgcgtatcttcggggccggattgcgtgaatccacgcattccttcaccgaagatttcgatctgcttgtcttcgcccgccctggcacgcgtttccggcgtggtggtgccttgcggttcaagcggaagatgcacgttggccgcgccaagaaagttgttgagtctcttcaggaacggcagggttttgccgaaaccacagtatgcggtcgcctgatacaccatttccttgatggcgatggacgacagtccggtttcgtaggccaccggcagcatcatttcgaaagcatccaagccttggcatccgaccagcacggcaagaatggccaaagagcgggttttgtcatccaaatcaggatgatttgctcccggttcgttcaccacttcgtcataagcgaaattcgagaagaattcaatgaattccggatcggtttgcgacaatgtcctgtcattattccagaacgaattcatccgtttgtgcagctcttcaaacaagatttgcttcctttcgtttgatttgcgcttattctatcgtcggtatattgctcagacctcactgatgcgcagcagcgactttacggtgcggcgctcgtccatggccgcgtacgcttcctgaatatcgtcgagcgtgtattcggaggtgtagacgatgccgggattgatgttgccgtcgagcacttccttgagcagtcgctgcagatcgtacgtgcgcaccggtgccggaccgccgcgcagaccaacgttgcggtagaacagtcctggaatatcggcttccacgccgtgcggcaagccaacgcgcccgactacagcgcccgcacgcgcaaccttcatggcagtgtcgttcgacaatgcggaccctacgcattcaagcacggcgtcggcaccgtaaccatcagtcatttccagtaccttggctacagcctcgtcgccacgttcctccacgaaatcggtggcaccgaattcgcgtgcgatacgttggcggtcggcatggcggctcatggaaatgatgcgggtggcgcccatcagcttggcggacagcactccgcacaggccgaccgcaccgtcgccgaacacgactgcggtgtctcccggcttgatttcggcggaagcagccgcatggtaaccggtcgacatcacgtcagagagggtgagcagcgatgcgagcatttcgtcggagaagctcttcgcgtcgcccggaacgaccaccagcgtgccatcggcctcgggaacgcgcaggtattccgcctggcagcccaatccctcgtctccgaaatatccgccgtgggggcagctggattcgaaaccggccttgcataccgggcacttgccgcagctgaacgggaacggtacgatcacgaaatcgcccggcttggccacggtcacgtcgtcgccgatctgctcgaccacgccgatggcctcatgtccggcctgagtgttgggttccttgctgccgtcgcggtagaaccacaggtcggatccgcacacgcatgcgcgtaccacgcggatgatggcatctcccccatcgatgatggtcggttcggcatgctcttcgcatgccatctgcttgactcccttgaagatcgctgccttcatgagttgctcctttgttatacgaattgaattaaggtaacgtctgcgatgacgcctcgacttatgcgtcagccttgctacgaatctgttttttcactgtttcgatgacatcgtggttttcctccagaagtcgttgcgcttcgtcgtcatggccttccgccacggcacgccaatacaatgttttaagggaaacataggcttgctgcatgcggatgctttcggcttttgcggccaaacgcaacgcctgcgcgtccagtagcgccatttgcctgcgcgcaccttcggttccgtcgaaacggtttttcagatactcgcgcatggcgtcaagcggcatgccagtcgcagacaagcaggaaatagtgaccaacgattgaatgtcttcgtcggtgtaggcgcgatggccagaacttgggtcacgtgcgatcggggcaatgataccgatttgctcgtagtagcgcaaagtggattcgggaagtccggaaatcatggatgcttcacgaatcgtatgccatgttgaagtgctcataccctgcactgtaaaaacttaaagtgcttgaagtctaattggcgtgttgcatgctatctcatagcaaaagaacatgtaatcctgacaattagctaagttgcgtctgcaaagcgtaacttacgtgttcatcgtaaggaacatcagaccacgctgttttggacgaatgccacctcacaacaaaaagctcttatgctgctgagttgaatgaaatcgtgcggattagatgtactggactggaccgtacgcccggatttggaatatttgtaacgatattttggatacagggaaatccatgatgcgtattcggcaaacaacacgtcgtataatacctttcgtcgttcctgcccgagccgcgcaggtcgaggaacggcccacggcgactgccgcgatctccgactcacggtgcacggcatcgaccaacgcaaggattcattatcattatggcgaagccattctctaaaaccgttattcataatacagacgcgaagctgtcgaagcaggtaaggcagcctttgaaaacaaaccaaggaatacacaaggccctcacatggcgtgtggtcgatatcgcggtcggcgcggcggtcggcgtgatgtcgggagtgatgttttgggtgttcgacggcctgtcgtatggtctttttccgttgatgactttgattcttcctggttcagcggcgctacttcatgctttgttctacttccccgccacgctgggctctctgatcgtgcgcaagccgggagcttcggcctacgtgcttttggtcgcatcgttcgtcgaggtggtactcggcacgaaatacagtgtgagcctggtggtaatcgcattgctgcaggcggcagccgcggaagcggtattcgcactgttccgctaccgtcgttggacgctcggcgtcaccattctgtctgctttggcgattggaatcgtctacaacttctacctgctgttcttctactatcaggcattcacgttcttcagcccgcgaggcatcatcggcactatttgcgagctgcttagcgcggtggcattcgccggtttcggttcctggggaatgtattgcgctttacgtaagtcaggtgttctgtcgcgattcgcttcctcgcataaggaacataacgaagaaaacgcctgaaagtacgtttgaaagcatgcctcgaccattttaattttttaatcaaatctcatcagttttactgattaaaaggacgcaacgccggctgcgacgttgcgtccttttatgccatcgcacatagtgcgattactgcggaatcttcgaactcgaaattcccggaatcaatcggcggtgatcagctcgctcgaatccatgtcgaagtcggacatggcaaacgagcggatcgccggatcctcatacgtgttcatgtaatacgtgttagtctttccggaataaccgctggtgaacagcgtgcgctcgaactggccgttgcccatcttggacatgccttcaaccatctgtacggaggccagcgtgtggaacagacgagacacattggcggactcgttgttctgctgtggatagtgcgtgttggtgtaggcgacacgtacgaaacgcgacggcgaactcacgtcaccgggaatgccgtgcatgctcacgccggcgccccatgcgctcagttccgccttgccccaagtggtcggctccgccatttcgttgctcacgcacatgtagttgcgcaggttttccatatggaagtcgaaggtcggttgattggtgagcacatccacatcgtcatgatgaacatgcatgccatcagccatctgctcgatgacgatgctacgggtgccatcgccaatgaaccagtgcagcaaggactcctgctggccgggcacgacctgcgaaacgagcgtcacgtccttcaacgcctcttcgacttcgtcgacactgtcgaaattgcgtgccacccacagcgggaattcgaaagtggcgacgttttcggttccctcgaccggttcgtgcgcgaaggaggcgtatccggggaagttcaatccggcgatggccaagccgtgctcgttggcacaatcgaaatacatggggcgatcggccataaccacgcccacgccgatcaccgcattcggctcgctcttgcctttggccccatacgcatagtcataccggtagcctcgcggagtgaccagaatggtctcgccgtaggagaagctccagtcgagattacggccgaaatatgtgtttccctcatcgtcggagaaacgaacaccagtgcacatatggactcccttccatgatttgccgtgtttttcttgcttgcgtgttcatggtaaacgccgtttgctgggaaaatcttaagttttgcccgtggaagaacctagtctggatatctacgcattctacgacgaccgtgatccgctggatcctcgcaaccgatagcagagtctccgtcaaacgcgcaaattcgaggtctcctgcatgcgtgttagagaatagcccgcctcccgagtccccaaaacacccacccgctggaacaatccgtacgccaactgccttcttggcgggaaggttcccagtgggtggaagattcaggacgttacaagccggccaatgccagaaactttttgtcggactggatgccttgggtgaggaatttgccgtccctaaacaacgcatacgtggtgaccggcgcgggcgtacgttgggcggtctctttatcggtgatatgaatcgttttgaatggaatattgtgctcttccgccgtttgccgcacccgcggaacccaatagcatgtaaacgggcattgatcggtgtagtagagcacgaacccgtcttcgtccaccgcgggatgcttggcgcattccttgaatttcggcagctccgcattctcttcaaaaggcagggccatgagattgatgccgcaatcagatatgtcggtcacttcgaaacccttgtaggacagaaacttcggatcggcaaggaactctcgtttgcgaccctcggctgagagaatgcaaatgcctttgcgcccctgctctttggcgtctcggatgcattcgctcagcagattaccggaatgtccatgacctttcaaagaaccggccacccatagacagttgatatagatccacccgtccgcatcgatcggcacccatgcgttttccgccggaatatattcgatgaagcatttgcctcgttcctcgctacgatagaagacgagaccttcgttgaaacgctgcttgagccactcttttttcgcaaggctttgcttgccggacatggcacagcagatatgttccttgtcgatgttctcttcagtgatgtggatgtagctcatttttcctgcacctctgagtcggggatgctgtatgggcatcttcgttgattcctcgaatatgacaaaagctcttgatttccaagggctttcaaatggctcctgcgactgggcttgaaccagtgaccgtccgattaacagtcggatgctctgccaactgagctacgcaggaatgcgctgtgcacaagacaaaaatattacaccaaaacttgtggatttcaaatcttcagcgtgtcacatgtgtgtttcgacttgcaaaacgtttccatacgatgctttcggcctaatcttacatggagatcttcgtcaacggcatggccgaatcgatggcgaaatccgggtttgacggagccactcccgcttcgaccaggttgacgcccagcatggccaccatggcaccgttgtcggtgcacagtttgagctgcggcacacgcacctctaccccatgctcggccccgacttccaacagtttggcacgaagctgcgaattcgcggagaagccacctcctacaatcaacgtcttcgaatcgtactgctcgcagccgcgcatcgccttcttggcgagtacagtcgccacggaatccgccagcgacgcgcacacgtcatcgacgggaatctcattgccttgcgcctgctgttcctcgatccaacgcgcgacggccgttttcacgccggaaaagctgaaatcgtacggatgctgctggcccgctttgccttgggtgagtccctgcggcactttgatggcatgcgggtcgcccaactgcgcatgacgatcgatatgcggtccgcccggataggggaaaccgagcaggcgagcgaccttgtcgaagcattcgccggccgcatcatcaagcgtggtgccgaccacgtcgatatgacgtgcgacatcctcaacatgcagcaaggacgtgtgtccgccggacacgatcaaggcgagcgtgtcttcggggaacgggccgaactgcaactgtgtgaccgcaatatgcccgatcacatggttgatgccgtaaatcggcttattcgccgcccaggcaagcgatttcgcgccggacacgccaacggcgaggcagccagcaagtccaggacctgcggacacggcgatcgcgtcgacgtcagacaacgtcatgttcgcatcggccaacgccttggaaacgcatggcacgaacgcttcggcgtgggcgcgtgacgcaatttctggaatcacacccccgtaacgcgcgtgctcatccatggaggatgcgacgacgttggaaatcagggtgcgcccctgcactaccgaggccgcggtctcgtcgcaggtggattcgatgccgagtacgattggtccgctcattgctgctccgttcgctgctttgcttgctgttccgtttggttgttctgtttattgttccgctgctgcgaagccgacgatcctcggctcaaggtcaaggctcatggtgtacgcgtcgatgccttcgggctggtagtagcgtttgcgcaatcccattttggcaaaaccgaaccgttcgtacaatgccaaggccggagtattgtcgactcgcacttcaagcaacatgcgtttggccccctgctcacgtgcccgcgcaatcaacgcctccatcaacgaagccgcgattccctgccgttggaaccgtctgccgacgccgatcgtcatgatttccgcatcgtcgccgtcataccagaaaccggcatagccgcgcacgacgggctgttgtctagcagaatcgcctgcaaccgatccagcaaccggctcatccgcggcaacgcaacccgcaatcccgcaatccgcggtcttgccgtcatcatcaatatcgaacagatacgtgcgtgctggcgcttggaattcctggcgaatcgactgttcgctccacgctcccctgccgaacaggtccgcttccaaagcggccatctgcggcactgcgatctgttcatcgatgcttgtatggtcaacgatcatgccgtatcgtcactccgtgcgttccgcgccggcatggttgagtacatgcttcaacgggttcggcaccgacacgtccggcctgcgcaaatacaacggttcgaccggctccggattcaccaaagactgttgcgaagtggcgaaggccgcgaatcgttccaatccggacgcgccctcgtcgagcagcgcctgatcgcgcacttcgccgccttcgggaaggcttgcccacgattgcgcgtatttcgccgctccatggccgacgacgtcgaccacatattccacgttcggatcggcctggcgaagccgttccagcacctcgttgacacggttcgcaatcgattcgggatagtcgatatccatgtcgatcagggtttccacacagccgttttcaacgtttgcgtcatggtcttcgcctgcgctgccaccggcctcatagccgctgccatccaacaatgtgaaatacagctgcttgcgtcgcgcatcgttcacggcgagcgtcagatgatggcggccgtcatgctccgcgttgcgcacaagcacctgcggggaaagcacattctgcccgataagctgtgcaccggtggcgaaggcgagcgctttggctgcaacgattcctgcgcgtagtccggtgaagggtgcaggtccgatgcctacgatgatgcggtcgatgttttccggtttgaggccggcttgttccacggttgtggcgatgttcacctgtagtttttcgacgtgggtgcgtgagtcggtttcgacgatggggtcgtgtccgaccatgccgacggttgagccgtatgaggtgtcgatcaccagtgtctgcattttgtggaaactccttatgccaagctgggaactactgtacaaccgatgctggaatcgtgcttgctgctggtgttttagcggttgttgcgtgtgatgtcgaaggtttgccaggatgcgccgacgggaatgaaggttacggtgcgggtgccgttgctggtgagttcgttgtcggctctgcttgtttcgtctgtgctaacggtgttgagtggccggtcgatgtggatttcgaggcgttccggtgcgagcgcggctgccatctgttctccccattccatgaggatgatggtgttgtcgctggggtcttcgagttcttcgtcgagtccgagggattcgagttcatcgagtagtcgttcgatggcattttggcctggggcgtaggcgttgccgccgagtcggtaggcgtcgacgtgtatgaggtgggcggagttaccgctggggaattggcctttgagttcgcgtgcgatggtgaaggttggcgagacgatgggttcgctgatgttgagtcctgcgccgaagccttgtgcgaaggtggtttttcctgcgccgagtggccctgagaggagtatgacgtctccgccgtgggtgaggtgtgcgacttgtttgccgagttcgcgcatggcttcgccggttgtcgcttcgacggtgacggttttggcagtgccttcgctggtgttttcgttggcgtcagtaatggttgcctcgctcatgttagttggttcgtcctttgctgctgatcagttcgatggatcgttctagcgcgtagacagggtccgatccgttagttttgctttgttcgtcggcccatgcgagcatttggatgcatcgtctcatgccgtcggaggtccatccggagagctgtctggtggcgtttttcagcacccatgaattggttttcgcttccgcttcgctgatggtgccggagcgtacggctgaggctttggccatggtgcgtagtttcatggcgagcgctccgatgagtgcgattggcgcggtgccttgttctattgaggcgcgcatggcgatgatggcgtcggcggcacgtccggagagtgcgaggtcggcgacacggaagccgtctacttggggatttgctgtgaggtattggttgacgcgttccaatgttatgggattgtcgtcgaagtcgaagcagagttgtcttgccatggctgcgagttcgccggttttgtcgccgagtacggccacgagttgttgtgcggccatgggttcgatgcgtcggttgcgtcgttcgaagcattgtatggtgaagttgagtttcgcttcggcttttttgaggtcggctacggtttctttgacggctccggctttggtgagttggtcgatgagtcgtttgcctttgatgccgccttcgtgttggcagatgacgatgctggcttcggctggattgttgacggcttgcttgcagtaggcgaccatggtttcgccgagtttgtcgtcggcgttttgcaggttggatacgatgacgattgatcgttcggagagcagtgatgggcttaccgcttcgtcgaaggcgtaatgatcggcgttggttgcgtcgagttcgatggtttccgcgtcggggtgtttgcgttgcgcttggtggcgcaggtcgcgtacggtctgctcgttgaggtacgggtcgcctccgtagatgaggtggaagggcgttgttgcggatggtttcggcatagtattcaatctcgctgtatcggtggacaagattcattcgttccatttcatggttttgagcgcgttgtaggttcgttcgccccatgctttcgcccgttcgatcggattgtgtatgaggcgtcggcccggcaggtttggttccgttgtggtgatgcgggcgaagagtgttccggcgaatcgtgcggtcgtgtatccgatgatttcgacgaggatgatcagtagcgcgccgcctgcgtctccggtccatggaatggtggcgtggtctcctgatccgaggttgagggccataaattccatgatggcggtgccccatgaggcgaggctggcgaatatgaacccgaggcttggcagtatccatgagatggcgagactggcgagtccggcaagtgtggagaatcccacgaagggtgcgacgaccagattggctggaatggagtagaccggcagttctggttcgataagcacttggatcggcagggtgaagagttgcgcggcgatggtcatggccatggtttgcgcgatgaatgccggcatgatcggtgtgagccatgcgcctaacggtcctgcgaacagtacgatgccaagtacggcggcgcatgacaatgcgaatccgaaactgcgtgacatgtgcggattgaccatgagcatgcccaacgtggtccagctgagggttgacagggcttgcgttcttcggccgaggaacaggaagcccgctcccgccaaacccatgagcagggcgcgcgacaccgaatcggatgggaacacgcacatcgccagcatgatgtacgacgcgccgatggcgatggccgtgacgcgtttgggcagcagcaggaacgagcagacggcgcgcaccagggtggcgacgaccgcaagatgcccgccgctgaccgccatcagatgcagtatgcccgaacgttggaaggcgttttcaagcagattggcgtatgtggaatcaatacccgtgcccgtctggccattgccactatctggaggaacgtaatcctgcccaagaatacctaaggtcaggccgggaacgagcactttcccttggtcggaaagccgtgacgtctgttcgaagaacgcctgctgcatcatgccgatcgtgcgcaatgcgaggttcggtccccgtatacgttccacggaggcgatgtccgtcagccatagcggcatggcaccgtattgcgatatggcgagcgtgccccgcatccggtattcgccgccttgtttgagcgtgccgcagtccggccggtccgcatagacgcgcacccgcatcatgcttggctgcgtgacctggcttgccgtgatcgttgagatcgtcgcatcaatctggcaatcgtttgcacgtctgttcgaattcactgcgggagatgtcgtacgtaccagcgtgacaacgtcgctttcgccgtttctggccgcgtacgaggccgcatccctccattgcaatacgtcgtaggtcaacgcggaagacgcgcatgccatcgccgcgaccacgcatacgataatgctgaaatgccatgccgagaccgcccgctgcacgccaaccggcactcgcagcataggcgatcgcaggaacggcaatcccaataatcccaataatgccagcaacggtaccgccaatgccacaacgagcggcagcatgccgaaccgaccatcccgttcgacgcaatagtcgaatcccatatgcgtggccaagctcgccgcccacccgcatagggcggccggcagcagacgccaatccctgctcccctgctccccatcccgccattcgaacgtgtttcctctcatcgtgcgcacacttggtctcggaatttcgccagcgttttctcgccgatgcctttgacttccaacagttggtcgacattgtcgaaacggccgatctgattgcgatagtcgatgatgcgttgcgcggtcacggggccgacgcctttcaaggtctgcagttcgtcggatcctgcggtgttgatgttcagcagaccgtcagccggatcggcgggctccgctggtccggatgttggttcgctctggctgtcgggttccgtggatggctgctggcttggtgttgtttgcgtggacgccgtcttgtctttctcggttccgttcgccttcgattgttcggattgggtgatctgcgattgttggagcgcactgtagtggacggcctgttggatgagcatggtcaggcttgcgcagagcgcgcacgacagggtgagtatggcgatgaccgcgtggattggttggaagacgagtcgtggacggtcgcgtttgggccggtcctgttcagtcggtttgtcggaaggcttgacgccggccagatcccgcaatgtgggttttgcgggttcaggcgattgttcagttgtcgcgattgcagtggacgtttcagccgctgcggaaatctcggatattgaggttgtttcggatatcgcgggaacagcatgttcgttgcgaacgttctgcccgcgcgcgttctttccacgtgtttcgggcatgccaagtccgcgcagccgttgcgcggactgcgatgcggtttcggcttgcctgttgcgcctgcccggcggggtaacgataatgcccatgcatccaaaatggaggatgcatgggcatgttgtccagtcgaaacggcccctgtggtcgaaggatgggagttatccacatgttcggcgtgtcgccttatgcggaaacggttcccaccctgttggaagcctcgtcaaagatctcgccagaagccgttggatccgtttttcgaaatatcattccgcaggaacgatggacacgatcttcggagccttgacgatgaccttgcgcggttccttgccgcccagacgatcggcgacggcttccaacgccatcttctcaagttccttaggatcgatgtcgggcgagacctcgagcttggcgcgcaccttgcccttgatctgcacgaccgcggtgacggcgtcctggccgacatagcgttcgtcggccttcggccattcggcgtgggccaacgattcgccgtgtccgagcttgttccacagttcctcgcagatgtgcggagcgatcggggaaagcatcagaatcaacggttcgacggccgcgcgcggcacttcgttgaggctggtcagatggttgttgagcacgatgagcttggcgatggccgtgttaggacgcatcgcttccatttccacggtcacgtcggcgatcgtgttgttcagcagcttcagcgtcttcgtgtcgagcttaccatcggtgacgcgcacttcgccggtgttctcgtcgacgacgttgcgccacaggcgctgcaggaagcgcatggatccgaccacgttgcgcgtgttccacggacgggattcggccagcgggcccatgcccatctcatacaggcggaaggtgtccgcgccgtagttcgcatacatgtcgtccggcgtgatgatgttcttcaggctcttgcccatcttgccaaactcgcggttggcgtgctctccgttccaggtgaaggtcggctctccgttggcgtcggccgggccttccaccacttcggcggccggcacgtactggccacggtcgtcggtgtaggcgtatgcctggatcatgccctggttgaacagcttgtggaacggttccgcggaatccacgaagccgaggtcgaagagcaccttgtgccagaagcgggagtacagcaagtgcagcacggcgtgctccacgccaccgatgtacaggtccacgccgccggacttgccagtggtctcgttgtggttcgggcccatccagtagtcgaactcgctcttctccaccatgtgttcggtgtcggtcgggtcgaggtagcgcatgtagtaccagcaggatccggcccagttcggcatggtgttggtgtcgcggtagtaggtcttcttgccgtcgcccaagtcgagttcgaccttcacccaatcctcgttgcggctcagcggcgcttcaggattggattcggcgtcttccggatcgaaagtcttcgggctgtagtccggcacgtccggcaggttgatcggcagctggtcgtccggcaacagatgcggggtgccatcttcgccgtagacgatcgggaacggctcgccccagtaacgctggcggctgaacagccagtcgcgcagacggtagctgaccgtgcccttgccgacaccagcctcttccagccatgcgttcaccttgtcgatggcttcgtccacgcgcagtccattgaggctcaacgcgtcgcccttggcacgggtggcgtccacagcggagttgatgacgatgccgtcgtgggagacgaacggagccttgccctcatagttggccagatcgtcgccggattccggcagcggctgcacggtgtaggtgaccggcagaccgaacttgaccgcgaaatcgtaatcacgctggtcgccacccggcacggccatgatggcgccggtgccgtaatccataagcacatagtctgcggtgaacagcggcagcttggctccggtgatcgggttgatggcgtacaggccggtgaacaggccggtcttctcgcccgcctcgtccacacggtccttggcggtcttggattccgcggccatacggtaggccttcacagcctcgaccggagtggcgtagccgcccttccagtcttccggagtctcggacggccattcggcgggaacatcctcgagcagatgatgctccggggagaccacggcgaacgtggtgccgaacagggtatcgggacgggtggtgtagatctccatgtccttgacgccgttcggggtttcgacgtcgaaatgcacggaagcgccgtgggattcgccgatccagttgcgctgcatgagcttgaccttttccggccagtcgatgccgtcaagatcttcgatcagacggtggccgtatgcggtgatgcgcatggaccactggcgcagctcacgctggaacaccgggaagttaccgcgttcggacttgccttcggcggtgacctcctcgttggcgagcaccgtgcccaggcccgggcaccagttcaccggagacttggagatgtatgccaggcggaagtcgttgagcacgtcggcctgctcggcttcggtcagatcattccactgcttgcctgcgaatcccggaatctcacgctcgccggattcgaactgctccaccagcgtgctgatcgggcgtgcgcagcccttggagccagacgggttggtggcatcctcgtcgtaccaggaatcgtagatgcgggagaagatccactgagtccaacgcacatagcccgggtcaatggtggcgaaggagcggcggttgtcgaagctcaggcccatacgatgcagctggcggcgcatgttggcgatgttctgctcggtggtgatgcgcggatgctggccggtctggactgcatattgctcagccggcagaccgaaggcgtcgtagcccatggcgtgcaacacgttctcgcccttcatgcggtggtagcggctgaccacatcggtggcgaggtagccgagcggatggcccacatgcaggcccttgcccgacgggtacgggaacatatccatggcgaagtacgacgggcgtccttcggcgttgcgacccttgccgtccttcagatcgccattgacgttggcggcccagaaggtgccttcgtcatcccaaatcttctgccatttttcctcaatgccctgagccaaatccgcgttgtaacggaacgacggttcggctggttcgttcgactgcgtctgcgcgcttttctcaatgtcactcataatgcatgaaactagccgcgcaactggacacttcgcaaggcgtcaatcattatgcaagaagcgttttgcaaagcgtcacgcaaggcgggggccgtcagccttccgacgctgccgagagcgttatcgcgggagggttgagcgacatgtcgggaacgtagccgatcgactgtttcatcttgtctatggcctgcttccacgagccgtcgtccatcatggactgcaatgcggcgtcgatctgtttggccagcgtggattggccggatttgaccgcgatcgcgtacgaacgttcgccgaacgtttcgcctacgaccttgagatatccgcctcccctgttggatgcgaggcccgccgctatggcgtcatctgccgcgatggcgtccgcctgcccgatcatcaatgccgtttcgcattgcggatacgtgtcgcgttcgctcacggtcacatcttccgcaagatttcgcacgctgtaggagggtattcctcctttggccacgcataccgtccttccggcaagatcatcggttccggtgatggttcccgcactgtcggaacgtaccaacaatgccgcatgcacagtcagatacggtcctgcaagctcaacctcaccatcctgaacgtcatcagcggcgaaagcatcgaccaccatgtccacggtgccatcttcaagtgacgaaacgcgcgtcgacggcagcacctgtttgaacacgatctgttttttcgcgaatcccagcgtgttcgccacatattgcgccacggaaatatcgaaacccgaatactctcccccatgcagaaaacccaaaccaggctggtccgcggccacgccaatcgcaatggtcggcccctgcgcgagaccattggtcactacggaaatggaagtgccgcacgcgctcgtgcccaatacggtcgaagcggcgcataccagcgccgcgatatttcgtgacagacgtgacagacgtagcatacgcgcgattctacgcgattctacttgaacatgcgcgaacgcgtcaggaaccaggtgacaatggccgaaacgaccagcgagattccgatgatcacggcgaagccccacggcttgtccgtcaacggcatgcctagcatgccctcctggaagttcatgccgtacattgagaagatcaatgtcggaatcgacagcgtgatggagatgatcgtgaagatgcgcatcacgttgttcagattgttcgacacgatcgacgcgaacgcgtcggtcatgttggcaagaacgccgctgtagatgttggccatctcgattgcctgcttgttttcggtgatgacgtcgtcgagcagatcctcgtcttccggatactgcttgatgcgcggcagcgtggtcagcttttccatcacgatttcgttcgatttgagcgacgtggtgaagtagaccaacgttttgctcagttcgagcagcatgagaatctcacgattctgcatggaatggcgcagtttgagttcgagcttgtcgctttcgcggtcgatgatacgcagataccgcagatacatggtggcgttgcggtacaggatctgcaggatgaaacgcgttttcatatacgtgttgaaaccgcggatcgtaccttccatgaacgggtgcaacaccggagtgtcctgcatgcagacggtgatgatggccgactgcgtgatgatgatcgacaacgggatggtctcgtaccagtctcgcccgccgcgctcttcgacggttggaatgtcgacgatgatcatcgtgtaatcgtcttccacgtccacgcgggagcgttcttcgtcatcaagcggggcgcgcaggtcggcgagatcaacgccggtttccatggaaacgttggcgagttccacatccgtcggatccgaaaggcataaccaagatccgttttcgggtttttggatctgctccacctggccgttaatcgttctgaacattctcaacatgtctctcacccgcctttcgcgctttccgacgttctatcgctgtacggcagcccgaatccaacatctccggcgatcggtctcttgcgatcgatctggaacattcgggcaaacaaccttatttaggatagtcccaccttgagagttggccggccgcgtgcctgagatttcatcgagaattcatgttcgacgcatgcgtccgcggcaggcgacagtcactgcagatcgttgcggttactgcggatcactgcacgatgggcttccacaatggcatgttggggcctcgcaattccttcggcccattctcccaatcggtaagcgcggcgatggcgggaccttggttgaaggcgtcgagcttccactgccatgtgtcgggatccgcaggaccgttggaaccgcctgtgttgacgctcatgctcgtccagaaggcgttgcgcatggctccgagattgttgaggtcgtccggatccatgtcgagcagcacggcgacggtggccacgatccacgatccatggccgactgcgagcagcgtggtggccgtcggatcatcggcatgttcggcgatgatgcttcgtatggcttgggagccacgctggccggtatgcctgcggctttcgacgccatgcttggtttcgcctccggtgtgggcacgccatgaatggtagtcgtcggcgtactgttcgaggatttcctcgcgggtcatgccttcccattcgccgaagctgcgttcgcgcaggcgtgggtcgagggctacgtcaagtccgagaaggtcggcgatggcgtgagcggtctgttgggcgcggaaaaggtcggatgatacgacgaccatgcgtcggctcgcggccggtgcctcgttgatttcgttaagatcggcgagatacgcgccctcgtacgcgggttgggcgagttcatcattatggtcggcgatgtgcgcgactttcgcccaatagtatgttttggcgagttcataagcgctttggtcggcctgccacctgccgacgatgtcgaggggaatgtcgatttggccttgcagtcgtcttgcgagattgtatgcggtgcgtccgtggcgcaggaagagtacttcgtcgatcatgcatttcattgtagctatgccgtgcgagtgtggtgagggtcgcccagatggctgtgagcgcgaatgccgtggtggagagggttccgtcggtgaggcatcctgtttctggcgggcattcgtcgtggttggggacgcgcgttcctatgatgagaagccggtgggtgttgatgccgtatggggtgcaggtcataagggtggcctgatcggcgctggcgtcgtgtttgtttatccaggtgaaatcgtcgggggtgatggtgcggattgtttgcacttgataggtgagggtttcgccgagggtggtgatggtgaattcgtcaccttctcgggcttggtcgagtttggtgaacatgagtttgtcggcgaggccccggtgtgcggtgatgacggtatgggttcccgctcccccgattggcagggatgtgccttcccaatgccctgcgccgatggcgagcgtctgttcgcttgttccgtggcgtatgggtaggctgatgccgagtttcgggtagttgatggttgccatgacgtcgctgggtgggatgacgagttgccgattgtattcgtcgggattttgcgttgcgggttcgccgtctgtttggttgctggtttggtttgcgaggcgcgcgttgtagagtttcgcctgccgtttgctttcttggattgccttgtttgcggtgttggtgatggtggctgcgtacgctttgacgttggctgcttgttggatgttgtcttcggcgcgcatgatcagggggatgctgatgatgagtgccgttgcggtgagcatggcggttcccacgcaccatcggatgatgctgcgtttgttgggcgcttttttgtgccgtggtttgctatgcgggggaatcgccatgtgttgcctattgtcggatgttggctagtcgttgcttgatcggcacatgcgcagcatgacgatgcctcctatgaagaggagtgccgcgatgctgaagagcatggtgaggcctgccgcaccagtcaacggtatttcggtgatggtacggatgttggtgacgaccacggtgtggctgtcgccttttttgatgaggttgttggggtcggatttgacgtcgaggctccacgtcatgttggtgtcgtcaacgttgacggtgacgactgcgctgggcagcatgagcgacgagtagtcctggggcgcttgtgtttcggtgatggtgtattcgcctttgagtccttggattttggtttcgccggcttcgaatgtggtggttgtggtggtatcgccgctggtggcgaggcggtaggtgccgttgccgagggccacgagtttcaaaggcgttttgtcgctggcgccttgggcgatggcgaatttcgcgccggtgagcttttggcttttggcgtcgaccttgcgtaatgcgatttcaccggtgcagactttaacctcgttgccgggctggttgttgtggtcctgccatgcgttgggattgtgggagtattccaagtcgatggagttgacgttgcaggggcttccgatgaccgcattgccgttgagtctggccttgtaggtgactgtgatcgtcgcgccgaccggcagggccgcctttgatgcgtccgaggcgagaatgtctccgttgacgccgaacagccagctgatggttttgccgttgacgttttccttgtagaacgtgctcgccaatgctttgccgccgacggtgatcgaggtgagcgaaccatagtcgagacccgcgccaagcgtatcgttcaacgcaagatagtagtgctcgtagcctgtccagttggggattttctgcgtcacacggtaggtcaggtccttgcctatcgcttcggatgcgctgtctttccaggcactgccaacgttgacttttttgtctggcgattccacgttggataccttgtagatcacttgcccgagggtcagggtcgtgccgccggccgtacgtagttggttgacgccgttgaccgcggtgccgttcatcatcatgatggacgcggttgttttgatggcggtgccgctgcttagtgtggttgtcgccggtgtacggtccacgatggcgtagattcccggtacgagtacgttgccggtcgacatggtggctttgtcttggctgagtgtggaaaccgccgttccatcctgcttggcgaagttggtttgtttggcgaggctgttgcagaagttgcgtagctttccgctccatggatcgctgcgcgagtcggtcaggttcttcaccacccacaccatcggatcgtttttgccgttgacggtaaggttcgtatcggtggctccggccgctttggctgccgcggtgatgtcggatgccaatgccgtgttcgtggtcagatcgtagccgacgatcgtgttgccgtccacgcttgcggcggtatatgtggcaagctggatggcgcggaggtccttgccttcgaggctttccccgttgcttgccttcacgctcatggactgcttgacgcctaaatcgccgagttgcggcgtggcttgggccgtgcccggcatggcaagagccgcgatcatgcccagcgcaagcatggaggtccatcggcggcgtatggtgtgttgtgtcatggttcaccttctttggttgttggttgtcgcataggcgtcttcgcttatgcgtgcagaccagcatggcagaaaccaatattcgcccgccacctctttaagaaaatctgtggataagtggatgagcgaacacttatccacacttatccacaacccatgcatgcaactgccgtataggaatccatggtcgaaccgccgcgaacgatatgctgcagattcgcgatcttccgttccgatatcggagaaccgcagaccggacatacagtcccgtctgcggttctccgatattgtcgtttcgactggttcagtatggaaccgatcagtccttgacgatggttttgcctgccgtagcgcccggagtgagatcctgaatttccgtgatctccaaaaccggaatggtcattggctttttcgtgccgcgttcttcggcgactttgacctgttcgtcatagatggcgtcatcggaatgcagcacgacgttgccgcggaaacggtatcccttcttctgttcgaggttggcgaccgcgacgaccagatcactgccgtcaagcaggttacggtatgtctggcccgcggtgcgctcgtggtagccgatatggttgttgtcgatgatgaacatgctcatcttcggaccgagatcgacctggccttctttgctgatggtggccacccatgcgaggttgctgttgaggaatcccttcatctcatcggtgagatctgccatgatgccgtcctttcgtctatatgcccatggaatgcgggcatactttcagactacgacaagaaaccccacaacgcatgttcgcccaacgtgaataacatcacatacgcgctccatctgaaaccgaatttaggagagataacacctgtttcgcactttgctgaggcgtcagaccacgatcatccgctatccaatcaatcatggaaaagaaaggattgattttgggttggcatcagcggtatctgctggacgatatgcacgtcgagttgattcgcaatgggttcaaagacaaagcctgcagcatgccgatatccgcacttggtttagatattgtgtgtgaattcctttattccattgatgggtttttccctcaaaagaatttatgcagattcagacatttccgatttagcctgggctttttgcgatgtggcaattcttgtttgctggcttagatatgtcagacagtatctgccagagaaagcacaaaggcattttattccatcccccattctcgctttgcttgtatgcgcgtacgcaacgccccggaggccctgaatctgagagggcgtcttcctgtgaactcgatgaggctcgcgcccgccagctcatccacgtatttgcggatcgtctgtttcgtcagcatgaggtcgccgcctgcatcttcgagcgtcatggacttggtggtgtcgaacagctcctcctgcatgactgcgtagagaagcagggtcgcgttcgtggacagtgcatgttccctccgtagctcgtcacgcaggacggtcgccttgtcgagctggtcgattttgacgccgagctcctcgatcagggattcctgcgcccgttcgatgagtccgaggatggtgtatacgaagaacgtgagttccccgctgttgagtttgtcctcggcctcagtgaacgccttgtagtattcgttcttgttctccgcgatcgtcctggagagggacagcacggtgggcagagtgagatcgttgctgaggtagagcgcgagcagatacctgcctgtcctgccgttgccgtcgtagaacgggtggatgtattcgaacaggaagtggctggctatcgcccgctgcaggaacggtatggtatccgaccgggcgaggtccatcatctgtgcgagcagcgctgatatccgcgcctcgctgctgacgccgctgtggatgacggtgccgtgcggtccttggacctcgacatcgcctttcctgaacagctccccgtcgggcctgttcttgtcgtcgatctcgtcgagggctatcttgtcgtagatgtccctgatgtcctcgagagtcttgggcagttcaacgtcgcgattggtgaggttgagatacagtttcgcgaactcgccgaacctggccttctccatgtcgccctcggtcctggcctgccgggctgcggccacggcggcttccgtctccttccgcgtcgacctgaccccctccatctcgttggtggcgagcaattcctcggatatggcgtggtagatgtagttccaccgcatgactcctgggatgctccgccacatggccgatacccggcgttcggcgaggagcaccttctgtgtgagcatgcacacgcagcgcggcgtggcgatgaacagttcgcccaagggtgtgccgattccggttgtgaatgtggagtccgcttcgaggcgttgtctgacgagccggtcgtggttggcgtaggagtccatgctcctgtcggcgtggaacagccgcgccaaagtcctgtattccatgctcataacggtcactgctttcaaaaagtcatttatattttatgagaattataaattagaagcactcagaagacaagacaaagcatctatgaatgaaaattaacaataagcccatgtcggctctaccgtccgtcgccgacacccctgccgacacgggtcgttcatgcgtccgtctgttcggcttgtatacgatcttgccgaaggttctccgcgtcgtcgtggaagtcctgtttctttaccaccatataaccggtttctatcaccttgaaccgtttttgaggttcggcaagcacgtccgcgaaacagcgtcgtttcaacaaaaagggccaccccttacggagtggccctcgataatcgtggagctaaggggattcgaacccctgaccctctccatgccatggagatgcgctaccagctgcgccatagccccaaagtctgctctgcaaactctgtataatatacatcgcagacataagtcacgcaaatttcggcgtgtcgcccgcactgaggaattggcatgagtaaaaccgcaatacgcaatcaccttatgtgaaccttatgcgggcgacatgggaagtgcgccaccagcgacattagttactacttgcatctcccgtcgagccggtagtaccgtcggtggatcccgacgtgccagtgccagtcgaaccatcggttccgctgtttccggatccggatgatgagccatcaccagtggtgccggacgtgcctccgtttgagccagtgccgttggacgaatccgttccgttctggctggaaccattgctggaattatcggatgacgacccgctgtttccggacgtggatccattggtattgctcgatgtgccgttggaagtggacgagtcggtggatccgttggtggttttgtcgctgccgtccgtggtggtttcgtcgttcgaatccgtggaatcggacttaggcttttgcacgggggtctgcccgtcgccagtctgatagtcatcggtatttccatgcgaaggtacaaccttctcatgcaccacgtcacgcaccacggtgtccgtcccctgaccgccggtgaaagcaagaatcaatcccgcgctcactcccacaccaaccaaagcactgacgaatgcgatgatcgccggagcgtacttgctatgcaaccaattcgaggaacgctgcccagcatgctgtactcgggcatcatgcgcgcttccgagtgttccggtcttaccggtaactacgccaacatcgctgacgccacgctgtccgttcgggaaaacggaagtctcccctgccccggcaatatcgccgagcgcacgagtcgcatccgcatattcctgtccggaggaaatgacgcgcggtaaaccggactgcgctaccgcagccgtatcggcagacaataccatcgtgacatccgacgcaacaggagacgatccaataatcctcgtctcatcatcctgttcggaagagccaagcacctgcgtttcatccgcagctcgctcattcgaaaccgtctcgctactcgacgggaacggcacggcctgttggatcttctcccctgatgccttcaaaacgttcttgtagacctgcgtggcaaccgcggaaacaaccgaacccgcggccacaccaatcaccgatcccgcgataccgattttcgcggaaagtaggaatgacgtgaccgccgccagcgcacccgcgcaaatcgacgaaaaagagattcccttaaaaaagtttttcacaagccatgacgatagctaatttcgctatgaaagtactggcgattctgtgaaaagcttgaaaaagcggtgacagaccagcgtccgacatcatgtatcggccggctacaggctggctacaggctgggatgctcccattcctcggaatcggcgatagcgggaccgtgattgtagtccatcaaacgccaacgcaatgtggaaccgatctccaatggaatgagccgcacccagtgagcgttgcgcatcgacaaaatgtcggcgaaatcgccatgcgcatccgccattcccagcagcgtctgcaacgtttgggaaatccatgcaccatgcgagaacacgtacaagtccgtgtcggatccggcacggaacgcccaatcgttcaacgcttcgacgccacgacgtccgacttcctccttgggttcggcaccgtatttgagttcgccgccacggaattcagcccaggaacgatagtcttccgggtaccgttgcgcgagttcctcaaccggaatgccttcccaatcgccgaagctgcgttcacgcacgcggatgtcgggatgcacttccaagcccagcgggtcggcgaacgcatgcgcggtggctgcggcacgccccagatcggaacagatgaccagccggttcggaatatcgggacgacgatcaacatacagttcacgcaatgcgtcggccgtctggcgaacctgccattgtccgacttcgtcgaggggaatgtcgatctggccttgcagacgatgctgcgcattgtaggcggtacgtccgtgacgcaccagcgtgatggcgtgcacgtgttccggtactgcgctgttatgctcaagttcgacgtttcgaggcatgctgctgctctccgttgctttctcgattatggaatgtttgcgaaaactgcttcgcttgatatgaaaacatgccttccgcatctatacgggaaggcatgttcatacgtgttattccgcggtttccgcggtctcttcgtcggaagtctccggatgttcgagctgcaggtcgatgctcgggcaatccttccacaagcgttcgaggcgatagaagtcgcgggactcctgatgcatgacgtggatcacgaaatcaccatagtcgagcagcacccactggccttcggtcaagccttcgcgggaacgcggttgacgcttgccgcttttgagatacaggtccttttcgatctcttcggcaaccgccaacacctgacgttcgttcgaagcggtggcgacgagcatcgcgtcggtaatggccaatggttcggtgacgtcgaaggcaacaaggtcggtggccttcatacggtcggccgcggcggcggcgatgcggatggcgtcgatggaatcttgtactgccggcatattcagcgctcccattcgggcttccagccctctactacatgttgtgtgttttcggaatagaccatggaatcgtccggaacgtcgtggcgtaccacggaaccggctccggtagtgacgccgctgccgacttcgacaggggccacgaacaggttgccggcaccgacgtgcacgttcgatccgatggtggtgtggtgcttgtgcacgccatcatagttggcggtgatggtaccgccgccgatattggtgtgctcacccaagtcggcgtcgccgacatagctcagatgcggcaccttggtgccgttgccgatgtgcgccttcttcatttccacaaaggcgccggccttggactcctcgccaagatcgttgcccggacgcaggtacgtccacggaccgatgttggccgcgcgaccgatgtgggtttcctgcacgcgggaacgctccacatgggcgtcggcatcgatgaccgcgctgataagtgttgtgtatgggccgacctgcgcgccctcgccgatcacggtctggccttccaggaagcatccgggaaggatcaccgcatcgcgttcgatacgcacgtcatcttcgatccacgtggtttcagagtcgagaatggtcacgcccttacgcatccaatgctcgcagatacgcttgttgtgagctttggcgagcgctgcgagctgcacgcggtcgttgacaccttcgacgctcaacgggtcgggggcggcgaacgcaccgacggcaccgttggctttggcggtttcgagtgcgtcggtcaggtagaactcgccttgggcgttgttggatttgaggttggcgatcgcttcagccagcagtttggcatcgaacacgtagacggacgcgttcacttcatgcacggccagttcgctgctgttggcgtccttctgttccacgatgcgcagcacgttgcctttgctgtcgcggatgatgcgaccatagccagtaggatcgtcaagaatggtggtgagcacggtggctccgttgccgctttgctcatggaaggcaagcagctggttcaacgtgtcggcgtcgagcagcggcatatccgaagctgcgatcagcaccgagccgtcaagaccgccttgctccttcaactgcgtcatggcgcactgcacggctcgcccggtgccgggaatgtcgtcctgattgacgatggtgacacgctcattgtaggagcgggccgcttcggcgactcgttccgcctggcagtgcacgaccacggccaacgtttcagggtcgagcgccgacacggagtccatcacacggttcaaaaacgtctttccggccaaagtgtgcagcactttcggcttgttggaacgcatgcgggtgccctcacccgccgcaagaataatcgcggcacttaatgccatgtctaatctccaattcctccggctctcacaaatccagacacgaagccagttatccgacgttccatcttaaaacgagccctccctaaacgcaaaacaaccacgtctcggaatgacttgtggagcgctggaatgtcagcatgcgtgcctcggaatgactaccgtctgatagacgactatggaaaacagcaataactacaaggcgttgcgccggagacggagcggatagattgatgtccgacatgaacgtggggtatctcacgtaatgtatcaccattttttgggaagggaatgatagtaatgtcagacatcgcatatgattggatcgccctcggcgtagccgcgatcctgttcgtcatcctggcgtttctcaaacgtaagaaaaacgcgggtttcaccacacgcgtgttgcttgcaacggcattcggtatcattttgggaatcgctttcaacggccacactgattatgtcggcgcggtgggttccatctggtccaacgcaattaccgcactggtggttccgctgctgctgttcagcatcatctccagcatcacgaaccttggagagtccatgcgcttaaagagtattggtgcgaaaaccgtattcttcctgctgcttaacactgacgaagttgaatccaatccacttcttcaaagcgttcttccctgccggagtggtcgcgttcacctcggaaagcagcatcggcacgattccagtcaccgtgcgtcagttacgtagcgcaggcgttccatgagatatcgcctcgttcgttgccggaacggagccctcacagagggcaaatatcacgaatgacgccaaatccgattcagccaacgtctcccaccaacagagcggtttcgctctgaacttcgcacccaatgcaatgttctccgccagtggagatgacgcctgctgcggcacgaagccgaacaaataatccatccacaaatcaacagacacctgtgggagaataccggatcaaagtgttcgaacgacgttaggctgtcagagcatgccgagcagctcggcctcgtcacgcatggcgcggtacagcatccactcctgcctggcgtcggacaatgcgcggtgctcctccatgtcggcgatgtggtagtcgacgatgagggtggaaactttgtggcttcgtttttccggatgcagtcgacggctgaggtccagagtgtcgacgaaatggtgcgcaaagcgcgcgtctcgctccgagtaagcgagctgtacagcattgtcgaggaacgacatgtcgaaggacgcattgtgcgccatgaccacggctgtgtccgaacaccagcgtgcaaactcatccatgacttcacgcacatccggtttgccgagcagcatgccatcgtcgattcccgtcaaaccagtgattcttgacgggacgtgttcgaacgggttgatgagctggtcgaattcgtcaaccagctcatcattacggattttgaccgcgccgatctcaatgagcttggcacctttgcgcacactcaatccggttgtttccgtatcgatcacgatgtaatccgtgaatcgtccggacaacgggtccaaacgtcgggaatcgccacttctatgcgctgccattcatctcacctctgctctttcatttgcgatgtatagcttaatcattccaacctgactttcttagccggggaaacataacaaaaaaaaagatcctgcagcatgacgctgcaggatcaatgaaccgttattcaggctttaccgcaaagctcgttcagcgggtcggagcgaccgtgaccgggcaacgctggaagctcttgagatcgacatagccggtggttgccatggcacgacggagcgcgccaatgtaattggtggtgccgtccgcattgtggctggggccgaacatgatatcttccagggtgccgacggtgccgacgttcgtgcggaagccgcgcggaagcgtctgatgacgggcttcggcaccccaatgcatgcccttgcccggagcttcctcggcacgggccagcggagagccaagcatcacggcatcggcgccaagcgcgaacgccttgatgaagctgccggagtcgcccatgccgccgtcggcgatcacttggacgtaacggccgccggactcgtccatgtagtcgcggcgggcttcggccacgtcggcgatggcggtggccatcggagcgtgaacaccgatggtgttgcggttcgcggatactgcgccgccgccgaagccgacgagcacgccggccgcgccggtacgcatcaagtgcagggccgcggtgtagttggcggcgccgcctacgatgacgggcacatccagatcgtagatgaacttcttcaggttcaatggctcgtgatcctgggagacgtgctcggcggaaacgaccgtgccgcggatgacgaacaggtcgacgcccgcttcgagcacggtcgaataatagtcctgcgtgcgctgcggggacagggcgcccgcaacggtgacgccggcgtcacgaatctcatgcagacgctcgacaatgagctccggcttgatcggctcagcgtagatctgctgaatacgctcggtcgcgctttcggccggcagttcggcgatctcgtcaagcagcggctgcggatcgtcgtagcgggtccacaggccttcgaggtcgagcacgccaagcgcgcccatcttgcccatggcgatggcggtggccgggctggtcaccgaatccatcggagcgccgataaccggcacgtcgaattcataagcgtcaacctgccacgaggtggacacatcctgcggatcgcgagtacgacgggagggaacaatggaaacgtcgtccagagagtatgccagacggcccttcttgcccaaaccgatttcaatttcctgagacatgttttcaaggctaatgctcagcaatgacagtatgcaagagcgtgtcacctgccgccacaccgtttttttggacattaacaggtgccgttaacacgttcgttataagacaggaacttatcaccttcaatcccgacaggagggcaacacatggccaaaatcaaggtcgaaggcaaggtcgtcgaactcgacggcgacgaaatgacccgcgtcatctggaaagatatcaaggatcgcctgatccttccatacctcgacgtggatctcgaatattacgatctcggcatcgaaaaccgcgatgccaccgacgatcaggtgaccgtcgacgcggcgaaggccatccagcgtgagcatgtcggtgtaaagtgcgccaccatcacgccggatgaggcgcgtgtcaaggaattcggcctgaagaagatgtggaagtcccccaatggcaccatccgcaatattctcggcggaaccattttccgcgagccgatcgtgatgagcaacgttccgcgtctggttcccggctggaccaagccgattgtagtagcccgccatgcgttcggcgaccagtataaggccactgatttcaaggttccgggggcaggcacgctcaccgtcaccttcactccggaagatggttccgagccgatcgaacatgtcgtgtacaactatggtgccgacggcggcgtggcccaggtgcagtacaacgtgaacgattccatccgtggtttcgcccgcgcctgctttaactatggtctgatgcgcggctatccggtgtatctttccaccaagaacacgattctcaaggcatacgacggccagttcaaggatacgttcgccgaagtgttcgaaaacgaatacaaagacaagtacgccgcagcgggcctgacttatgagcatcgtctgatcgacgacatggtggccagctccctcaagtggcatggcggctacatttgggcctgcaagaactatgatggcgacgtgcagtccgattccgtggcgcaaggcttcggctctctcggcctcatgacctccgtgctcatgacccctgacggccagaccgtcgaggccgaggccgcacacggcactgtgacccgccactaccgccgctggcagaagggagagaagacctccaccaatccgatcgcatcgattttcgcttggaccggcggtctcaagcaccgcgccgacttggataacactccggaagtcaagtatttcgccgaaactttggagaaggtcatcgtgtctaccgttgaaggcggtcagatgaccaaggatctcgccatgctcgttggtccggatcaggcctggcttgacaccgaaggcttcatgaacgctttggacgagaatctcgccaaggctctggccgaatgacctagccgaataacctttggctgaacgaccagcagcaggctcaaaagggctggatatgtatggttcacacgcatatccagccctttttgacgtccggatattacaatcggagctcagcataggaatcatcattcgattttcatgaaggaaacggcatgacactgcaccgcacgaccgtgacgaaacgtctgttcgcactgttggcatcgacctcgctcatcatgaccatgggcgcctgctcatccgccaatgaaacgcaatcgcatgaaacggactcccccagcaccgccactgccaccgatgccggcaacgtggtgatcttcaccccttcggacggcatcaccatctcccagcagacgcctctgagcaaatgggagaagctggtgccggaaatcgtttcatcattgaaagacaatgatgtcaaaggcgccaacatcaccgtcaaagcggcgccaagtctcgacaagcaaagccaaagtgtgcaggattacgtggtgaatcatgtcaacagcaccagcgacgatgcggattcctccgacaaaaccactctggtagtggcgccggtggccgacaccaccgaatccgaccgccaatatggagactatgtgtcgcacgccatcacatggaatgggagctcctccgacgaagacgcccaggactacgcccaatccgcggaacgtttggtttccgcattgcagctcgctcaaaacgagggcatgaaagtcgtgttagtgtcgaacacgctgcagggtttcactccggatgtgtacgtgccgatgaccacggccgagcagatcggccagcttcaagccaaacagctggtcagcaagctcgagctcgacaaaaccagttccgacaatccgaagcatatcgaagtgctactcccctacgatgccgccaatgaaagcggcagcacagcggacgcgactttcgcgcaaggcgtgttcaaaggcatttggtcagtgcttggaccgtatttcaaagatgggaaggccgtttccccatccggcacgctgacctcgtcgagcacggaatccgattgggtgtccgtggcgttcgacgcggcgaaaagtgagcgggtcaaatccacgctcgccggacgtctcggcatggataaggacacatcgcgccatacccgcatcgacggcatcatctcctgcaatgattatgtggccggctatgcttccgaagagctcaacgatcttggatataccggttcggcggccgacatcaacccatccatcaccatttccggcatcgtagacaatatcaccggcaagaaagacctgaaaaaacagtccgttcccgatcctgcgcaggcgcctgaatccgatgacggcgattccgatacggaggataccagcgattcccttgacgagcagaactcgcaatggccgatcatcaccggttacggcgcctacgtcagctccataccgaatatcgtgaacggcaaacagtggatgaccgctttggaaaatcgcaagaccttagcatccgacatcgcacagacctgcgtgcagctcaacacgtcgggcaaacttgcgaagctgacgttcatctcatccgtcgccatggaagacatgaaagtgccgaccattcaggaagaggcgcttgcggtcagcgccagcaatctgaagaaaacgctgatcgaaccgggatatatctcgctcgccgaagcaggcttgtagaccggcaacaaggtaatccggattatcagacataggaaatccgacaagagatggaaaaagctggcttccgtcgaaccgccgcgacggaagccagctttttatgttgcggccggcacattcctaccgccgatcatcgcattctacttcttcggaacgtagatgacggtgtcgatcagcatgcggtagtgatcaaccaccgcctgacggcgtgccttcatgctcggcgtgaccaagccgttttcttcggtgaactcgtccggcacgatttcgaacttacggatcgattcggcacgggatgcgagctcgttggctttgttgacggcacgttccacttcggcgcgcacgatcggattgcgggaggcctcctcgagggatgccgcgcattccgcgcctttcgatgcaagccatgcgttcgtttcgccaagatccaacgcaatgatggccgctatgaacggcttgcggtcgccgatcatcacgcattgactcaccacgggcgacgtcatgatcgacgcttccatttcgcatggagagacgttcttgccgccggcggtgatgatgaggtccttcttacgtccgacgatggagacgaagccttcgtcgtcgatggaaccaagatcaccggtatgcagccagccgtcgacaatctgctgcctggtgacgtcgggattgttgtggtagccggcgcatacggccgggctcttgatgcacagttcaccttcctcgtcgacacccatggccacgccctgcagaggcagtccgatggtgccaatcttgtatccggaggtcggattgacgcttgacggagcgcaggtttcggtcatgccgtagccttccagcagcggcagtccgacgccattgaaaaaatgcgcgatggatgaatcaagcggagcgcctccggaaaccgcgtattccacatggccgccgaacacgtccatgatcgaggagtacaccagcttgttgtacagcgcatgcttgagattcaagacaaccggaatgccttcgcctgactgctgtgcgtacgaccagtcgcgcgccgtctgcgtggcacctgcgaaaatacgtcctttgaggccggctccggccttttgcgacgccgcattgtatatcttttcgaagatacgcggcacggcaaggatgaacgtcggcttgaacgctttgaaatcagccaggatcgtcttcaagttgctggataggccgagcgagacgttacctgcgaagcagaagaactgcatgtagcgtgcgaacacgtgcgccagtggaaggaacagcagcagacgacggttcggcttcatcgcgatatcgggcatggagctaatgcccgaataggtgatgaacacgaaattggaatgggtgagctcaatgccttttggcgtgcctgtggagccggaggtgtacacgatggtggcgaggtccgatcctttgaccgcatgttcgcgctcttggaattcggcgtcggacacggcatgtccgtattcgatcatcgtgtcgatcgcgccaagtccgatgacgtagacgtcgccaagattggagcattcgtttctgatggattcgatcttgtcgcgttgcgcgtcatcttctgcgaacgccattttgacgttggcgtcgttgaagatcattttgacctgcgcgggagaattcgtctcgtatacgggaacggtgagcgctccgatcgacatgatggccacgtcgagcgcagtccactgccagcaggtgtgagagatgatggacaccgattcgccgggcatgatgccttgggcgatcaggcctttggcgatggcgatgaccttggcacggaattcggtggcgctgaacgacgaccactcgccatgctcgttcttgtattcgaccaatgaatcgttcggagtgcggttcgctcgttcatcaagcaccgagaaaatgttcttatccgtgtcgatctgctgttccaaaggccgcgtgtattccttgtacatggcatttctcccctgcgtaatcgtcgtacatgtagcatcatagcctgagagcttcacttttttcgacgaggccacgacgtatggacaaaatcaatggttctgtcgacccctgtttcacaggcctttcaatccgattctcaccgtacgggttttgctttccggattggtgtattgccgtccttccgattttatcccccaatgcaggcaccgctcgtcgcaatggtcggattcgccctccacacgcgcgaaacgctccccttgcgcaacatgtgcgccgacatcgcgttccgcaatggcgggttcgaacgtcgaggtcaggccggaaaggtcgcctccatgccggatggtgaccacggctttgcctcccacgttgccgctgaaggcgatcacgccgtccgcgggcgcgacgatggcttcctgagggtccgcaagcaggtcgacaccccgatggcctggaagccactgttgtttcggcgcatcgtacttgccgaccacctgcgcgccgttcagcggccatcgcatcaggacggcgcaggaaccggacgcggtcgccgcattcgttttcgcatacgtcggttcggccgaccataggcagcacacgagcagcatgacacacgccagagcgcatacgaccatggtttggcgcaactgctggcggatgcgcttcttttcctcctgtgcgattctgttccgtcggattcgcctgcgatattcacgttcgtccatgatggctccttcacgttgctgtgtttgcgccgttgcgttgtgctgtggtaaatcgccagcatgacagtgtgaagttgtgcttgtccagctgaaacggccctgtggtcggaggatgagttatccacaggctccgggcgtgtctcggcatacgatggaacgtatgagcgataacacgtcacagcgcaaagcgttgcagcaactggaaagcgagtccgattacgatcggatcacctactatcagaagccttttatggtgctgtgggcggccgtgcaggaagcgtcaagcgaattgcaggacgattacgcgctctcccccgaactggcgcagttgtgggttgccgagcagatccgcaaggtgtcggactcgctggtggaccgtcttgcggaaacggctttggcgcacggcgagtcgaaatcgaatgtggcgcgcgcggccggagcaagtcccgccaacgcgttgcggcgctttcctcggctcaagaacgatgaaccgcacgagcgcacgctgatcgacgacgtgcttgattcgttagagtaacaaaaagcccttgatttccaagggctttcatgtggctcctgcgactgggcttgaaccagtgaccgtccgattaacagtcggatgctctgccaactgagctacgcaggaatattctcctgttctaagcttctccccgacaaaaatcaggaaaaacctaaaaacgcgctcctgcgactgggcttgaaccagtgaccgtccgattaacagtcggatgctctgccaactgagctacgcaggaatgtgcttcctgtacggaattgcttccgtgcacaagtcacatatattacacaaatcctttgtcttcgcaaatcgagtgtcgcacagcgtgtcgcgacatcaccattcgagttccgcgatgtccatcggatgctcgttgacgtcgacggcggtgaccttgccatcatgcatgcggatcacacggtccgcgatcggcgcgatcgcggaattatgggtcacgatcaccacggtggcgcctttcttacggctcatgtcctgcagaatctgcaggacctgcttgccggtgttgtagtccaacgcgccggtcggctcgtcgcacagcaggatcttcggattcttcgccacagctcgggcgatggccacacgctgctgttcaccgccggaaagctgcgcgggaaaattgtcgacacgatcgccgagaccgacgtcttccaacactttgacggcatcctgagcatcggaaacgatctgcgaggcgagctcgacgttttccttcgcggtcaaattcgccacaagattgtagaactggaacacgaaaccgatgtccgtcctgcgataagccgtcagctgtttcggggaatagttggaaatgtcgcgtccgtcgatgaccacgctgccttctgaattcgtgtccatgccacccaaaatgttgagcaccgtcgacttgcccgcgcccgacgcgcccagaatgatggccagttcgcctttttcgatgccgaagctcacatcatcgttcgcggtgatggtggtggaacccatttggtaacgcttgtaactatgctgcatttcgatatatgccattttggtctccattccacgccgaaaaatccttgactcccaatattacgactacagtagggattgttgctcatagacgacgaggaagggaacgttatggacatcgccgacgacgccgaccgtttgcaaacactgctgtacagcgcttacgattccgataccgtgcgcgagatggaacgtccgctgcttgacgacggcgtgccgctgatgcgcatggccgcctcggctgcggcccatgtgaccatgacactgctcgatgatgaggacctcgccgtcgaggacgcgcgggtagccctccttgtaggggcgggagataatggcggcgacggtctatacgccggcgcggaactggcgaacgaaggcgcgcatgtcaccgcgatcgccgtgggacgttccctgcacgaggaggcgttcggcgcgttcgtgcatgccggaggccgtattctcgtacttgatcccgccgccgaaatcccaggatgcaccacgggtttttccgcgggagaggccggagaacgactgcaggccgccgttgaatacgttcagggctcccatgtgatcatcgacgcgatgaccggaatcggcgtaagcggcgcattgcgtggcatcgcaggcgccatcgcttcctccttgggattcgatggcgaacttcccgacaggcccgccctgccgaacaacgagccttcctccgccctgccgctcgtcgtggcgatcgacacgccgtccggcgttggcgtaaatgacggttcgcttccaggaccgtacattcctgctgatgttacggtaacattcggcgcgatgaagccgtgcgcgatggtgccacccgcctcatacgcatgcggccgcctcactttggtcgatttcggtttcgacattgatgattgcgtccccgcggccgaaatgacggacggcgatttcgtaacggattcgattcgccttccgcaactttcggacggcaagtattcgcgtggagtggtcggattggtgaccggctccgcccgttaccccggtgcagccgtattgtcggccacggcggcggcgcgcgccaacactggcatggtgcgctatctcggcccgcaacgagcgcaggacatggtgctttcctcgttgcccgaggcggtgatcggcaagggccgcgtccaatcatgggtggttggttccggcgttcccacgggtgacgacgaagccgccgacaccgacattcaacgcgaaaccataaccgcgttgttgaagcattacgcactgcaggaaaaaaccggctccaatgacgacgccaggaatgaaagcgccctgggcatgccgccgatcgtggtagacgccggagctttggacctgctgccaggcaaagtgccggctcaagtggttgtcaccccgcacgtcggggagctggcccgcatgttgactcggctagacggaaacgaagccagcgtcgacaaagtgcgctcgcagccgctcgcctgcgcccgcagggtccatgagctgaccggcgcgaccgtattgttgaagggcgcggtgaccatggtggtcggcacggacggcgaaggcaacgagcgggtgattctttccggacgcgcgccggcgtggatgtccaccgcaggatcgggcgatgtgcttgccggcatgttgggcgccctgctcgcgcaacaggacgacatgcttgccgaggatccggcattagttcccgaagtcgtggcggccggagcctacatacatggtcttgcgggctcgatcgcatcgcgatccgaacagcgtggatggcatcgtccgcagatctatgggcattccaaaaagcagcatttcggggaaatcggccatccgatcatcgcgagcgatattatcggcggcattcagccggcatttttgcaattactttaattgcaaaacaaatttaccgaacaccagccccaacatcggtggctttgcgctacactagcgttgccaatccgtattttgcaggaaggattttcatgacctcccccagtgccaacgtcaccgatgtggtctttgatttttgcggcgtgcttatcgactggcagacgcgcgcatgccttgaaggcaggtacccccaagtggttgtagaccgtatttgcgcggataatgatccgtgctgcttctacgattatgaggatcgcatggaccatggcgaggatttcgaagccatttatcccgacgtggtacgtgaacagggcgaagagatcgccgagattttccgcgattacatcgaacgttacggcgatgcgctcccccgcatgattccggatatggaacagctgcttcgtgatttgaaggctgcaggctacggcgtgtgggggttgacgaattggtcgcatgagacgttccatttcgcattcgaacgtttcccgcagctcggcgagctgctgcagggcacggtggtgtccggcgtagagaagatgcacaagccgaatgccgacatctacgaactggcgctgagccgtttcaatctcaggccggaatccagcgtgttcttcgacgacaccgcgaagaacgtcactggcgcacaggccgtgggcatgcacgcgttccgcttcactaacgccggtcaggctcgccgcgatctgaaatctttgggcatggatttctgactttttcaaaacgaacacttgaattaacaaagggtgcggatcgcacgcatgtgaaccgcaccccgattgttggactgaagaaattcagattcgattccttcactgtttgcaattggttctcctgagtccgttcattaaactttcccagattgccaacggcgtttgtcaacgttgatttgtgttctgtgtcaaggcgacggtatctagcgtcgctatgacgttacttcagttttgccgcgaaccgcgactgcggcggaacaacaggtagctgtatacataaggaacgagcgctgcaccaaccgctatcgtcacaataattgcgaccatgagcatgtcgcccacaggcacaacagagctgacaacacccgccacaatcaacagcactcccaacaccatgaaagagatgccacccacacgctgcgtacgcttccaattgttctcgtcgaccagagcccaaggcgttctgatgccgaaagtgtaattctggcgcatgcgcggaaggtaattgcctaagccgacgaacagcgcgcccaataccacgctgacaataagcccaacgggaccgccggtagctgggattacaccgaatgcggtggcttcagtgaaccatgtgacaccgcacatgatgagtgtgaacgcgatgacgaatccacgatacagtccgctggccttcatgtagttttctcccttggggtccatcttcgggatgacgaggaaaagtcccaagcacagcaacggcaatatatcaagaatcaacgttacggcacgcgggccataaccattgaccgaaccatcggcaccccaatgaatcggcacgttttcgggaagccgactatagcaggcaagatgtgcgatgatgttgactacacacagtgcaacaagcgcaatgcacagattgcgtccgatcggagcgatcttctcccccgaatcagtcttgttcttgtcttcggcatggttgatgttgtttttgaaatcgttcaagttgttcccgcgcataagactctcctttatttactgtctgtttgatcattcgcttgattgacgtttccatcgctgtccatgaatcccatgaaccatccgatcagatcctgcatcaccgtggtgttgagactgtagatgatgttctgcccgtgccgttcgtcggttaccagtcccgcggttttcaacgtggtcagatggtggctgatcgacggtttgcttatgttgaattgttctgcgagttcaccagccgtcatgtcacgttcgcgcagtaattccaaaatgcgccgtcgcgtgggatcggagagcgctttgaatcccttccctgccatgcattcctccttcactttgcaatgtttaaagattttcttatttagataattatctaaacatctactatgtaaacatctaccgcggacatgcatgcgttacatttcacgcattatggtgggaagcatgattgattggagcagctaggactgagttttcaaagaaaaagcgcgccttgcccgtgtggtgaagcaatggtgcgcccggtatttcgcttgacagtcgcaaattatgggatcgtggatctgtcataacgaccagtccacgatgattcgacctgtttgaacggttggccagtagtgatttgttttactgcttctgatcgtagggtgggttgatcatgcggtcacgccaatagtagacgtcatcatgttcgccgatttcgcgatacaccttgcatggctgtccgaatgcgaccacattggcgggaatgtctttggtaaccagcgagcatgcgccaatcaccgaattgtcgccaatggtgacgccgggaagcacggtaacgttggcgcccaaccacacattacggccgatggtgaccggcagagaatactgtgtgaccttctcgcgcaggtcaggacgaatcggatggccggtggtaatgatagtgcagttcgggccgatcatggtatgttcgccgatatgcacttcaccatcatcaaccaacgtgaggttgaaattggcgtaagcgtgcgcactgaaatacgtgttgcatccccaattggcatgcaacggcggttcgatataagcgtcctcgccgaattcaccaagcagttggcgtgcgatttcgttgcgttgcgtcatttgactggggcgggttgcgttgaagtcgtatagcagttccatctgttccttctgtgctttgatcatctcttcgtcatcgcaggtgtagatcagtccggaattcatagtgtcaagcactcgttgcggcacagtcatggcagcctccttgcagtcgttcatgtccgttgcgattatatacgaacacaacgcaactcatgccgtgattccgcatgcctttcgcgattctctgcacaatcatcggccgcgcgtctgccaatatcggaacgccatgcagtgtcattcatccccatttattccagcattgaaaactctgtggatggacggaagtacgttgtcaaccaagcggatggaatacgtcgtgtttgtgggtggtgggatagcatattgttggttttgtcgttgtgattgttaattgcaagtcaatagtcaaaggagaaacatggcatattccaagaatgcgccgttccgcgccgatgtggtcggttcttatctgcgtccggacgaactcaagcaggctcgtgcagattatgctgcaggtattattgatgccgctgggttgaaagctatcgaagacaggctgatcactgatctggttgccaagcagaaggcagccggcctgcatgtcatcaccgatggtgaattccgtcgcggctggtggcatttcgatttcatgtggggcttcaacggcgtggaccatgtcgcagccgcccatcgcgttgccttccatgacgaggtcactcccgccgacactgccacggtgaccggcaagctcgacggacacgatcatccgttcgtggagcatttcaagttcgtcaggcagtttgaagatgacaataccgttgctcgccagaccatgccttccccagcgcagacccgtttcgtgcttaccggcaacaagaacgcctacccgtacgacgagttctacaaagatgacgacgagctgaccgcggatatcgtggccgcataccgtcaggtcattgccgacctgtatgccgccggctgccgtaacgtgcagttcgatgactgcacttggactcgcctgtgcgacaagagcgtgcgtgagcgtctcggctggagcgatgaggatgcggcccgcctgcagcaggagaatcttgacgtgatcaacgcagtgatcgcagaccagcctgatgatttggtgatcaacacccatatctgccgtggtaatttccattccacgtggctgtcgtccggcggttatgctccggtcgcagccaagctgttcggcgaagagaacgtggacgcctactatctggagttcgacgacgaccgttccggtgacttcgcgccactggctgaggtttccggcgataaacaggttgtgcttggcctcgtcacctccaagagaccggaacttgaagatccggaagtgattaaggctcgcatctccgaagcggcccagtatgtgccgcttgaccgcttgtgcctgtccacccagtgcggttttgcctccactgaggaaggcaacaagctcactgaggagcagcagtgggccaagatcgcactcgtaaggtccatcgccgaagaagtctggggcgaataatccaagccaatgctcggtacgaccagcttatgacatggtcgtaccgggcattgtgttattcgatgatgtgaacgcggagcattgggcgaaacgtataatacgggacagcaatcgtgaaatcataacatcgcagacagggaaagctatgagaaaagtggcttttatttgcatgcataattcatgccgcagccagattgccgaagcgttgggaaagcatctacgcggaaccgattgtgatttttattccgcaggtgtggaaaccaagccgcagatcaatcaggatgccgtacgactcatgaaagagctttacggcatcgacatggagaaaacgcaatactccaagctgatttcggatattccaaaacctgacaccgcgatctccatgggctgcgacgtgggatgtccctatatcggcaaggctttcgacgataattggaatctgccagatccaaccgggcacaacgatgaagctttcattgacgtcatccgtcgcatcgaggaaaacatcatgaagctctaaagggtcttgaccagcatccgttcgaagcccaccaagacccttccaaagcattctaggttagcttctagcacaatcagcaggcagctaaattttgccagcgtgatttggtaagaacattcacgtgcccgacacgcacctcgtgcataagaggcaccggtacctcatcacacgtgtgatgatagacaaaaccaaccttctcctgcacccgcttcgacttcagattgccgtcataatagccgcaccaaatcgcactcataccaagatcaacaaaaccatgacggataacctccttggctgcctccggcatataacccctcccccagaaaggcttgcccagccagtaacccaactcacactcatcatcacgatccgtcatatccgtatgaccattaagctttaactcaatcgaaccaatggggttattgctgccgcgctcgcaaatcgcgtagcattccttgccattgagcacatgacgaatcgtattgagactttcttctttcgatcggtgtgcgggccagcccgcgataggcccgatatccggatctttcgcataggagtacaagctttccgcatctgtttccgcccaagccctcaatgtcagccgttccgtttccaacatgtagtcgacctctttcacacgcaatgcattgaactgaagtatagattagcctgcaaggagagtttgctgtgagttgcgcggcggaggcgtgacgcggatggaggcgatgcatgcgaaagtgacggctggcctaactctcctgtgggcttcgatgaaagttacgtccagtgcagggcgtagattcatagccaacacgtaaagcaggggggctccccaacggagctgagataggcgaatgcctgaccctttgaacctgttggttaacaccatcgtagggagcgaagaatgagtgtcgtagcgcacacgcattgccagcgtcaattggcatccgtaaaagtctgcgcagcagatgcgtcgaccaaacagtctgcatcgcgcaatcatcaatcgtgattccgttttctatcccgtataaccgagcatacgggcgcgtcagcatacccattgcctgcgaaatcaagttttcccaacccaaaacatcataatcaagggggaatcatgagcaattatccatatgcgtcgatgcgagacagcttcgacctgagcgcctattttgtggtaggaccacaggattgcaaaggccgaccgatcaccgacgtcatcgatgacgcattgcgcgggggcgcaagcttcatccaactgcgcgtcaaagacgctgacgcgaaggatctcaccgacatggcgcgtgatatcgcgcaaatcatcgaagacaacaataagtcggattccgtggcattcgtgatcgacgaccgtgtggacgtggtctggcaggcccgcagcaaaggcatcaaggttgacggcgtgcacatcggacagaccgatatggaaccgcgcgaagcccgtgcactgcttggcgaagatgccatcgtgggcttgtccgccgaaacggaaagcctggtcaaactcatcaacgaattgcccgacggctgcatcgactatatcggtgcggcaccactgcatgtttccgtcaccaagccggaagcgtccgtaggcggcaatgacggttccggtcgcacgcttgacgaagagcagatcaacaccatttgttcagccagtggttttccggtagtggtaggcggtggcgtgaccgcagatgatatggagatgctggcgcattcaaaggcggcaggctggttcgtggtgtccgcgattgcaggagctgatgatccggaagctgcaacccgcaatatggtagcgcgctggaaagccgtacgtggcgacacgaagcacgggtacgcgccgcgcgtgaaagcccagaaaacagcggaaatcaacactgacaacacagccgacggcgcatccggcgaaaagaagttcaccaatgcgaaggaagccaaggccgcctccaagcttgccaagcaacagcgcgtcgacattgccgcacgcgattccaagcagcgagacaaagcacatattcgcaaaaccacgccggtgcatttcgaaaacgaattcggttcctacgatctgcaagtgccgtacactgaaatcaaactgtctgacactcctggcgtcggaccgaacgcaccattcaaggattacaacaccgaaggtccgaaatgcgatccgaaggagggtctcgctcccctacgtttggactggattcttgaccgtggagacgtcgaagaatatgaaggacgtcgccgcaatttggaagatgacggcaaacgcgccatcaaacgtggcaaggcttccaaggaatggcgtggtcgccagcataagccgatgaaggccaaggatcatccggtgacgcaaatgtggtacgcgcgccacaacatcatcacgccggaaatgcgctatgtggcggagcgcgagcattgcagcgtggaattggtacgcagcgaactggccgcagggcgtgcggtcatgccttgcaatatcaaccatcccgaagctgaacccatgatcatcggctcgaagttcctcaccaagctcaacgccaatatgggcaattcggcggtcacttcgtctattgacgaggaggtggagaagctcacgtgggccaccaagtggggtgccgacactgtgatggatctgtctaccggtaacgacattcacaccactcgtgaatggattctgcgcaactcccccgtgccgatcggcaccgtgccaatgtatcaggcgctcgaaaaggtggaggatgatgcgtccaagctcagctgggaactgttccgcgacacagtgatcgaacagtgcgagcaaggcgtggattacatgacgattcacgccggtgtgctgctgcgtttcgtgccgttgacggcgaatcgtatgacgggcatcgtttcgcgtggcggttcgatcatggccgaatggtgtttgcagcatcatcaggaaagcttcctgtatacgcatttcgatgagttgtgtgagatcttcgccaagtacgatgtcgcattctcactgggtgatggacttcgtccgggatcgcttgccgatgcgaacgatgcggcacagttcgccgaactgatgactttgggcgagcttacgcagcgcgcatgggaacacgacgtgcaggtgatgatcgaaggacccggccatattccgttcgacaccgtgcgcatgaacatcgagatggaaaaggcgatctgcaaggacgcgccgttctatacgcttggaccgctcaccaccgacaccgctcccggctacgaccacatcacgtcggcgatcggcggtgtggaaatcgcccgctatggcactgccatgctgtgttatgtgacgccgaaggaacatcttgggctgccgaataaggacgatgtgaagcaaggtgtgatcgcatacaagatcgcctgccatgcggctgatatcgccaagcatcatccgcatgccatcgaccgcgacaatgccatgagcaaggcacgtttcgaattccgttggcttgaccagttcaacctgagctacgatccggacaccgccatcgcgttccatgatgatactttgccggccgagcctgcgaagatggcgcatttctgttcgatgtgcggtccgaagttctgctccatggccatcagccaaaacatccgcaaaaaattcggtaatgccgaagcacaggagaagctcgtcgccgacgcgcaaaccatcgctgccggcatgcaagagatgagcgagcgcttccgcgagcagggcggccatctgtaccagtagaccgaactgtagtaggttgtgacgaacgggattgtctggtgtgtagaaagccgggcaatccctttttgtcgcttatgccgatatggagcactccgatagggacaactcttttgcttgtgggcctgacccgtcaagccggtccgctcccattgggcgaacacctgaccggttttgtcgagcacggtttgtggggtttccaactgtgtgcgatcctcgtcaagctgcaattggtttttcacgtccttgatctgcgcgatcggcagtccactatccagacaagagggtataagcactcccccacggtcagtacatggctctaacctgaatttatgactcttcttcagctgaaatatattgtgaaaatcgtggaatgcggttccatgaacgaagcctcgcacgagctgtacgtgtcacagcccgcgttgagctcgtctgtgaaggaactcgagaatgagcttggcatcgagatcttcacccgctcgtcgcaaggcatcgccttgaccgtggacggagcggaattcctcacctacgcgcgccaggtgctcgatcaggcgtcgctgctcgaagaacgttacaagaacgcgaagccacgcaagcagctgtgttccgtgtccacacagcattacatgttcgccgtcgaagcgttcgtggaaatgatcaactccatcaaatccgacgaatacgagttcaccattcgtgagacgcgcaccaaagacatcatcaaccaagtggcgaacatgctttccgaaatcggcatcatctacctgtccgatttcaacaaagacgtaattggcaagatgttgcgcgaaaagcatttggaattccatccactgttccgtgctccgttgcatgtgttcatttcacgcaacaatccactggccggcaagaagaaagtcacgatggacgacttgaagccgttcccgttcatccagtacgagcagggcgaggagggcagcttcttcttcgccgaagaggcggtctggccggaatactcccccaagcagatcaacgtgaccgaccgtgcgacgattctgaacttcatcatcggtctgaacggctacaccgtgtgcaccggcatcgacaacggcgatctcaacaatgagaaaatcgtgaccgtgccgcttgacaccgatgagaccatgctggtcggctggatcacgaacgagcgtgcgaagctgtcgaaggccgcggaaaactatttggagaagctcaagtcggtggtggccgaccatggatacaacctgatcgactgaatgcactctgatatgagattgaaaagtgcctcgcaccgatgctttcgattggtgtgaggcacttttcatatgtcaactataggacccgcctatagaattcaggcaccatactgctccagataagcgtcggcagcggccttgatctcgtcggtcacatacgcggtgccgtcagcggtttcgatatgctggccggcctcgaagatctcgcgcacgttggcaatggcgaataccgggaagccgaactctgcttcgacggccttcaccgcggacgtgtcggaatccttggtcttttccatacgatccacggaaagcaccaagccgacgacctccacatccgcttcggccttgagcttgggaatgacctcgcgtactgcggtgcctgcggtcatcacatcgtcgacgagcagtaccttcatgccgtcggtcagctgggtgccgaccatcatgccgccgtcgccatgatccttcttctccttgcggtcgaaggtgtagccgacttccataccgtggccggaagtcagagcgatcgcggtggagacgcccagcggaatgcccttgtaggcaggaccgaaaatggtgtcgatgtcgttcggcagattgcctgcttcgatttccgccgcgatcttctccgcatagaatgcgccgagcgtggcgatcttacgtccgtcgttgaatgcgcccgcattgatgaaatacggcgacttacgaccggacttcagcgtgaactcgccgaatttcagcgcctgcgcttccagcaggaacttggtaaaacggtggtcgagggattcagtcatgtcatgctcctttgatgaatgatcgaggtcaacgccaagtttcgcccttggcgagcttgtctgcgagttcgggacgtgcgtcgagcagctcgtcgagttcgcgggccacacgcaatggcgcggtcggttcgaacagtgcggccgcaccgacttccacggcgttcgctccggcatacaggtattcaagcgccttctcaccggaatcgatgccaccgatgccgatgatcggagtgttcggtaatgcggagcgggtcttccacacggccacgagtcccatcggcagcacggccggtccggaaacgccgccggtcacatggtcgatgatcggttctccagtgcgaatgttgatgcgcatgccgagcagtgtgttgatcatgctcagcgcgtcggcgccgctttccacggccgcgcgggcaggcacggtgatgtcggtgacgttcggcgtgagcttgacaatcatcttcttgtcggtgagcttgcgcaggcgggtgatcagacggctcaacgccaccggatcagtgccgacgctcatacctccggcggacacgttcgggcagctcacgttgatttccagcatgtctgccggagaatcattcagcttggacacgacttcgacatagtcgtcgtcgcagtgaccggccacattggcgatgaccgtggcgttgatggccttgagcttgggcaggtcgtcttccaaataatggtccacacccgggttctgcaggccgaccgcgttgatgttgctggatgggccttcagcggtacgaatgccgggattgccttcccatggcaccggggagacgcccttggtggtgaccgcgcccagttggctcacgtcgtagaaccagcggaccgccgcatactggaaggtgccggaagccgtggcgaccggattcttccacggcacgcccgccacctgcgtgggatgcttccactcgtacgaaccgtacaggttctcatgctgggtatcgtcgatcatctcattcaccccatcccaaacgttcgcgagtaaagaccggaccatcggagcagaccttcaaacgtccgtccaacgtgtcgaccgtacacagcacgcaagtgccatagccacagcccatgcgctgttccaagctcagctggcacgccatgtcacgcttcacggcccatgcggcgacggccttcatcatcggcagaggaccgcaggtcagaatcaccggcttgagtcccgaatccatcaactcgccttcgatgcggtcaagcaaggtgatcacgttgccttcgctctcgtcgatgctgtacaccttgtcggcatacttgcccgcatattcgtcgccgaaacgcacgttgcggtagccgaacaccgcggtgctgaccgcgccttcgatgccggcgatatgctgtgccgcatgcacgagcggaggcacgccaagacctcctgccacgagcacataattggcgggctccttggtcttgaacgaattgccgagcgggcccatcacacgaatggtgtccccagctttcaatccggcaaattctgcggtgcccttgcctaccacggcgaacatgaggctgacttcgtcgccgttggtttcgcaaacgccgaacggacgcggcatcagcttgcttggatcgttggaatatacgtcaacgaattgtgccggctttgcatggctggcgatgtattcgtcacggaacgtcaaacggtacacgccgtcagtcagttcctgattgtcaacgacctcgacttcatgccggctcgggaaaaagcctgccgcagtcgcttcggcaacggtcggaacgaacgttgttgcggtggtcatgaactccctctctgttacgttcgatggtttggtggttgtttttctttcagattgaacagttggccagtcggcaggttacggcaagaccgcacgcagattgtcacgcatatctttggctgcctcacgggctgattccgcaaccagatccagagcatcgtcggcgctcatggattcagaatacttgccggactttttccatgcaccgataacgccacgtgacgagttgacaagcgcacccatgccgtcacggtcgaacatgccggccacaccttgcgcggtgccgccttgagcgccgtatcccggtacaaggaagaacgtgtgcggcatgcgtgcgcgcaatgccttgccttcctctgggtgcgtggctccgaccactgcgcctacacgtgaatagccgttcttgccgatggtttcggctccccagccttccaccagatcggcgacatgctcgtatacgcgttcaccggaggcgagttcgagttcctgcagttcactgctagacggattggaggtgcgtacaagcacgaaaatgtctttgtcgttggctgtggcggcgtcgacgaacggtgtgatgccatcggtgccgaggtatgggttcacggtcaccgcatcctcatgccatggatcataggcggtgtcgtccaatcctataccgctgaggtgatgagcatatgcagccgcggtagagccgatgtctccgcgcttgacgtcgccgagcacgtacaggccctgctgcttggcgtattcgcaggtcatggtgtaggcgtcgatgcctgccggaccgagcgtctcatacatggcgatctgcggtttgaccgcaggcacgatgtctgcgacggcgtcgatgatggcgcggttgaattcgaagaaggccacggaaagctgcatggacggcgcttccgccggatcttcaacctgttcgctgatttcctcggcaaagccggccacgatttgcgctggcacgagcgcttcggtcgggtcaagtcccacaacgctcggattctgcttggcttcgattgcttcgatcaggcgatccatcaatcctccttgttgatacggctgaagactagtttcgagccgatgatggtggcgagcggacggccggtgacctgccatccaccaaacggggtgttacgagccgaggaatggaatcgttcaggattcacggtccatgcctcgtcggtgttgagcaccaccagatccgcgcggtcttctgcaggaaccttgacgaggtccagcacgcgtttggtgtcgtcgtctccggggacggcgtctgcgtattcgtcaagcaacgctgtgacgtcggccttgctgtggcccataagttcggctggcgcagtcgacatgagttcaatcaggcgttcgtcggagataaagccaccgtccacaagaatcttgtggcatacgccatacgcgcattcaagaccaatgatgccgttcggagcatcgaggaaaccaaggtccttctcttccatggtatgcggtgcatggtcggtggccagcagatcgacggtgccgtcagctacggctgcgatggttgccttgcgatcctcttcggagcgcaacggcggattcatcttggcgagagtgccgtatttcagcaatgcttcatcgcacaacgcaacgtagtgcggtgcagtttcgcacgtgatcggtaagccttcagctttggccttgcgaatcgcgtcgaaagaaatcgcagtgctgacatgctggaagtgcacatgcacgccggttttgcgcgccatctcgatatcgcgttcgacgattttcagttcggtatcttcgggaatgccgggtacgcccagttctcgtgatacgggaccttcattgaccgccccggtgtcgtggtgttcgcaatgctcgatcaggtataagcctgatttcttgacgttgtcgaacacttggtcgaggatttccggtgttaccgcggaaccgtcatcgctgatggcggtcaccgggtggcacagctggtaggcgtccttgttgtcgtcatcgtgttcaggcaggtagccgatccagtcggccacgtcggttgcttccttgcctgcacgccctttggaagcgcatacgcacaggtcataacgcaccggcaaggtcacatcatgggcttgttcgtaatgctgcaaatagtcgatgaccgtgtcgaaaccggcgtcgagcacttcactggcgcccggttcccccgccgtcaccttcacgccatccatggcgggaacggtgttcggcatgatgagcacgttcgtatacccgccagaggcggcagccgcgcaaccggaaaccatggattccttgtaggtctggcccggatcgcggaagtggacgtggggatcttcgaatcccggggcgatggtcatggccgaagcgtccaccgtttcatcagcgtcagatgggacgatcaggtcgatgacttcgccggtgttccaaaccttgatgtcgtgaagggtgagggtcatgggtcagaacttcgcttcctcgtcacagtagtcgcagcggtattcctgacggtcggaatgcaccaggtggaacatctgtacggccggctcggtggtagtcacgcagcgcgggttcacgcatttgatgatattgaccacatgttccggcagtgtaggctgctttttctctacgattttaccgccgcgcacaatgccgacggttgcggtgcgtgccacaaggccgagcacgtcaaggtcgatggtttcggcttcctcttcgctttcgattttgatgatgtctttggtgccgaacatgtggctgtcggtgttcatgatcagcgcgagcttggtcttagccggatcaattttcaggtattcgagcaccttgagcgcggtgccggcaggcacatggtcgatgatgatgccgttctgaatgctggtgacttccatcaggctgcaacctccttggattcaagcggttcatatcccggcagttcgtctccgaccaccgagctttccaatgccatgcgcataagcatgccgttcttgacctgttcgaagtaggcagcgcgtgggtcgtcatccacttcgacggcgatttcgttgactcgcggcagcgggtgcagcacggccatgtctttcttggcgtaagccatcttggcttcgtcgagaatgtaggtgtcgcgcagtcgcagatagtcgtcttcgttgaagaagcgttccttctgcacgcgggtcatgtacagcacgtcgagatcgccgatcacggaaacgagatccttgacttccgtgtaggagcaggagtcggtggcgttgatgcggtcgagcacatactgcggggtcttgagctcatccgggctgatcagcacgaagttcacgttgccgaaacggcacagggtttcgatcagggaatgcacggtgcgcccgaaagtcagatcgccgcacagtccgacagtcagattgttcacgcgaccgaagcgcgactgcatcgtcgcaagatcggccagagtctgcgtgggatgcatatgtccaccatcgccggcgttgatgaccggcacggaggctgcacgggacgccacgagcgcggcgccttccttcgggtggcggatcgccaccacgtccacgtagttggacacggttttcagggtgtccgaaatggtttcgcccttggtcacggaagcgagctgggcgccggcgaagccgatcaccttgccgccgagtcggagcatggcggtttcaaagctcagacgcgtacgggtgctgggctcataaaataaagtggcgagcaccctgccgtcgcaggtgtgcgccacttctttacgatgagaatcaatgtactgcgccttgtggagtaattcttgaatctggcgaatggaaagatcatccaatgtgatgacgcttttcccgaccatcggcgtttcaaccgcctgttcgagtactgaagacaacggctcacctttcatgcaacttgtggttgaaggtggccactcgaagtgacctagccaactatagcctgaaatgcagaccctgccagttcaccgcgtgttcacaagtattcgtggcgcaacctccatccttccatgcacgaaaccctgaatcagcataaccgtcagagccgtataacttcggtccgacggccacaccatgctcctagccgttcaaatggcacgactcacgaacgaccgtagaacaggcgttccgttacgtcacgggctttgcgtatcacggcgagcaggtcgttttcgaaatgttggccgcgattcgcatcgtaaccgagatacacggcgatgcctcccagcgaatatgaatcgtccggcaaaatatcagcctgattgacgcgtccgctccacagataactgccgttgcgcgcggccgtgcacatacgccatgccttacgcaacaccacagcatcgccagcggaaatcagcttgcgatgttccaactcgttcaatgcctgcaacgtaccgttgacacgcaagttggcattgtctcccgcatgctgcaattgcagcaactggatcgtccactcaacgtcagacagtccgcccttgccgagcttcagatggcgatccctacgtactccgcgcggcagacgttcagcttccatacgtgccttgagtttgcggatttcggcgatctgcgtttccgtaagatcgattttcggataacgcaacgggtcggcgatgttcatgaggaaatcctcggcaagagacgcgtcgcctgccgcatatcgtgcgcgtaatagcgcctgatgctcccatgtgcttgcccaggatcgatagtattcctcgcaggatgcgtaggaacgtacgagcggtccgtttttgccttcaggcctaagatccatgtcaagttcgatttttggttcgaatgtggttggaccttgcaggatcgcacgtaggtcttcctgcacttttcgtgcgaaaaggttggcttggtcgtcatcggcaccttcggccggcctgtagatgatgatcacgtcagcatcagagctgaagttcacttccctaccgccgtaccgtcccatgccgatgatggcgatcgccgccggagcttcgtcgatctgtatgtcgttgatgcgatgctggatggcccactgcagcgatgcttcgatggccgcgtcgtatacgtcggtcatgccggcgagcgatgcttcatcgtcgatcacgccactcatccaagcgagaccgatgcgttcgatttcgtgtctgcgcatggctcggatggagttggcgaaatcgttgatgttgccggcattgcgttcaagcgtcgccttggtttgaatgtcgaggctttctcgcgaacgtggttgcaaagagtcgtcgttgccgagccatgtgactgattcgacggatttgttgagtgcgtcgccgaggaatcgtgagttggatagtacgtggcataggcgttgtgccgcggatggtgaatcgcgtaggaatccgaggtatccgctttcggagccgaagttttcttcaagtttgcgccagttaagcagtcccatgtcgggattctgcccttcgccgagccattgcagtactgcggggagcaggatgcggttgatttttgccgcacgggagatgcctgcggtgagcgcggtgacgtgccgcatggccgcgtcggcatcggcgaatccgatggattcgaatcgttcctgcgtggctttcgtggagagttccacctgttcgtcgtcgagtcccgcgttgatgggcagcatgggccggtaatagatgtccatgtgcaggtgacgcacctcacgacgtgtctcatcgtatttgttgacgagttcttcgggatgcatgtgaaatgcgcgcgcgagtcgacgtagttcgggattttggttcagctcgtcgatggtgatgtctcgtttgcgttcaagaccgccagcgttggctttgccgaggtctgggaacaggtgggtgcgtttgagcgcccacatttgctggcggtgttccatcacacgttcgaatcggtagtcccatgaaagtttcttggcttgtttgcgtgagacgtacccgccttcggccaaggcctgcagggattcgagtgtggagctggtacgcaatgcttcgtcggagcggccgtgcacgagttggagcatctgcacggtgaattcgacgtcgcgcaagcctcccctgccgagtttgatttcgcggtctttcagcgggttgggaataaggtcttcgacacgtttgcgcatctgctggcagtcatagacgaagttgtctcgcttggaagctgtccaaacgaacggtcgggtcatatccatatacgcttgtccgaggtcggtgtcgccggctaccgggcgggctttgagcagggcctggaattcccagttttccgcccattgctcgtaataggcttcgtgggattcgagtctgcgtaccagcggaccgtccttgccttcggggcgtagtccaccgtcgatctgccagagtgtcggttctgcgacgcccatgatgacggattggcatacacgttgcagcgtggtggccattttggtgccgattcggctgagtgccatgccgttggtgtccatgtcggcgggttccaccacgtagatcaggtccacgtcggatacatagttgagctcctgtgcgcccagtttgcccatgccgatgatggcgaaacgcacatgttcgctgccgtccacttcatggcgtgcgatggcgagcgcgccttcaagcgccgcgtccgcaaggtcggaaagttcggtgctgatgcgcggttggatttcgatgggatcgttcgccgtggcgtcttgcgccatgattgcggcgagttgtttgcgataggttttacgtagcgccgtcgcagcttcggcaagtggcaggcttgcggtcggcatggtgtggtcattgggatcggctcctaccgatttgagcacatgcgctctgcgctgttcgtgattgtaaaggtggctttcgcaggcatcgttggctgcggcctccacgagttccgggcggaatcgcatgagcttgcccatttcatcggatacgccgagcacggtgatcagtcgcacgaaagagttttcatcggcgatgatgttggtgaaatccttgccttgactttgcatcactttgatgatgtccaccaggttgctgagtgcgatgtcgggatcgcacgctttttccagcgtggctagtagcagccgcatcctgtcgccatcgatgccgtcattgtgcagctcgtcgaacaacgtgcgagccctgtcgagatcttgcagccctgctcgaatcagatcaagcgccccgaacttgtgttgcatggaagtcatggtttctatagtaaccgctgataaaaccaagggcagttgcgaaatacccgcaaccacccttgatgtttgttgcatcgcctgaaatcagacgaagaatggtttgacgttggaccaaatacgtctgctgacgcatggatggttcatcgtatacaggtgcacaccgtcgacgccccgcgccaccagttcgcagatctgctcggatgcgtaagcgatacccgcctctttaagcaaagccttgtcgcttccccatttatcgagcataatgccgagtttttcggggatcttcgactgacatttgctcgacatgttcaacaccgatttcgcgttcatgactggcatgatgcccgcttcgatcggcgcatcgatgcctgcggccctcgctttgtcgaggaatctcaggaaatcctcgttgtcgtagaacagttgcgaaatcagatgcgtcacgccggcatcgactttctttttgagattgtcgatgtcctcttccagcgttgccgactgtgggtgcttttccgggtagcaggcgccgtagattttcatgtccggacgttgctggcggatgtatacggccagatcgctggcatgttcgaacactcctgccggttcggcaccgtcgatgcggtcgccacgcaaggcgagcacgccggagaccttggcctgttcgaacatgtcgagtgcctggtcgacgtcatccttgttcagatactgcgcggtcagatgggccacgctggggatgccgtattcgcttaccgtgtgggcgatgcgcgcggtcaatgtacggtcggatgatttgccggtgccgtaggtgacggaaatgaaatcggggtccaacccctgcaggccatccaacgtgtcgtagatggtgcctacaggggaggttcgcttcggagggaacacctcgagcgagaacattggcgaatgcatggctgtcgtcttgttcctaacgtttcgccttatttggtcagcttggcacgcacagcctgggctgcggccacgaggttttcgaggcttggccaggtttcggcgttgccgcgggtcttcaaaccgcagtcggggttgatccacaccttttcgacgtccatcttcttgaggatttcgtagatgcgttcctcgatttcggcttcggacgggatgcgcggcgagtggatatcgtagacgcccgggccagcttcggtttcgaagttggcgtcgtgaatggcgtcgagcaccacgagatcgccgcgggaggcttcgaaggagatcacgtcggcgtccatggcgtcgatgtcggtgatgatgtcgttgaactccgagtagcacatgtgggtgtggatctgcgtggtcggcttgaccgcggagtgcaccagtcggaatgccggaatggcccagtcgaggtacttcttgtgccagtcggtcttcctgagcggcagcttttcacgcagggcggcctcgtcgatctggatgaccttgatgcctgcggcttcgaggtcgagcacttcgtcgcggatggcgagggccagctgctgggtctgctgctcgtgggtgatgtcctcgcgtggccaggaccagttgagaatagtgaccgggccggtgagcatgcccttcatcacatggctggtacgggactgtgcgtaggcgctccattccacggtgatcgggttggcgcgggacacgtcgccccatacgatcggaggcttcacacaacgggtgccgtaggactgcacccaagcgttcttggtgaacaggaaaccgttgaggttctggccgaagtattcgaccatatcgttacgctcgaattcgccgtgcacgagcacgtcaaggccgatctgctcctgatgcttgatgcaggcgtcgatctgcgccttcatgtattcgtcgtattcagtcttggtgatttcgcccttgcgcagtctggcgcgttcagcgcgcacttccttggtttgcgggaaggatccgatggtggtggtcggcagcaacggcaggttcaacgcctcccgctgtgccttctgacgttcggcacgtgccggctgacgcacgaagtccgagtcggtcagagctgcaagacgttccgccacgttcttgtcggcggcgacgcgggtaccgtcgaagagcgcctggttggcggccaatgccccggatgccttcttgtcttcctcgctggcgtcggcgagaaccgcgaggtcgtgcagttcgccgagcttttcaacggcgaaggcgaaatgcttgcgcacatcatcggcgagaccgtcctcaccttcggtgctgaacggcacatgcagcagggagcttgcggtggcgacggccacattgccggtgaccttcttcagcgcgtcgacgagtccaaggctgacggcgtaatcgttacgccagatgttgcgtccgttgaccacaccggcgaagatggtggtgctctctgcgacgccgaacttttcaacggcggcgagattctcgtccttgccttcgttgaggtcgagtccgatgccgtcgaagccgagcaggttgacggtctcatacacgtcggcgatgtggccgaagtaggtgttgagcagcaccttgatcttgccgtctcgtgcgggcaggatcttggtgtacaggctcttgaacagttcgacgtcgcccggctccttgtcgagcacgaggtacggttcgtcgatctggatccattcggcgcccagctcggcgaacttggccacgacctcggcgtagacggcggcgaccgcgttgaccaggcccttgtcgtattcgagttcttcggcctgcggattgcgggcgagcttgaggaaggtgtacgggccgatgagcaccggcttggtggtgatgccgagcgccttcgcctcgttgaattcgtcgaacggcttggtgctgttgagcttgatgtcggtggcttcgtcgacttccggcaccagatagtggtagttggtggtgaaccacttcttcatcggcagcgcggtgacgtcgcccttgtctccttggtagccgcggcccatggcgaacagcgtctcttcgggattgtcgaaggcgaggcgctggtagcgctgcggaatgacgttcagcaggatggcagtgtcgagcatttggtcgtaatagctgaagtcgttgctcggaatcaaatcgattccggcttcctgctgcagcttccaatgcttggcgcgcagctccttggcggtggcgcgcacgtcgtcgagcgttgcgacacccttccaataagcttcgataatcttcttcagctcgcggttctggccgatgcgagggaaaccggagacggaagtgagaacggacatgaatcctccatctgatatgaacaatgcaacccgctcaagctaccacgaaatcgccagctataactcatcaagaaaatttaagtgtcgctataagcacgatttatatcagttggcatggcaacatttcacgcctctcagcatcatgccgagaggcgaaggaatcattcaaaatccttggccgtcagcaatgcgatgagttcgccactgtgcagctgccattggttgaatggctcatttgatccgaacacggcgagcgatgccggcgacatgcccagattcagcatgtcgagcagcattgcatccgattcggagctcgccagccattggcatgcgatcgacacagtgggctcatggccgagcaccaacagctcgcgatgcttctccttggtctgggcaagctcgtcaaataccgactgcaccccaccttcgtacagactctgacgatagtcgaccttcgggtcgtcgccgaacaccttaagcatgcgatcgcaagtctgcctggccctggtggcgctggagcacgcaatgcgcgtcggcaccatcttgtgcgcggccaggcctttggcgacggctttcgcctgcttacgccccttgtcggtcagctcacgcccggcgtcgccaccgtcaccaaacggctcggttttggcgtgacgcatcaccagcaacacatacttgtaatccttggcttttttcgcaaccttcttgaggctcgttcccatggacgaatgctccaatccttaacgatccagcgtatgtaccaacgcaacgcgctatgactattgtctcagaacaacggcaagaaacaccgtatcaatcgccgatagcctcgacctgcgcgtcgagatcacgcagcaccttacgcaacttgcgatcggaaatatcccgcaactcaagatcttcgagctgttcggcacgttcttcggcgctcagcgaatcaatatcggtggtcgtgtctttcgtggcacggtcacgcttgcgcaacgcctgaaatcccggcgccatagcccgcgaaaccataaggaagccggtgtgtccgatcatctgatggtcgggacgtatcgccaatccctgaaccttccagtcgcgttccagagtctcctggatatccggttccgtccagcagccagcctccctcaacgcctccgccatacggcttagctgcgtagtagtggtcacatacgccacgagcacaccgccgggcgcaatcactcggtatgcctgctcaagacggttccaggggtcaagcatgtcaagcatgatgcggtcgaaggaatgctccggcaatgtggcggcgaccgaatcgaaatcaccgattttcagatcccaccatgcggggcgcccgccgaaatagaccgtggcattcgcttcggccacgcgggcgaattccgaacgcatctcgatggtggtcagtcttccacgctcccccaccgcgtccagcaggttgacgctcatggcgccggatccggcaccggattccaacacgttcatgccggaacgaatgtcgccaagctgaatcacttgggcaatgtccttcggatacatgatctgcgcgccacgaggcatcgacagcacataatcggccaaccgagggcgcatcaccgcgaactgccatccgccaatggcgcgcgttcccttccaaggcttgttggcgtcgcgttccggatgatcctgattgatctgcgcctcacgtttggcgctcaccgtcaccaccacggacccttccgactgcccgatcacatcgtcatgcagaatgatgccgtgcgaggtctgcgtcacaccgcccggcaccaattggtcggtgatcttattggatctgcgatccgtgaactgtaccttctcacccgccgtcaacggtcctcgacgcatcaatcactccttcatacccacacggattccaccatcacgacagcacggaaccgaatgactcctgtccgacgctattcatgctacagcatattccggcgcacacagcacccgttaccgcgcgtacgcgctccaacgtccattcgcatgcgtcacctcaagctccaaaccgaacacttcgctcaaccgttccgaagtgaaaccgtgttccagatcacccgagtacacgatggtgcccggagccggatcgttgcctgcgacattgtcggcgtaggcgtcggcctcgctgccggtgatcctgcccatgatcgccacatggtcgaatccctgcggaatctcctcaagacgatgcgtcaccagcaccacggcacgatccgactgctcggcgccgacacggctcaacgcacgaagcgcaatctcacgaccgcccaaatcaagaccggtagtcggctcgtccaaaatcagcagatccggatcagccatcaacgcacggcagatcagcacgcgcgtacgctcaccttccgaaagtttgaacatcattttaccttcgagatattcgataccgaattcacgcatcagggaacgcgccttggcatagtcttcgtcggtgtaggtgtcgcgccaacggccggtggtcgcggtcaatgcggtcacgatggcgtcgagcggatcttcttggggagggaacgcgcgactcagttccgcggagctcaaaccgatacggttgcgataggagaacacatcgaccttgcccaagcgattgccgagaatgtcgacggtgccttccgacgggaatcctctggtgctcatcatttgaaccaagctggatttgccgatgccgttgggtccgaacagcacccatttctcgcccttgttgattttcagattgaccttggtgagaatcacgcgtccacggcgacgaaattccacgtcagcgagttccagtgcgatgttctgctccggcattcttcctcccctatcgttgttcggcttgtagatatggaaacgccttccgccagcataatgctttccgcggaaggcgttccacgcatcgtctacgtggtgaactggttattcggcggttttgccctgctcggcaagcacgtcttcatagaccttgacggtcttgtcggcgatcgactcccagctgaagtggtcgcgcgcacgctcgtaaccggcctgtcccatctgcttcgccttttcaggatcggccatgatgcggttgatagcgtcggccatgtcatgcacgaacttgtctggattggtcggagtgccggtgccgtcgtgcagctggtcgacaggcacgagatatccggtttcgccatcgacgacgacttcgggaatgccgccggtcgcggaggccaccaccggaaggccacacgccatggcctccaagttcacgataccgagtggctcgtagatggatgggcagatgaacgcgtcgcaaccgtgctcaagcgcgttgagctccggcttcggcagcatctcctcaatccagatgatgttgccgcgctcctcgtcaagcttggcgaacgcggttttgacctcgttcatgatctccggagtgtcgggcgcgcccgcgcatagcacgatctggatgcccggatcgacgaaatgcaacgcctgaagcaggtatggcaggcccttctgccgggtgatacgtccgacgaacagcagcgtgggcttgttgcggtcgatattgtagcgttcgaacaccttccagcccggatcgtcgtcggatggggtttcgaactggctcatggtgataccgttgtgcaccacgaccaccttgtcggggtcaagattcggataggcgctcaggatgtcttcgcgcattcctgcggacacggcgatcacgcggtcggcatgctcgtatgcgtcacgctcggcccacgagctcaaatcgtagccgccacccagctgttcacgcttccatgggcggaacggttcgagggaatgcgcggtgatgaccagcggcgttccgtgcagcatcttggcaaggtatccggccaagcatgcataccacgtgtgcgcgtggatgatgtcggcgtccacatcgtcggcgatctgcagatcgacgccgaacgtcttcagcgcgccgtttgcttcctggagttccttgggaacgtcgtatccgacgaccttgagcgaacctttcggattgtcacccgggatttcgggaatctcattctcggcacgtggtccgtcaaacgcacggaccgtcacatccacgcgttccgccagaactttggaaagctcctccgcgtgcacgcctgcgccgccatacaccttgggcggatattcacgggaaaggatgtcaaccttcatatctgtgctctcctcttcgagtcaggcagttgttccatcactactgtaaggcaatttttcaatgaaacgcctgattgtttcattcgtgtcacaaagttttgcatctttcctaaaaatgcaggcaaggaggtcaataaaccaggaacgaatagtgccgtcattcgtgactcgcatgtgaaagcggggctgcatccttccatcggatgcagccccgctttacgttcatcgccttgctatcagacggccgtaccattctgatcgaggttcggattatgcttcgggttacccgccgtgaagaacaggctaagcacaccgacagcgaagacgatggagaccgtggcgaccaaccacatgggatgtgacggcagccacatgatcaccaggaatgcgattgcggacagtgcgatgagcagccagctgatcacgcggaaccattggcgtgcggaatgcggtgccttgaacatcttcgggttcgtgtagttcgggctggtggtcagcaggctttcggtttcttcgatggtgccgccggtcggcttccaaggtccatcggtaccgtcttgcagtcggcgggacttttcctgcagctggtattcgtccagcattccggaacgtgcgcggccatgggtttggtcgtactgctgcggcactcccctgcggttgttctttgcctgcgctcgacgttctgcacgatttggcattgggtcactcctttgttgcgatgtgctgcagttcactttactgcatgactgccggtttttcgccgaacggcacgtcattcggacgtttatgccacgtctgtattgttcgaggttccgggaagtggggatatgaaaaatcgtccgattccgttttggcggagaatcggacgatttttctgttacgttaactgcttatgttcagcgcggcagcatcatcggccttttggatgcgacgatgggtgccggcagttcggtggcgccggtgaggtattcgtccacggcggccgcgcaggaacggccttcggagatggcccacaccacgaggctctgaccgcgtccggcgtcaccacaggcgaacacgccgtcctggctggtagcgaacttgtcgttgcgcgccacattgcctcgtccgtcaaggtcgacgggcagctggtccacgagcgtggtggtgtccgggtgcaggaagccgacggagatgagcaccaaatcagccggaatcacgcgttcggtgccgggctggcgggtgaacggtccgttttcgccgggtgcaacgttcactaccttgagaccggtcacatgtccgttctcatcggccacgaagccttcagtagcggtggagtgctccaccttcaccttggcctgttcctcttcggtaccgacgaagttcacagaatccgtgctgtacacgtactcggcgcgctgggtttcgaagccttcttccatggaggaggtcttctggtacaggcgcgcgaaggtcggccatggctggttggccgggcgttcgcttggttcctgcggcatgatctgcagcacagtgacgtccttggcgccttggcggatggacgtgcccaggcagtcggatccggtgtcgccgccaccgatgatcacgacgtgcttgccttcagcggtgatgtcgttgactggcttgacgccgtagacgcggcgggtcgcgtcgggcaggaattccatggcaaagtggatgcccttgagttcacggcccggaatcttcatgtcgcgcggcacggtggagccgatggcgacgaccacggcatcgtagcgggatcgcagatcgtcccatgagatgtctttgccgatctccacgccggtgcggaacacggtgccttcggcttccatctgttccacgcggcggtcgatgagtcgcttgtcgagtttgaagttcgggataccgtagcgcatcaggccgccgatggcgtcatcacgctcgtatacgaccacggtgtggcctgcgcgggtaagctgctgggcgcatgccagaccggacgggccggagccgaccacggcgacggtctggtcggtcaggcgctgcggaggcaatggcttgacgtagtcgagttcccaagcctgatcgatgatcgtgcattcgtcgttcttgatcatggtcggcggctggtgaatgccgagcacgcaggccgcctcgcacaacgcggggcagatgcggcctgtgacttcggggaagttgttcgtttcggacaggcggttgtacgcgtcctcccacttctcctggcgcaccagatcgttgaattctgggatgatgttacccagcgggcagccgctcatgcagaacggtgtgccgcagtccatgcatcgggccgcctgttcggtggtccaaggctgcaggccggattcggcgtggacgtcgaaccaatccttgattcgctcctcgacggggcgttcggccagttcgcgacgggtacggaccttcaggaatccacgtggatctcccatgtcagcgcgctccttccataacctgctcgtacacctgttcccagacgccgggcgtattgaaatcgatgttgttctcttcggcgttcttcatcgccttctgcatggcgaggaagtgcttcggaacgatgtgtgtgaatcgcttggatgcgttctcccagtcggcgagcagtccggccgcgaatgcggagcctgtttcttcggcatgctgcttgaccagaccgtgcacgatttcgttcgactcactgtcgagcggttcgaacagcaacgcgccgttggcggcggcagccgggttgacctgcttcatgtcaaggtcgagcacgtacacgtggccaccggagaagcctgcgccgaggttgcgacccgtgggaccgaggatcacgacggtgccgccggtcatgtattcgcaaccatggtcgccgacgccctccaccacgaaggtggcgccgccgttgcgcacgccgaagcgttcgcctgcacgacctgccacgaacatctggccggaagtggcaccgaagccggtgacgttgcccgcgatcacgttctcatgcggatcgaaggtgatgcccgcctccggacgcacgaccatgcgtccgccggaaagtcccttgcccgcgtagtcgttgacttcgccgtacacgcggatggtctcgccacgcggaatgaacgcgccgatggactggccgcccgcaccatggaacgtcatgtcgatggtgtcgtcaggcaggccttcctcgccgtaacgcttggtgatctcgtagccgaccatggtgccgagcgtacggtacacgttacggatcggcatctcgatgcgcaccggctccttcttctcaagggcgggctgcgcgagctcgatgagcttgttgtcgagcgccttgtcgagctcgtggttctgctcgatggtctggtgcaggatggttcccggcaccggtcccggctgcatgagcacgttgctcaggtcgatgccgtcagacttccaacgcttgatcgcttcgttctggtcgaggcattcgacatggccgacggcctcttccaaggtgcggaagccgagctgggcgagcagctcgcgtacttcctcggcgatgaacatgaaaaagttgatgacatgttccggcttgcccttgaagcgtgcgcgcagttcgggatcctgggttgcgatgccctgcgggcaggtgttcttctggcaggcgcgcatcatgacgcagccttcgacgatcagcgcggcggtggcgaaaccgaattcctcggcgccgagcagggctgcgatcaccacgtcgcggcccgtcttgagctcgccgtcacattgcacggtgatgcgggaacgcaggccgttgagcacgagcgtctgctgggtttcggacaggccgatctcccacggggtgccggcgtgcttgatggcgttgagcggagccgcgccagtgccgccgtcgtagccggagatcagcaccacgtcggcatggcacttggcaacgcctgcggcgatggtgcccacaccgaactcggaaacgagcttgacgtgcacgcgggccttcggattggccatcttcgcgtcgttgatcagctgcttcagatcctcgatggagtagatgtcatggtgcggcggcggggagatgagctcgacgcccggagtcgcgtgacgcaccttggcgatccacggcggaaccttggcgccaggaagatgtccgccttcgccaggcttggcgccttgggcgagcttgatctgcaggtcggtggcgtgcaccaagtagtcgctggtcacgccgaaacgtgccgatgcgatctgcttgatcttgctgtagcgcagcggatcattgatgcggtcttcggattcgccgccttcaccggagttggaacgtgcgccgatggtgttcatggcgatcgcgagggtctcgtgcgcctcctgggagatggagccatagctcatggcgccggtggagaaacgcttgacgatctcgctggccggttcgacctcgctgacgtcgatcggcttgcgaccggacttgaacttcatcaggccgcgcagcgtcatcaaacggttggaggtgtcgttgatgtgcgccgagtacttcttgaacatgtcgtagtcaccgcgctgggtggactgctgcagcaggaagatggcttcagggtcgttgaggtggtcttcgccggtacgacgccacttgtattcgccgccggtgcgcaggttgcggtgcgggcgggcggtccactgcgacgggtaggccacgcgatggcggatggcgacctcttcggccagttcgtcgagtccgacgcctccgacgcgggaggtggtgccggtgaagtattcgtcgatgacgtccttgttcaggccgatggcttcgaacagctgtgcgccacggtagctcatgatggtggagacgcccattttcgccatgatcttgagcacgccggtcgacaacgcgttggtcaggttcttcaccgcggtttcggcatcgacgttgagatagcccttgcgggacaggtcttcgacagattcgaacgccagatacgggttgacggccgccgcgccataggcgatcagcagagcgacatggtggatttcacgcacatcgccggcctcgacgaccatggagatctgggtgcgcgtgtgtctgcgcagcagatggtgctgcaccgcggaggtgagcagcagcgacggaatcggtccccacgtgtagttggagtcgcgatcggagagcacgaggaagttggatccgttttcgatggcttcgtcgacttcctggaagatctcgtcgagacgttccttcagcgccttgccgccgccagcgacctgataaagacccttgacgacgaacggcttatagtagccgccgaggatcttggcgcggtcgaggcgcttgagctgcgccatctcgtcggagttgagcaccggcaacggaatgaggatcttcttggcatgcagttcggaatcggccagcaggttcggctcgggaccgatggcggattcaaggcaggtcacgatcttttcacgctcccagtcgagcggcggattggtgacctgcgcgaacttctgggtgaagtagtcgaacagcatgcggctgcgggaggaaagcgcggccataggcgcgtcattgcccatggatccgagcggctccttgccggtgttggccatcggggcgagcagcagcttcagatcctcttcggtgtagccgaaggcgcgctggcggcgttgcacggactggccggagtggttgacgtgctcgcgcttgggcagctggctcatctcgacggtgttgccttcgacccactgacggtacggatgctgggacgcgagggacttcttgatctcctcgtccgggatgatgcggccttccttggtatcgacgaggaacatcttgcccggttccaggcggcccttggacacgatgtgttcctcggcgttctccgggagcacgccggtttcggatgcgagcacgatgtagccgtcgtcggtaagctgccagcggccggggcggaagccgttgcggtcgagcagcgcgccgacctgggtgccgtcagtgaagatgatgtgcgccggaccgtcccacggttcgatcagcgtattgttgtattcgtagaacgccctgacatcggggtcaagctggtcgttcttctcccatgccggcggcagcatcatggagatggcatgtggcatggaacgtccggacaggtgcagcagttcgaggcattcgtcgaacgtgccggaatcggagtagcccggggtagcgatcggcagcagcggcttgaattcgccgagcagttcggagcttaggcggccttcacgtgcggacagccagttgcggttgccctggatggtgttgatctcgccgttatgggccagctggcggaacggctgggccagcggccagctcgggaacgtgttggtggagaagcgggagtgcacgatggcgatcttcgccttcatgcgctcgtcggaaagatccaggaagaagggcttgagctgcatggtggtgagcatgcccttgtaggtgatggtgcgtgcggacagggacgcgaagtagatgcccacctcgtgttcgacgcgcttgcggatgcggaaggtcttgcggtccagttcgatgcctgcgagctggccttcggggtcggccacgaccagcgtcttgaacgcgggcatgctggcgagcgcctgcagtccgagtccgtccgggttggtgggtacgacgcgccatgcgagtacttcgaggccttcttcgcgcacgattttggcgatggcttgttcttgttgtccggaggtggcgatgtcgcggtcgaggaatgcgatgccggcggcgtagtggccttcttcgggcagttcgacgcctgcggtggcgcgcatgaattcgtcgggcatgctcatgaggatgcctgcgccgtcgccggtgttttcttcggcgcctacggctccgcggtggttgaggttgacgagcacttcgatggcgtcgtcgacgattttgcgttcggggcgcttgttgagggtggtgaccatacccacgccgcaggcgtcgtgctcggcgccgggatcgtacataccttgggaatcatggatcgtgagatctaacggggcgtggaaagtcaccgaaaccaccttcaatgtttttgggcaagaaaagtcttgcggttctttaatgcgtggtttagaataccgcgcccctgtatcaaatacgtttcgcgtgtccatataacgaatactcggaaaagtcaagactgttttttcttgggaaaatgtggaggatatgtgttgggttgtggtggttgccggtatcgatgcgtgtcgttatgctggtggttgtccgaagagtacaggggagccgatgtggctgagatgggcgtttgcccggacccttatgacctgaacagggtagtgcctgcgtagggatgttacgaacggtgcgcgtgcgcgtcttctctgtgctgacggctggtgtttggccgtgtgtttcgtggaaagagaagggatttggcgtgtctgatgcgtcgcaggtgcctgagcagcttggttcgggttcgaagaagttgactccgaagaatgtgctgctgggtttgcagcatgtgttggtgtccaatgtgtggcttgatccggtgtttgtggctggtgccattggcttgccgttggcgttgtcgtcaaatatggtgaatgccattttcattgtgtctggtttggtcacattgattcaggccacgaggttggtgcgtttgccgattgtgcagggtccgtccgccgcgttcgatgcgttgatgatcgctgcgggcactgctggttcgttggctgccgctggtacgtcgatttttgtcagttcgctgattttcttggtgctgtgtctgacccgtgtgattgagaagatgcgttttctgttcgcgccgatagtgtcgggcgtgattatttttctggttggcgtttcgctgtcgagtttcacgttgagcgagtttcttggtggcgctcccggcgatgatggttttgccgatccgaagacgttggccgtgtctatcgtgacttgcgtgctggtggtggcgctttcccagttcggcaagggtatggtcagggcgctttcctatctgattgctctggttgccggcactgcgctttcgatggtatttggcatggctgatttttccggtgtcgcgtcgaagccttggtttggtcttcctcagattatgccgtatggcggttttgactttgatgcggcggtgtttgtgccgttcttcatcgcatatatggttgcgattatggaggcgcttggcgtgtatcaggcggccagtgagatccagggcgtcaagcttgaggatcgtcaggttcgttatggtttggccggcgaggctgccggttccgcgatttcttcgatgatcggcggtttcaccactaccgcgtatccgcagaatgtcgcgttgcttaaggtcacggatgagggcaagacccgtacccgtgtgccggtgatcatcgcctgcgtggtatttgtggttcttggtttcattccgaaggccggagcggtattgtcgttgattccttcccctgtgatcggcggcattttcctgccggccgcggcaagcctgatcagcacgggcttcaatacgctgcgcaaggtggagtcgaacgaccgttcccaggcggtcattggattgtccctgctgttgggcatcgcgctgccgagcgcgttgagcggcttggagggcggcgctcacgtgttcttctccaattcgattctggttggggcgttctgtgtggtgattctcaaggcactgctgatcgacctgccgaatctgatcaatcgtcgtaaaggaaacagcgaagctgaagttccgtcgcagatctgatttgctttcgaatatcagtatcgtttatagaaaggaataccgcatatgacatcaatgtcgttgggtgccgacgcgcaggaagtcaaggcaaacgtgcttgagttcatcgaaaagtatggttgcgaggtcgctccggatgaggcgttcgacgcgctcgcacataagattttcgctttccagtttgcccataacatgcagtatcgcgcgtattgcatgtctcgtagggtgactccgcagatgttgtcggattggatggatattccgccgatgccggtggatgggttcaagatgctgacgctcacttcggtgcctgaagatgattgcgaggcagtgttcatgaccagcggcactacgcatccgggtcagcgtggacgcaactatcatcctgatcttgaggtgtgggatgcgtcgatgatcggcccgttccgtcatttcatcatgcctgaccgtgagcgcatgcgtatcgcggtgctctcccctgcctgggagatgaatcataatggttcgttggcccgttatctgacgcgtgcggtggagcagtgcggcagcgagggcagcggcttcttcttccatgaggatggtttggacttcgctggtgtggaaaagttccttgatcagtcggtggcagacggcgagccggtgatgctgatgggcgcttcgtccgcgtatctgtatctgcttgactatcttgccgagcggggcaaaacctatgcgttggcgaaggattcgcgtgttttcgataccggtggtttcaagagtacgaaaaccgatatgaccgtcgatgatttgtatgcgaagttccttgaggtgtttggcgtcgcacgcacgcattgcgtgaacatgtacggtatgacggagttgagttcgcagatttacgatcagaatctgctgtcgtactatacggatggttcgtcgaattatctgaaggcgacgccgtcgtgggttcgttccgtgttcctcgatccggcgacgctcacgcctgtcgccgatggcgagcagggggtgatcgcgcattacgatttggcgaattggaattcctgtctggcgattctgaccgaagatcttggcgtgcgcaccgattccggttacgagctcaacggtcgtgcgaagggtgcggaggcacgcggctgctccatcgccgtcgacgaggtgatggcggcaaacgcatgagcgtcatcgacattttccatgcgccgcgcggcttcgtatttgaggatttcgaaacacgcggcgttctcaccgaccgcggtgaggtcacgttgcgttatccggtactcacgcctgagactgtccaagatttgtgcgagacaacgcgttgcaatcgatcgcagacattggcagcatattccgtcgaacacatcgtcgacatcatcggcgaggcggtggaattgtggacgaatcccgattatgagggtcgccagatagcggagtctctgattccctccatcaccggctatgacgcgacgatgacgcgtatcgaactgaaacgttacatgcgcatgttccgcagacgcgaactattgcgttttcttgatgacgaactgccaagcccgcgcatgctggacgaataccgaccgaacaagtccggcggatacacgcgcctgtacgggccggacttgacattccacgtgttttccagcaatgttcccggcattcccgtatggagcatgaccatgagtctgctgacgaaaagcgcgatcatcggcaaatcatcgttcgacgaaccgctgatgcccgtactgttcgctcgttctctgacacagatcaacccggatctcgccgacgtattggccatagtgccgtggcgcggcggcacagtagagcttgaagacgtggcgatcggcgaagcgaacgccgtgatcgcctacggttcgtcgcacaccaccgaggcgatccgtccacgcgtgagcgcgggcaaaccgttcctcagctatggcgcacgcatcggcttctcactcatcggacgtgaagcgctacgcgcggacactcacgtgcaaaccgtgcaccgtatggccgtggacgtggccacctacgaccagcaaagctgcctggcgccgcaaaccatcttcgtggaacgcggcggagccatctcccccgctcagacggcggaactgctcgccagcgagctcgactcgcaacaacgcaaatatccacgatcaaccccttccgacacggaatccctcgccatccgcagggcacgctctcaaaccgagatgcaagcgctgttcatgacgtccatgactccagacagcgccgcacaggccgacccacaggcaccgttcgtcatcgaatcgccgcaaggcaccgactggaccgtgctttactaccccaataccagcagtctcccctcgttggggacaccgctcaaccgcaccattaacatcgtcgccgtggaccaactcaaacacgcgctgcccacactgaaaccctaccgcgagtggctgcaaacctgtgcgatcgccacaagctcatccagactgttcgcactcgcgcaacaagtgggcgaatacggcatcgaccgcatctgccccgtcggagaaatgaaccgcgcgaaatccggatggcaccacgacggcggattcaacatcctcgacctcgtcagagccgtcgacatcgaacgcaacaccgaccgttacgccgacaccttcgacatcgactacgaataatcccaaaggaccttacgtgaaccagcaatccgaacaccggacactcaccggcaaaaccgccatcatcaccggcgcaagccgaggcatcggcgccgcaatcgcactcagactcgcacaactcggcgccaacgtgaccatcgactacctaagcaacgacgaacgcgcccaacacaccaagcaacacatcgaaaacgaagcggacgcacaaggacgcgtcatcacatgcaaagccgacgtgaccgacgaaacccaagtcaacgaactcgcacaaaccacagccaacaccttcggcggcatcgacatcctcatcaacaacgcgctcagccactactcgttcgacccacgcaaccgcaacaccttcagcaacaccagctggaacgactacgcgacccaactcgaaggatgtctcaaaggcacctacaacacctgcacgaccgcgctgccctacatgcgacgccaatcatggggacgcatcgtcaacatctccagcaacctcgtagacagcccgatcgtcccctaccacgactacatcgcagccaaaggagcactcatcggattcacgcgctcgctggcgcaggaggccggagcgtggggcgtcacggtgaacgccatcgcggccggtttgactgtgggcacggattcgagccgcgccaccaccgaagacgtccgcgagcgcatcatcgcgcagacgcctttgggcaggcttgccacggctgatgatattgcgggcggtgtggcgatgctggttggcgaggacgctcgtttcgtcaccggtcagacgttgcatgtcgatggcggactcacgatgcgctgattacgaacatccggtgacagcctcgttctaagctctatgccatcgggcctggaatgcaacaacctgcatccgaggcccgtttcaatctgcacactgtatccacccataccaagatggatcatctaaaaccaattcgtcagaggattatcggcattacaacgagcaggcgtcgaagaaacgctcgatgacggtgtcgttgagcaagcgtccggttcgggttggaatcacacgtccgtcacggataacgataaggccttcgtcttccatgggctggatgcgagccatatcaaccatgtttccaaggcgactcaaatccagaccctcacgtatgcgcagaccaagcatgatgatttcttcgaggttctcctcgttggagattcgttcgcttcccgaccatggcacattatcatcgttgatagcctgcccccacatgcgaggatgcgcaatatcccagctgcgcaagcccgacgatttgaccgtttcagatgtttcagccgacgtggactgttcaacatccatcacattgccgtaatggctgtgtgcgccgggaccgagccccgcccaatcaacattgcgccaatagccaagattatgttgcgattcataaccaggacgtgcccaattgctgatctcataccattcaagaccggctgcgctcagtagatcgtcggcaatctcatacttggtcgcctcatcgtcatcatcaggcgtaggcaaggttccaacagcaatctgacgtcccattttcgtgttcggtgcgacggtcaacgcatatgccgaaatatggtcaacacccaagtcgatcgccgtccgtacggaaacacgccaatcgtcgagactctcccccggcgcaccgtaaatcaaatccacgctggaacgcatgccggcagcatttgccgctgcgattcccgccgccacattggccggggtatgcgtacgatccaatgttttcagcacgcttggcacagccgactgcatgccgaaagagatgcggttgaatccgccgtccgcgagttccttcacgtaatcggcgttcaccgtgtccggattcgcttcggtggtgatttccgcattgtcggcaatgccccacgtgtcacgcacggcattcaacatggcgaccagatccgaggctttcagaatcgtgggagtgccaccgccgaaaaagacggtggccgcttccggttcgttaacgccatgcgcgatctgccaatcatggacgattgacatctcgcgaatcaccatattggcgtaattgccacgcgaagcgcccgctcccatgtcgacagcggtatacgtgttgaaatcacagtacccacagcgccgtatgcagaacggcacatgaatgtaggcttcgaacatcagccttcggttttctgggcggcgcgaatcttgtctttggtgtcgcggtcgttgcctgcgtctccggtcgacaatgcggcgatgaacgcctcctgcggcacctcgacatggccgagcatcttcatacgcttcttgccggccttctgcttttcgagcagcttgcgcttacgggaaatatcgccgccataacacttggcgagcacgtccttgcgcagtgcgcgaatgttctcacgtgcgataatgcgggagccgatggcggcctgaatcggaatttcgaactgctggcgaggaatgagctcacgcaacttcttcgtcatcatcacgccgtaggaatacgccttatccttatgcacgatggcgctgaacgcatcgaccttctcaccctggatgagaatatcgaccttcaccagatcggcggactgttcgccgtcctcatggtagtcgagcgacgcatagcccttggtgcggctcttcaactggtcgaagaagtcgaacacgatttcggccaacggaatgcgataatgcatttccacacggtcggcggaaatatattccatagtgcccatctgtccacgatggtcctggcacaagtccataaccgcgccgatgaattccttcggagtgatgatgtcggcggcaaccaccggttcgacgatctgcttgatcttgccgtcggggaattcgctcggattggtcacacgatgcacggaattgtcttccgcggtgacctcgtatggcacgttcggtgcggtggagatcaagtcgagatcgaattcgcggctcagtcgttcggtcacgatttccatatgcagcaggccaaggaagccgcagcggaaaccgaaacccaacgccacggacgtttccggctcgtagatcaaagccgcgtcgttgagcttgagcttgtcgagcgcctcacgaagttccggatactgcgcgttgtcgattgggaacaggccagcgtagaccatgggctgcgggtcacgatagccttcgagcggatcggccgcaggcttgagcgcggaagtgatggtgtcgcccaccttggactggctgacgtctttcgcgccggtgataacataaccgacctcacccgcaccaagcgccttcgtaggcatcatgtctgggctgatcacgccgatttcaatcggatcatgggtcatgccgatacccatcatgtgcagtttctcacgggaacgcaactcgccatcgaccatacgaatgtaggtgacgatgccgcggtaggagtcgtagacggagtcgaagatcagcgcacgcgcgggagcttccggatcgccggttggtgcaggaacgtcggcaacaatgcggtcgagcagttcggtcacgccttcaccggttttaccggacacgcgcagcacttcggaaggatcgcaaccaatcagacctgcgatttcctcggcatgcttgtctggttccgcgctgggaagatcgattttgttcagtacaggaatgatggccagatcatggtcgatggccatatacaggttcgacagggtctgcgcttcgatgccctgcgtcgcgtcgacaagcagcactgcgccttcgcatgcggcgagagcgcgggaaacctcataagtgaaatcgacgtggcctggagtgtcgatcatgccgagggtatattcggtgccgtcgaacgtccacggcacgcgcacagcctgcgatttgatggtgatgccacgctcctgctcaatatccatacgatccaggaaacgatcacgcatctcacgttcgggcacgatgccgctgagctgcagaatacggtctgccaccgtggacttgccgtgatcgatatgcgcgatgatgcagaaattgcgaatcaacgactgatcggtgaaaccgggctggttatgctgctggcccacgccatcctcctcttgaaatattcgacgcaaacgattctaactgctagtatcggcatggtgagtcgcgacactcctaagcccgttggcaatttatccgcgcgccatgttatcatcatcgtttgtatgtccttatagaaaacgtcgtttggagaaatagtggcaaacattaagtcgcagaagaagcgcgttctcaccaacgagaaggcccacaagcgcaacgtggccgtgaagtccagcctgaagactgccgttcgcgccacccgtgaagctatcgccgccggcgataagtccgcagcagaagccgcctacaaggtcgcagctcagaagctcgacaaggctgctggcgctggcgtgattcacaagaaccaggctgctaaccgcaagtccggtcttgccgtggccatcaacgctctctgagttttagaagctcacagctaacgaaaatcccgcaggtttttcctgcgggattttttgttacgcaaatgtcttccgtttaattaccatctcactgtcgctacctacgcttgtcacacttgcgtttgtcggaatccttatcagaatgaatgaccggtcgtttcaaatatttcgcttcacttggcagatatgtattatgacgcaccaacgctcccggaagctgaatgtcgaaaatcaccgataccaatcgcatgctgaccatcaatgcgacgatcagcagatcaagcaccacttcggctggaaaactgacgattccagcgtccacgcctttgcagacaagcaccgtcagtacgcaccccacggcagatggaaccgcataccaatgtttgtcacgaatcaccatcggcacttcgttgatgagcatgtctcgaatcaggccacctccaagcgcggtgaacatgccgagaaaaaccgcggtcatgcctgacgtgtggtacatcatggctttgctggtaccgttgaccgcatacaatcccaatgccagagcatccaacgacagcatggaccatttgagcctgttgatttcgggatggcacaccgcgacggccaccgaagccagcagagcaacgatcaccagtcctttatccgacacgcctaccggtggcgcgatgcccagcagcacgtcacggatgattcctccgcccaatgcggtgagccatgtggtgacgagaatcgcgaagatatcgtagcctttgcgcacggcggcaagtccgccgcacatgccgcagcagaacgtcgccaaatattcaatcccccaaaagaaggcattactctccaacgccaccgacatgctttcccatccttttcccttccctcacttcccccactctcggatttcgcgacttcccatcgtacacaataagccgaggggcggggaacatggtgttcgaccgtaggcttggccgaacggccttgagtgtgccgaataccatgttccccgcccctcggcggactttgaactataagtcagtcgcgaaaaatcagcagaccttccacatccagttgtgcggatcctcgatctcgccaagctggatgcccagcagctggttgcgcaggttcacggtgaattcgccggagttgccgtcggcaacggtcacgtcgaacttctcggacttgaaacgaccgatcggggtgatgatggctgcggtaccgcaagcgaacacctcggtgacttcgccggacttgatgtcttcgagcaactggtccagagcgatcatggtttcgaccacgtcgtggccgttgtcctggatgagctgaatcagggagcgacgggtcacgcccggcagaatgttaccggtcagagacggggtctctacgtggccgtccttgtgcacgaccatcatgttcatgccgccaagctcctcgaggtaggtcttggtagcggcgtcgacgaagcagacctgctcgcagccgtggtcgatgccggtgtattcgcccagcagggatgcggcgtagttgccaccgcacttggcgaagccggtgccgccagggccggtgcggaaccacttgtcttcaacccagatgctgaccggcttcacgccgcctgggaagtacgggccggacggggatgcgatcacgcagtagtccacttcctgcggagcacgcacgccgaggaacggctcggaagcgaacatgaacggacgcatgtacagggtgtactcgcggcgggtcggaacccagttcacgtcacgcttgacgagggcggccacggaaccgatgaaatcgtcgatcggcagttccggcaggtacagacgcttggcagagttctggaaacgctcggcgttcgcatccggacggaacagccaagtggagccatcggcatgacggtaggccttcagaccttcgaagcattcctgagcatagtgcagaacggatgcgcccggatccatcttcagcggcgcatacggctcgatgcggcggtctccccagccttcgcccttggtccaagtcatgtgggccatgttgtcggagaagacctgaccgaatgccggcttgtcgatgagttcggcacgtttggcgtcggatgccgggttgtcgttcgggagcacggtgaacttctcggtgagcttgtcaagctctgccggatcgtgatgattctgttcagtcattctttacttcttcttgttgcagccgcccgaaagcggcccgcggttgttggtatcccagtgcttgtggcaccggttctggttagtaactttcccacatcataatctctttcgattacaagcgttcgcgatatgagataggaagaaacatcctgcgaaaaagtcgccgccctcacgcctgattgatgctccatagactcggaacgtattctgaattgttcaaaaaatgactgtgcctcattccccaaaacaccattatgacgttcaggtctctgacagcgggatgtgggtgagaatgatggggcgagtagtttcgacgtcgtagcacaacatgccgctgtcgcctattggggtgaggagacttcatggcggaaggcgctggaaacgcagccttcccaacgctcgtcgcgttctgcgtgttccgttcgtcgcttccggtcatgctgcgatcctttcgggtgaagcatgcaagccaaccctccgatgtattggcggatactcgaaaaagcagtaccaccgtcattagacggggcaataagattgttggcgtcacgatgcttgtttcagcggcgttctcccggattgcggatctgcatggccgcgccgtcttccatgattgagaagccgtgcttctggtagaaggtggcgttcttgctttcttccggcatgacttcaatataaaggtagtcgcgatatctctctttgaccatgcccaccaggtggcctgcgatgccatgaccctgatattccggatcgaccagcacgtaatgcatataagccaccatctccgtgtcatcgagcacgcgcaccaagcctaccaagcggtcgccgtcccatgcgctgaacacggtggacgatcccatcagagccttgtacagacgttccggatatttgcctgacacccatccgacggatcggaacagttgctgcgtccgttctttggtgaacttcttttcatcggtatacgtgattcccatagccccgagcgtggttgcatgctacgcgcggactgaagccagtctctgcattcggacgtgattttggaatcacgtttacgttggctcaggccagccagtaaccgcacgcaacggccatgacgggcacgacgatcgaagccagcgcatagccgatgaaacaagcgattttcccattgcgcaggagcgtaaccgtctcgttcatcatggttgagaacgttgagaaaccgccgagaaatcctgttgcgagcagtaggcggcagtcggggcttatggtgttcgccgcgaacaatcccgccaccaagccggcaagcagaccggccacaacattgatggcaaacgtcgaaagcgggaacgttttgcgccacaatgccttgatatacgaatcgcagatatagcgtgcggccgcgccgacgccaccgcatgcgcatacgccgatcgcaagcattgcgctcatcgaatcgcctccttgtcagcatgttcgtctttgtttcgttccgccaaccacgaaccgcataaggcaccggcgtaggcgagcgaaaaaccgacaatgaacgttgcgcagcaataggtgaggactctgggaatcgcatgatcgtcaatcatcatgaattcttccaatgcgagcgtggacatggtggaaaggcctccgcacatgcccatgccgaatccacgattcacgtattcttttgcacggcctttcaacaggctggaagatcccagccatgcggaaagcgccgcatatacgaagcaggccaccatattggccgcgaacgtaccgacatggaagccgcccacgtccgcaatggacgagctcgcataccgcagtcccgtgccgacgcatccgccaaggaataccaccgtcaccacatcaagccgaataatatgcttattcaaatgtttctctcttccgcaccgtctcactttgtctctcgtgcattgtttccatgcatcgtcagtcatgctagtcgttattcgattggaatgctgatgcatgtgacgtatttgctggaatcctgcgtcagatcattgtcgatcagtgtgatctcacgtgggaagcctaccaccgtcaaatgatgattctcgatatagtccattaatgtgcggcatcaggatggctgccgggaaaacggatcgtcacgcagtccgtctccggcagtacgcaatcgctcccttcgtacccgacagtgccatacgggttcactgaacgtataggcgagtataatccgtatccacccgttgtatcaatattgcgtaaggaatgcaggatttgccgtcagtctcttatgtcttccagctcatagaacgggtgttgccgggtatgaaaaagcccatgtgcgtctgagcacatgggcttttcatcatctcttacggttgttcaaaaccgtaaaatggaagtttgcttccttaagctatctgaactcactcagcgttttcagccggagcggtttcgaccggagcagcctcatcggcagcgtcttccggcacctcgacggtgacgacggactcttccggatcctcgacgtcgagcacaacgccttccggcagcacgacgtccttggcgaagaccttggaaccgtcggtcaggccgtcaacgttgaccacgatcttctccggcaggttggcgacatcggcgcgaaccttgagctcctgaatgtcgacgaatgcgacggcagcgcccttcggggtgccctcgacgaacaccggcacctcgacgtcgatcttctcgccggccttgacctcgtagaagtcaacgtgctcgacgatgcgcttcaccgggttgcgctgaacgtccttgacgacggccatcttggtctcgtcaccgaacttgatggtgaacagagcgttggtgtgacgcagggacagggtggtttccttcatcggcagctgcacgaagaccggctcttcgccgcctgcgtacacggtggccggaataaggttggcgacgcgcatgcggcgggcagcgcccttgccgaactcggtacgggcagcgccttcgagggtaatggtggtagccatgggctatttctccttatgttttattcgttcattctgtttcggcgcatcaacgagccgtgaatcaacccacaaggagcctacaatcacacgccgagtcgattacggaagccatacgcttccctcgccaagacaacagttaactagtatacggcgagggcggacattatcgaaaaacgtctcacatcaaaaatgaaaaaatctgtcaaagcccacgaaaacgccgtacgcacgtacaatcgatagtaattgtgaacaatccgtcaatcgcaaggaaacgagacagcaatgaagcatgacaatgacacaatcgttcgcgacatttgcatcgccacgggagccgtgacggctgcctgtatcgcatcgttggctacgactgcgaaatacctgttccatttctgcatcgatacgcaatggaaacgttccgttttccatcaatcgctgattgcgccggagcgtatcgaaaaacttcagcagggtgaggcacaggaagcaggagaatggttcgcgcaagccaaacagcctgtgacgattaccagcgatgatggacttcgactgcatggatggctgttcgatccggattgcactgcgccaaaaccacacctgtacgcaatctgcatgcatggttataccggtgtaccggaggaaaccgcgaaatgggcacatcgttacgcccgcatgggcttcaccgtattggttccgtcacagcgtgcccaagacttgagcgagggacggtacgtcggcatgggctggcttgaacgcaatgatctactgaattggatcgaccttatcgcgtcgagtgacgccgacgcccgtatcctgctgtatggcggttcgatgggcgcggcaacggtgatgatgacgacgggagacccgcgtctgccgcgcaatgtggtgtccgcgattgtcgatagcggctacacgtctgcgcgcatggtgttcatcgacagccttcggcattcgtcgcgtctgccgaaaccgcttgccgcggtatgtgtggatgccgcgggattgttctgcaaacattatgcagggtacgatttttcggaagccacctgtctgcagtcgctcagacatactgtcattccgatgctgttcattcatggcgaacaggacgacatcgtgagctcacgttttctcaagatcaattacgaagcgtgctcgagcatcgatcgagaaaagctcatggttcccgacgcacgccatatggaagcatccgtcgtggatcccgaactgtattggaacaccgtcaatgccttcatcaaacgcgcattcgaattgtgagccatgaaaactgtgtcaaggttcacatgagattttcctcatgcttatccccaaggtgaacatacacaatgttcatttgttggaaaatccaatgaaatcaacggcttacccacttctgccgcctcccggcacgctcaaggccacggaatacttcaccattatcttgttgtttgttcgtcgcagggcgaacaaacaacagagaggaacgaatattacatggccaatcaacatccttggcatgtcggccgtcttccttggacccttcgtcgaaaaggacatcaagaaatcggctttgatctcaacggtctgcttcgcctgcaggttcgccggtaccggagccagtatcgcggcaggatgcccccggcgtgctcatcttctatggcgtaatcatgggcattggattgggcgtcggctatctgacgccggtgaagaacctaatgctgtggttcgccaaaggtctcgccaccggcatcgccgtcgcgggattcggtctggccaaggccatcgcgggaagcatcagcgtcatcctgaccgtcgatgccgtgttcaacgctgccggtgctgcttgagcagcactttggcatgaagtcagtgtccaccgtgcacggactggctttgagcgcgtgggcgttcgccggattgtccggcaaccagttggcatccttcgtcgtctctcatgcgacggatgcggcccaccgatacagcgcgctgattccgatcatcaccgtactgtacgccgtcgctctcgcgtccatcatcgccgtgacgctcgccacgaaaggcaagggcgccaacgccttatcatcacgttgagcggcatgatacatcgttcaacacgctgacacggcggatgagcccatcaacgccttatgcggatgttctgggcattcgcttgttagccgccctgcgccggggaacagactttggttccgctccccggcgaacttcttcccattgatatatacgatgtatatgattccttcctttcccaatccatttccccgtattccaccgcatcgccttccgattcacgtacgctgacggtagccgtgaaaaacaatggcatcccctccgttgcggtcgaatatatggatcagataccacaattgcagcaataccatgacgaacaaggttcccctgcccgcgtgttttccgccacacaggtactgtagtgggtatggaacaatcatctggagctttcccgccgtcccgcatcgaagtgcgcggtgcctgcgtacataatctcaagaacgtcgacgtcgacattccgttgaacaaattagtcggcatcgccggtatctccgggtccggaaagagctctctcgctttaggtgtgctatacgctgaaggatcccgacgttatctggaggctttgtcgacgtataccaggcgacgtctcacccaagcgagtcgagcgcaggtagtcgacatacgtcatgtgcccgcggctctcgccctccatcaaagaccttcagtgcccggcgtgcgttccacgttcggcacgatgacggagctgctcaacagtctgcgtctgttgttctcccgttgcgcctcacatgtctgcgagcattgtggcgaacgcaaccgtcccacaatgaacgtggcggccgagttgcctatacgatgcacatcctgcaatcaactcatgcacccaccatccgccgaacagctgtcgttcaattccgccggcgcatgcccgacctgctccggaacaggcatcgtgcgaaccgtcgaccgtgcttccctggtaccagacgagaccaaaagcatcgacgccggcgcagtattaccatggggatcgttgatgtgggatctgatgaagcaggtgtgcggcgcgatgggagtgcgcacgaacattccattcaaccagctgaccgacgccgagcgggacatcgtgttcaacggcccggccgtcaagaagcatattctatacaaaccgaagaaaggcaatgatttcgccgaacttgacttcacgtacttcaacgccgtgtataccgtggagaacgcgctcgccaaagccaaggatgagaagggtatcaaacgcgtgtcgagattcctcagcgagcaaccatgtccggattgttccggtacgaggctttcacagcaggctcgtcaaccgcagattctcggtattaatctggcacaagccacggcgatgacacttgacgaaacgatacgttgggtgcgttcagtacccaagtcattgccgcaggagatgcgtgcgatggccacagccatctgcgaatcgttcgaggatacggccgagcggctcgtggaactcggattatgctatttgtcgcttgaccgcgcaggtgcgacactgtccaccggcgagcgccaacgtgtgcagttggcccgttcggtgcgtaaccgcactacaggcgtgctgtatgtgctggatgaaccgtctatcggattgcatccggcgaatgtggatggactgttgggcgtgatgcgcgatttggtggctgacggcaattcggtggttgtggtcgatcatgatacccgtgtgcttgccgcgatggatcatttggtggagatgggtccaacggccggtgccgaaggcggtcatgtgatcgctcagggtgcggtggcggatgttatgacggcacctggttctcagatagcgccttttctgcgtgatggtggcaaaatacatgagcgggcgcggccgcagattgacttagatgcgatgttcgccaagggtcggattcatttggagacgaataccgtgcatacggtgcatccgttattggtggacattccgcgaggacgtctcactgtggtgtctggcgtgtcgggttccggtaagacgacgatggtattggagacactggtccctgcgttgcgctcggccgctgatggtaccgtttccccgagctcgattcgtctgattgacgcggatggcatttcgaaagtggaactgatcgatgccacgcccattggagcaaacatccgttcgaccgtggcgacatattgcggtgttcacgatgatctgcgtcgtgcgtttgcgaagacttccgatgcccataagaagaatctcaaacctggcgcattctcatacaacacgggcaagttgcgctgctccacttgcgatggaaccggtaccatttcgttggacgtgcagttcctgcccgatgttgacgtcacgtgtcccgattgccatgggacacggtatgcacagaccgccgatgacattcgattggtttgcgcggacagcgtcgcccgttcactgccggaattgatgttgctaagcgtcgacgagatgatgcctctattggatttcctacgccccgttcgatcgaaactggccacactgcatgagcttggcctggggtatctgacacttggcgagccgactcctgcgttatcaggcggcgaagcgcaacggctgaagctggccagcgaaatgggacgcggacagtccgattcggtattcgtgttcgacgagccgacgatcgggctacacccgttggatgtgctggtattactacgcgtgttcgactcgttggtggcttctggggcgacagttgtagtaatcgaacatgatcttgatgtaatcgcgaacgcggattatctcatcgacatgggtccgggcggaggcatggccggcggtcgcatcgtatgcgagggaacaccggaaacggtccgtgcctgtcctgacagcgtcacgggcagatatctgcgtggatgatccgacgcgaactcgcccgtgacggtttcccatagctgctttcctcggggttgtctgggatacagtcagaaatcccagtcatcgtcgtcggtctcgactgatttgcccattacgtacgagcttcccgaaccggagaagaagtcatggttctcatcggcgttcggacttaacgcggcaaggatcgacgggttcacgtcgcagatctcttgtgggaaaagcgctggatatccgagattcatcaacgccttgttgccgttgtatcgcaggaacttttcgacatcttgcgtcaatccgacaggctcgtagaggctgcgcgtgtactccacctcgttgtcatacaactcgttgagcaggtcgtaggtgtagtcgcgcagttcgccgcgtttgtcctcgctgacccgctcaagccctttttgatatttgtatccgatgtaataaccatgcacggcttcgtcgcggataataagacggatcacgtcggcggtgttggtgagtttggcatgcgcggagaaatacatcggtagatagaagcctgagtagaacaggaacgattccagcagcgtggaggccactttgcgcttgagtggactatccccctcgtaatagtcgagcacgatgcgcgctttcctttgcagatactcgttctcctcactccaagagaacgcctcgtcgatctgtcgggtggaacacaaggtggagaaaatcgaggaatagctcttggcgtgcactgactccatgaacgcgatgttcgtatagacggcttcctcatgcggggtaagcgcatcgggtatgaggctgaccgcgccaacggttccctggatggtgtcaagcaaggtgagaccggtgaacacgcgcatggtcaacgtatgctcggcctcgctcattgtgcgccaaacaggcaaatcattggagacgggcactttctccggcagccaaaaattgccggtcaacctgtcccatacctcaaggtccttgtcatcctcaagtttgttccagttgatggcactcacacggtcaatgagcttaatcctctgtcgaggtacggatatcggcgccatgatggtcgtcctttctaatcgtcgtcttatcgtcgcggccgtataaccgcctgtattcgtccggagccgtcagacgaagcatcgcgcggtaaaccaaacgagacatgtcttttcttttcctttcaagtcacaggtttcacaacatgcaactgacgcagccttgtacttcggtgccagacaacgcctgctgacgaatgcggatgtaatacagcgttttgatgcctttgcgccatgcataaatctgcgccttgttcaaatctcgggtagtcgccgtatcggggaagaacaaggtcaacgacaggccttgatcgacatgccgcgttgcctcggcatacgtatcaacaatggccttccatccgatttcgtacgcatccgcgaaatactggagattgtcgttggtcatatacggagctggatagtagatccgtccaatcttgccttccttgcgaatctcaatcttcgaggcgataggatggatggaactcgtggaatgattgatgtacgaaattgacccggtgggcggcacggcctgtagatattggttgaagataccgtcacgtatgatgtcgtcacgcagacgacgccaatcatcctcgtcggggatatggatgccccgccgtgcgaacagcgacgcgattttcccggtcttcggcgccagcgagcgctcgccgttcgtatatttgtcgaaatagttgcctgcgcctgcaggcttcgcataggcggaccgttcgaagcctgcaaaccgtgttccgcgttcgactgcgagctcatgcgaggcacggtaggcatggtatgcaacggtcatgaagtacatgtcggtgaagtcgagggcttccggtgaaccgtacatgatcgattctctggcaaggaatccatggaggttcatctgtcccaggccgatggcatgaccttcgtcgttggcgcgtcggatggatggcacacacgcgatgtccgtatgttccgacaccgaggtcaatgcgcgaatcgcacgttccacggttcgtcccaaatcaccgtccatcgctttggcgatgttgagcgatccaagattgcaggacacgtcacgtcccacgtgattgtaggacagatcctcatgataggtgcttggctcctgcacttggaggatctccgagcacaggttgctcatggcgattcgtccgtcgatcgggttggctcggttcacagtatcttcgaacaccatgtacgggtatccggattcgaattgcaattcggccaaagtcatgaagaactctcgtgcgtcgatgtaggttttcccgatgcgttcatcgtccaccatattccggtagttttcgctgatggagacatcggcgaagggtctacccatgacgcgttcgacgtcatatgggctgaacagggccataggttcgtgtctcttcgccagctcgaatgtgatgtcgggtatcactactccaagagccaaagatttgatacggatcttctcatccgcgttctcgcgtttggtatcgaggaaatgcatgatgtccggatgatgagcgttgaggtacaccgcaccggcaccctgtctagcgcccaactggttggcgtagctgaaagagtcctcaagcagtttcatcacaggcacaacgccgctggactggtgtttgatgcgcttgatgggcgcgccggcctcgcgcagattgctaagcaacagcgcgacgcctccacctcgtttgctcaactgcaatgcggcgttgatgccacgcgatatggactccatgttgtcttcgatacgtacgagaaaacagctgaccgcctctccgcgctgcgccttgccgaggttgaggaaagtgggcgtcgccggttggaaacgtcctgatataagttcttcgaaatacgattcggcggccgcatggtcgccggcggcaagcgcgagcgcaacggcggccgcgcgttgcgggaagttctccaggtactgtttgccgtcaaaggttttcaatgcgtatgagcggtgaaacttgaaagctccgaggaatgtatcgaattcgaatccgcagtcatccacgttgcggtagaacctgtcaaggaattcggcatcatattgggcaaatacggattcgtcgtaatagccgtctgcgatgagccggctgagtctgtcttgtgtggagttgaaacggacggtgttcggcagcacgtgcttttcgacgtactcgcgtacggcttggatgtctttatcaaattggatgcgcccctgcttgtcgtagagattcagcatcgcgttgagcgagtgccagtcatgggcgcgatcgtaggaggctatgacgtcggttactgcgtgtggtgtcgttgaatcttctggcatggttatcgttgttcctgttgtgtgtattcgtcgaaaaatctgcgcagtccttcgcgcacggtcgcggtgtcttctgaagtgcccatcagttcgaaccggtagagtagcggcacgcggcatttagccgcgatgatgtcgcctgcgatgccgtaggcttcgccgaagttggtgttacccgatgcgatgacgccgatgatgccactgcggttgcgttcatcattgaggaatcgtttgacttgcacgggcactgctttgccgattgttcctccgccgtatgtgggtgtcagcaagacgtagggctcatccacatgcagctccggctcgtccggccgcagcgggatgcgcattgtatgaatgccgaattcatccaatcggcatccttcgacgaagcgtgtcgtattgcccgatgccgacgagaagtacaccaacgcactcaccggcagcgagcctccagctcgtggattttgtcgggacgatacccggaccaggattcgtcgtctgcgatgatgactggcatctgccgccatccttcgttccgcaatctgtcggaaatacgtgcgttggccgtaatgtcgacagtcgtatagggaaggcctcgtttgtccaattggcgtttcgtcgccgtgcattgcgggcagtttgctttggtgtataacgtaatgttcatgttccacgtcctttcacgaccgtacgtcgttggtatgtggcacacattatccgaacgaaaataaaaatcaagaccacaacatacagtgtctcgtcacattttcaaacactatatacggcgtgtttccagtattggcaacagttttgaagttctagagcaggacgtgggccggatttgtgggatttttcacatcggatgcaatcgttcttcaccgaaagccccatgccataaaaaggcatataggaaccagggtcttattcccttcgggaacccagccgtcactcactcaagttgaccttggacacccaatcatgcaccaaccgcagaaaagacagacatcccgcaccccggcaacgcagattcaggtttcttcgcagaaatctgcagagattctttcggtacctcttcgaccgagctgggaagtgtccgacataccacaccgaccaacggtatgtataatgtcggtgtattcgactccatcatcgaaggagaggcatatggcgcgcaatgcgcaccctgaagtgacacgacagcgaatccttgacgccgcgaaaaagctgttcgcgcaaaaggggtatgagcgcaccacgattcaagatattctcgacgagctcgaagacctcagcaaaggcgctatctaccatcatttcaaaaacaaagaagcgatgctgcatgcgctggtagattccgacaacgaacgacttcttccccaggcaaatcaagaggatggctcacgaaacggattgcagaaactacgcaattcgctcatgatgcagattaccgacaccgaacatatgaccctcatgcgcgatgcgtttcccctgctgaacgacccgaaaatcctcgccgaaaatcttcgcatctggcgaaccgacagcaccaaaatcgcatacgacttcatccaggaggggttaagggacggttcaatcacaaccgaataccctcaagaagccgcggaacttttttcactgctgttcaattactggctagccccaaacttctaccccatcactaccctaagtgaattcaagcatcgcatccactgtcttggattgattatggactcgctcggagttccacttatcgatcacgacagtgatatggaagatcggcttgcggaaggcttcttcctactcgccagtaatccgcaataaaagctcggcaatgtcaatctatctttatttgtacctttttttacataccgtcagtcggtatcgaaaggaatagtcatgaaaaactcgtcagcaaagacactccaatccagcttgcgctccgcaaacttcatcctgcttgtactcggtcaaggcatttccttgttcggcaataccatgctccgatttgccatgtccatgtgggtactggacgaaaccgcatcatccacgaccttcgccaccgtgctggccatatccgtcattccgaccatacttattagcccattcggaggtgttatggccgaccgagtaagcaaacgtgccatgatggtggcgctcgatatcatctcaggaatcgtcacactgctcgcgactgtgtttttcgcactatccggattcaacattctcgccatcgccatcatgcaggtagtgttggcagtactcgatgccatggaaactcccgtcgtgcaatccgcactgccacaaatcatcggaagagagtcctccactgatcttcgccgaggcgcggccatcatcaaccaagtgcagcagctcagccaattactcccgagtttcctaggtggcgtgatgtacgggctggtcggcattcgaccgatgatgctcatcaccgcagcatgtcttatgtcggcagccatggttgaatgcttcatcagactcgcaaagcccctatcgaatcaagatgatgccggcatctgcctgctcgacgtcatcattggcgatatgcattcggcgaccgctttcctgcttcgcaaggagccgaccgtagcacgattagccggtgtttgcacatggatcaatctgatactgactggattcagttcagtaagctttccttacattattcgaactacgttaggctacgatgcggcgacatatggtctatgcgatggcattatcggcattgccggcatagcgggaacattcatcgctggctgtttcgccaaccgtttgaaatcacgaaacgccccttcgttgttgttcgtggaaagtcttatgctgctcccaccggccatcgccttcctgcttccatgttcaacgcaaaccaagctcatcatgctggtgctctgcactgcggcagtcataatcgccgttgatttcttgaacctcattctcgtaccatctattcagatgaggacaccaaccgcgcttacaggcaaggtcatggccattatttcatcattgacgatatgcgcccagccactcgggcaaatgctttacggatggctgcacgcacattgcacggtttggcttatactgctgatttcagcactggcatcactacccttggcatggttggctcgcccactgtttgcgcaccttgacgatacgatttccaagtaaggcagggtaatgaagccgatatacgaacgtccgtatgctgagaatgccgcccaacatattgcgattcggcttgaaatcagccttccttaaacgaatgcctttctgcttgcaacgaatcaccaccagcgcgacgatcacactgatggtctgtgcaaagattatgccaaggaccgcatctgccggaccaagctgaaaatgccccatgaacaggtagacgagtgcgatattgaaacactgattcccaagctggcaggaaccacttggctgaatcactatcttgagagcctgccgaatctggaagcccagaaacagatgtgcagacaagttatcagcatgcgatgttcaacggctgacatcagttatacaggaatgttcgatcggggttctttggcacggcatgtccaaaattgttacgcctatgcggattggacgtccacgctggtggaagtgaattacgtaaacgagaacttctgtctgtcattcacacagaagttcgccacagatagatacgtaaaagcatttcgcgaattgttggagcaatacggcatagcatgcaccgagatcgaagagacaaagttcatctgaacgttccgccattcaatctcggcacaaccatgatgcatacgctttgacgttcgcgatctgagaggccgatcagtcgccgattgaaaccggcctcccctcgtttcctcccgtctcatccgcgcttcccatgtatggacccatcagatcgatatatcccttcgcgtcatgagcgagaagcgcacgcgttgcacgcagggattcgatatcccttggaaaacggtagagcgcaaccattgccgacaaatccctaagcccgttacaggcgtccattaatcgtttcttctcctttcgcggtgcgaaaagcgcatcatccctactttccggttccgggaagcagatataccctcccaatgtcatcgccaaccccatccctttaacggattcagtcgttcgtctcagactttccactccctgctggaacatcttgtcatcacgagtccggaacccttcagtaaggggccgcgagccgactgcccccaacagcgacagggcaagatcatgcaggtacagcggatcctcccaaatgttcgtcacctgatacgcgcccttctggtaaacgcgttccatgatttgcgaagctgattcagtctgcttgttccacaaagcacgatacgcttccacgattttccccgcatcgtacagatatcgcgcatccatacacgcgggatattcaagcaacatggattcggcaaggtcggcattgcaagcatagtccagatcggcttgaattctaagatcgcgcagatggtcgcacagatttcgataggagaagtcttcatcgcatccggaatccactactttcggatcgtccctcagcatgcacatgccgataccgccatatccaagcaccatcaacgcaacatcggccgcacgcggctcttcctcaccccaacgtagcagactgtacgcggccagccaatatacttcctgcaaatattcagccatgcaggccagtctcttctttttgctggtagcgtattttccaccctttttcttgcttctccgaaacacatccttggtgtaggtcaatccaatctggaatggcattctgctgctgggcctttgcaaagccaccgctatcgaagcgtcattgatcatttcatagagccaaacgctcataccgtacttacgcacgatgttacggcatccatcaagaaaattcgcatcatgctcaaccagatcataatcgaacgaaatcatggcccacgccagattcgccacccatgatgtgctgcagaataattccttccccagttcacagactttttcgtcaaaaagcgaaagagatccgatctcaccgtattcatcgtggatttttcccaattccgcaagatatttgccagaactgtatccatcaaaccgcttgataagttcttcgatcgttgccaaaaatccctgttcatccatatggaacgggccagtgattatttccgccatgtgcaactcctttgttgtagggtgcacctactgtctcatattcaaatcatcttgcgccaccgaaccttgaaaatctgtggatatgtggaaaactccacccatatccacaggcgaataacgactgtggataactcacaattcgcatgcaacagacctgatcttacgaaaatcaccatatgcaaaaaggtcccttccctcaccggaagagacctttcaggaaaagcatcaacgcaacgtttcagctgttagttgatgagctccttgactgccgcgataacggcctgcaggcttgccttggcgtcgccgaaaagcatctgcgtgttgtcttcgaagtacagttcgttctggataccggcataaccggtaccgcgaccgcgcttcatgaccaccacattctgggccttgtcgacgtcgaggatcggcatgccggagaccggggtgcccggcttgcgtgcggccgggttggtcacatcgttggcgccgaccacaagagccacgttggcctgcgggaactgcggattgatgtcatccagatcgacgagctcctcgtacggcacgttggcttcggcgagcagcacgttcatgtggccaggcatacggcctgccaccggatggatggcgtaggagacttcgacgccgtggttcttgaggagcacaccaagatcagcaagctcgcgctgggcctgagcctgggccagaccgaagcccggcacgaagatgaccttttcggcgtatacgagctgtacggccagatcgtccgcggaagtttccttcatgctgccttccggaccctcaccagcgccagcggcggcattggcaccaccgaaaccgcctgcaagcacggacagcagcggacggttcatggccttggacatggcgatggacagggtcacaccggcggcaccaaccagtgcgccggccacgatcagagcgatgttattgatagccaagccggacatggccactgcagtaccggtgcaggcgttgagtacggaaatgaccaccggcatatcggcgccaccgatcgggatgacgaacacgagaccgtagcacagcgcgaacacggtggtgagcacggaccacagcagacgctggcccggctgcacgcacagcatgacgaaggatacgacggtcagtacggcgaacagaatgttccagaagcccttgcccggcaagttcagcttcttcacccacttgatgccctgcagcttgccggctgcgatcagagagccggagaacgtgacggaaccgatcatgatgcccaaaccagcggtgatcaacaccacgatggaaggcgtgccctcggaggtcagaatgtcgttcaaagccacaagcgcggcggcgccgccacccacggtgttgaatacggaaacgagctgcggcatgtcggtcatcttgaccttcttggcggaaaccacaccggcgacggcaccgatgatgatgccggctatcagcagcacaacggcaacgccatgctggaatccgttggagatctcacctgcgaacagcacaatgaacgccatgaccacggcaaggatcatgccgacagcggagaccatattgcccttgcgagcggtcttcggagagttcatcaagtgcaggccgataacgaacatcacggcggccagcagatagacgaaccattcgatgacgccgagcggcgtgctcagcatttcagccatggtacccatttacttggcctcctcttccttcttcttgcccttgtcggacttgaacatctccagcatgcggtcggtgacgacatagccgccgaccacgttcatcgtgcccagcactgcagccaggaagatgaacacccaggcgagcgggctggtggcatgcgcggcgacgataacaacgccggcgatgacgatgccgtggatcgagttcgcgcccgacatcaacggagtatgcaaggtggccggcaccttgccgataacctcaacgccgatcagcagcgcgaggacgaacagagtaatcgcaacaacgatatccattgcttactccccttccttcttggcttcctcgccgcggccggccacgaccatggcgttgtcaagctcttcgttcagatcgatggccagcttgccgtcacgcacgaaatgcgcaagcacatcggccacattgcggctcagcaggttggatgcggtagtggaaacgccgcttgacaggtacggagcgccgatgatggtcacgccgttttcagtgacttgggtgccgacggtggaaccttcgacgttgccgccgaggtcgcttgccgcgcagtcgacgatcacagcgccacggtgcagtccggccacgccagccttggtcagcagaaccggaggcttgcggccgggaaccttggcggtggtgatgacgatatcgaagccggcagccttctgatcgacggcagcctgctgctgggcctgctcttcggcactcagcgcacgggcatagccgccctcgccctgacccttggagaagtcaagacccagatccaggaacttcgcgcccaaggattcaacttcgcccttggaagccggacgcacatcgtacgcggtgacaaccgcgccaagacgcttggcggtgccgatggcctgcagacccgcgatgcctgcgccaagaataagcaccttggccgggcggatcgtgccagcggcggtggtcatcatcggcaggaacgaaccgtacgcgttggccgccacgatggccgccttataacccattacggaattctgagaagtcatctcgtccatagactgcgcggagctcaactgacgcggcagcttctccatggcaacaccgaccagaccggccttttcaatcgcagtgacataatcggcgtcggtgaacgaaccgagcataccgataatccaggtaccctgcttaacgcgtccgagcagcgcgctgctcggacgatcgacgaaaccaagcacgtcggcacgcgcaatcacttcatcggcggagacgacctgcgctccggccttactataatcctcatcaacataatgcgatgcgacgcccgcaccggattcgatcaggcagttaacacccgatttacgcaacctcgttacgatatccggtgtcagagcaacacgagactcgtgttcggaggtctcattgagaactccgaagaccacggtggcttcagctgtttcagccataggtgccctttcttcctcgttaaagaaatcaaaatgaacagatacagcgcaccagtgtaacgtaggtcacacctttgtatgaagaaaagttcacctattgaatggcatcgcatggcaattcctttacgcaggccccgctggatgcgcactttccctacgctaccgtaaggtgacgtgtcgcattcatgggtctatcattcctacagatattggatttaaatgtgtaggagagtcacgtgtccgtcatcacctctttgaacaagcgagctgcaaatcttgcgcagaaggcactgcgtttgggaggtgacttcgttcaccccgtcagcgacgattccggcaacactccggattacaacgatccgaacaacatcatctcccccgacggccatatcgaccttccgcacaccgtcgaatggggcgaaggattcccatccaccacgttcctcgatccggaaaccggtctgttgaccaccaaaaccgagggcaagccgccgctggacgagggcaccaccatctacgatatttacgccgatcgagccgagcgtatgggtgacgagccgctctacacctataagacgaacggcgaatgggtgaccaaaaccggcaacgaggtgctcgccgatattcgtcagatcgccaagggtctgatgcattacggtcttaagaagggcgacggcgtggcgttcatgtgccgtacctcgtacgagtgggatgtgttcgacgcggccgtcatggcatgtggtggtgtgctcgccacgatctacgacacggattccgcggagcagatccgtaatatcgtcaataattccgattcccgcctgctggtggtcgagaccaccgatatgcgcgccaaagccgatggtgccgataaggaatgcccggcactggaacacattatctgcttcgagaacggcggtctcgacgaaatcatggcctacggctccggcgtgagcgacgaagagcttgacgagcgcatcgcttccatcaagaaaaccgacctgtgctccattgtgtatacttctggttccaccgccgcgccgaagggtgtggagatgacccatgagcattattgcaccaccgcgttgaatcttccggcgtatatgccgaaactgctgcatgagaggaagaacagcgtgctgctgttccttccacaggcgcactctttcgcacgtgccatcaactacatttgcgtagccagcgaactgcatatttacatcgcgcagggcatcaagacgctgatcgccgatcttcaggtcgccaagccgtccgtcatgatcgttgttccgcgtgttcttgagaaggtgtataacgcggcctcgcagaaggctggtcatggcgccaagggcgtggcgttcgccgcagccgttgtggcagcccagaattacatgaaggaggtcagtgcgaagggtaaggccggagctttggccaaggctcgccgtatggcgttcgacccggtggtctacgcttcgctacgcgaggtgctcggcggacgtgcccagtggatcgtggcgggcggcgctcctcttgacccggaacttatggcgttcttccgtggcgccggagtgcccgtgtatgagggttatggcttgaccgagaccacggctccttgcgcgttcaatccgcttggtgtgccctatcatcagggttccgtcggcgtggctttccctggcttcgagctgcgtatcgccgaagatgaggagattcaggtcaagggtaccgccgtgttcccgaagtaccacaagaacgaggaagcctccgaggattcattcactgaagacggctggtatcgtaccggcgatttgggacgtatcgacgatgacggcttcctgtatatcatcggacgtaagaaggatctcatcatcaccgcaggcggcaagaatgtctcgcccggtccgatcgaagaggttatcaagcgttgcgaattcgtttcccaggccttggtgcttggcgacaagcgtccattcatttccgcacttgttacgcttgacgaggaatccttgcgtccgtggttggaaagcaaggggctgaatcgcgacatacccatggaggaggccgccaacaatgccgccgtccgtgcggaagtgcagaagtgggtcgatcaggccaacgaaggtgtttcccgtgcggagtccgtacgtaagttcatcattctgccggaggaattcactcaggagaatggtttgatgaccgcttccatgaaggtgattcgtccgaaggtcatcaagcgttatgccactttgctgaatacgcagatgtacaccaagaagaagtagtcttcgaaacagcagaatgaggtctgactcctacgggaatcagacctcatttattattttccacgcaatcgttgcgaagcggatcctaagcagatcagaagcctagcttctcgagctgtttggctgaaccgtcaaaaggacagtccagtggactgtccttaggtgaagtgagcagcttcgctgcgaagcggatcctaagcagatcagaagcctagcttctcgagctgtttaggatccgactgccatcccttggcaaccttgacatgcaaatcgagtttggctttctgtccaacaatacggttgaccggcgtacgcaacttcttcttgacacgcacaagatgttccgctcccttgccgatgatgatcggtttctgggaatcgcgttccacataaatcgacacaatcacgtgggctttgccatcgtaagcttcgccactatcgttgtcttccggatattcgatggaatccacgactacggccagtgaatgcggcaactcgtcatccaattcttccaggaaagcgccacggaccagttccgcaatggtttcttccggacgctcttcggtgatctgctcggccgggtacatttgcgggccttccggcatgttctcgataagcacgttcttgacttccgcaagattgtcatgcttcagcgcgctgactggcacaatatcggtgaagtcggcgaattcgttgatttcaatgagcttgttgatcagcccgtcacggcttaattcgtcaatcttggtaacgatggcaaccagcggcaccttccatttgaatgtgccatcatctcgcttgactgcgaaatcagaacgcagacggctcaaaatgcgcttgtcgccgggaccaatctcctgattactaggcagcaggaaagcaacggcgtccacgtcggcgagcgactcgtccacaacatcgttcagacgctgcccaagtagtgtgcgcggtcgatggatgccaggcgtatcaaccaaaacgatctgcgcattatccgtggttaaaatgccacgaatggctttacgagtggtttccgggcgagatgatgcgatggcgatctgcgtaccgatcaacgcgttgatcaacgtcgacttgcccacgttaggacgcccgaccacggcaacgaaaccggaccgatatggaacgggcgtggcggaatcggaatggtcggaagtcgtctcggttgttgctgcgtcagtcatgcttgtctttggaatccttatcgttgtcggatgccttttcggcatcatccgcatgttcttcgttacgtgtttcagtttcgtccacgccctcgacgtgggccggctccaccacaatggtcgacacttttttgcggcgtcctgcggagtcgaccgcggtcatgcgcaagcctcgagtgactgcggaggatccgacgatcggcacacgtcccaacagcttggtcagcaagccgtaaacggtgtcgacatcatcctcgtcaatgtcgatttcgaaaatctcttccaagtcggcgataggcgtgcgtgcgggcatgctccatttcttgtcaccgatccgttccggatcggcatgttgcgtgcgatcatgttcgtcttccagttcgcccacaatctgctcgatggcatcttcgatggtgaccatgcccgcgattccgccatattcatccaccacaatggcgacatgctggcgtgtgcgctgcatttggtggaaaagatcgtcgaccggcttggattccggcacgagcatggggtcacgaactatcgattcgacttcgcgtgtcatcgccgcatggttgaaggtcgtcgcgcgcacggcatctttcaaataagccacgccgaccagatcgtccacatcgtcgccgatgaccggcacacgtgagaatccggaacgggagcaaagcttaagcatattctccaacgtttcgtctcgctcgatgcaaatcatgtcggtgcgcggcaccatgatctcacgagtcagcgtttcggaaagcgtgagcacattgcgcagcatttcggaaacttcaggatcgaaatcgttggcttcgaccagacggtcaatggttgcccgtccttgttcgatctggattttttcgagctcctcgtcgtcggaaagatcactgccgcgacgcttcgcgcctttttgccccccgatttttgcgaatggggttaatagaaccgcaatggaaacagcatccacatgctgcagcataatgtcgactggcttggatgccccggcactacgcggacgcaccaacagcgaaatcaccgcaatgacgatggcaaaaacaaatccggcaagtaattcggcccatagtggagcgtccaacatgcccgcaatcaccgtcacgagcacaccatcaaccacattgcagcagatgcggaagaacgcgcacgatccggcggtggcatagcgatcggccaccaaccgctgaaccttatgaatgcgcctgattttcttgtcgcgtatgaattgcgaaagctcggcatccgtttgaatttcgagaataaggttattcaggctcgccctggtcacacgtcccacagcgccttcagtcgcggccattgaaagcgacagccagaccaacagcagcgccaccacggcgagcaccacgatcatcgcaatcattgttgcctgcataattcagcccccatcatgccggacgatatgctaccggcaacgtcaatcattatttggcgatctgccgtcccgtgccatgctgcctatcccattcggcgagcgcgtccggcgtatccggcggaaggatggcctgcgtccccgctccctggcgaagcgcgaagaaggtgagtagcagctgtcgctgcagaccgaacatctgacgctcctgttctggggtggcatggtcgtatccgagtaggtggaggatgccatgaatcgtcagcagcatcatttcctccatggtgttatgtccggccgcgagcgcctgctgcgcagccacccacgggcaaatcacgatatctccaagcacgccttccatcacagttcggccgtctcctgggcgcagctcgtccatggggaagctcatcacgtcggtggggccttcaagattcatccaacgcatgtgcagttgggcgatgggatcggggtctacgaacatgatggtcaggtcggattgcgtgctgacccgcatttggtccatcacccatatgccaagatcggagaacaccttgccgtcaatttgccagacggtttcgttggttacctcgacgctcattcagcgttcctttcgatttgctcgcttgtttgcctggatgtggttttgcccgtggcgtgtctgctgtggtcgccggcaatggccgcgtgtcggtcgtacgctgcgacgattttgccgacaagcgcgtgtcgcactacgtcttccggtttgaggtgggcgaatgcgatgtcgtcaatgccgtcaaggatgcgttcgatggtggcgagcccggatttcggtactgtcagatcgacctgcgtcacgtcgccggtgataatcattttcgtattgaagcctagtcgggtcaggaacatcttcatttgttgttcggtggtgttctgcgcctcatcgaggatcacgaatgcatcgttgagcgtgcgtccacgcatatatgcgagcggtgcgacttcgatggtgccgtcatccatgtagcgcttgagctggtctgccccgagcatgtcagaaagcgcatcatatagcggacgcagatatggatcgactttttcgttcaatgtgccaggaagaaaaccaaggctttctcccgcctcgacggctggtctggtcaggataatgcggcgcacctgcctatcttggaatgcgcgtaccgctttcgccactgcaaggtatgttttgccggtgcctgccggtccgatggcaaatgtgatggtatgtgattcgatggcattgacatatgtgatctgaccagccgttttggcacgcaccggcttgccgagcgcaaaggtgatcactccgggcacatgcggtttgcgtcggtccgcatgattctcgcgattggaggtatgctcctgttgccgatcggccagccgtagttcctccactacacgtccatggcccgggcgagtagcacgcacaggatttttcaacacgttttgatcgagcatgcgtcgcaccgtatcggcgtccatcggagccgtatatgcggcttggatgatgttttcgatcacatgctcggcctgtgcggcttgggattcggatttgctggaacgtgacatgatcgcgatgcggttgcctctgacgataatggtcaagtcggggaacgcacgttccacttcccgaaggacctcgtcgaccggtccgagcacggtcaccgggtcaagctgctgcggaatcgcgatggtacgtgtagtagtggccacaaaacctcttctgacgtcgatatatggggaaagggaagattattcgtcaagcttttcgccggtcagcacgtgagcatgcacgtggaataccgtctggccagcatcaattccggtgttgaagatcaggcggaaggcaccgtggaattcctggtcggcgatattttgcgcgacctgagccatgtgggcgagctgctggggatcggccgccgcaagctcggccacgttcgcataatgcttgcgaggcaccacgagcacatgtactttggctttcggattgatgtccttgaatgcgtaggtggtatcgtcctcatacactttttcgcttggaatttctcctgcgatgatcttgcagaacaggcaatccttgtcgctcataatgctccttaatgctggttgtccttcggtacccatgctattgcgcaaccgggataatccgccgcatttcgccggcgtgtggcgtcagatgaatcgtcccaacgcccgtgcgagcagcgataacgcgacgggaccagctgtcgacgctcgcagaatattgcttccaagcacgcatgcttcagctcccgcattggtgaaggattcgatttcagcatcgctgatgccgccttccgggccgaccaccacgtacacggtgcgctggcgcccgtcctgcaagcatttgtcggaaagcaccgcgatcgcttcctccagctggctccaagttttggtagcatcctggtgcagcacaatcaccatgtcgccgtgcacacaggcacgcttgcaaatggcaatcaactgcttgctggtcacgcactcccccaattccggcgtccaggagcgtcgggattgttcagtggcggcatcaagcacttgccgccacttcttatcggtgcgccccgccttccatttggcgatggaacgatcagcctgccatggaatcacctcatccacaccgatctgcgttgcggtgtcgatggcctgctcatcgtgtcctgttttcgccagcgcttggatcaaagcgagtttggtggtaggctgcggttctttgccgaagctcgacacttccgcgattccttgttgcgcatcgcgcaacaccgcgtggatacgtagccctttaccgtcggaaagctgcaattcgtcaccgtctttcagacgcatggcctgaatggcatgtcgacgcaccgactggggcaacgtcaatttccatccggcgttcaattcgtcactgttcaccggcacatcatcatgttccgtatcaagcaggaaaagggcatcagtcatagtttcagagcctaccagcacctcggataccaatggcgtaattccgcgcgacacgccgagacttgcatcacaccgagcatctgctatagttttcgtttgttgccgctgagcaacgcacctgtccgggtggcggaatggtagacgcgctagcttgaggtgctagtgcctatttatacaggcgtgcgggttcaagtcccgctccggacaccagcaaaccccttggaaacaaggggttttcttgtatctgaaagctattcggcgaaagatcgatcacatgcagttcatccatcttgattccattgacgacgagcgcgtgtcggcatacacgaatctcacggaaatccagcttcgcaacaagcttgaacccagcaagggcctgttcatcgcggaatcgccgaaagtcatcgatcgcgcgctgaccgccgaccgggaaccgatttccctgcttgtcgaagaaccgtggatcggaggcatgtcggaaaccttcgcacgcatcgaccaacgttggggcaccgacattcccgtgtacgtggcatcccctgaacagctcaagcagctgaccggctaccgcttgcatcgtggcgccctggccgcgatgaaacgctggccactgcccagcgtcgaggaggtgtgtcgcggcgcacgacgcatcgcggtcatggaaaacatcgttgaccacaccaatgtcggagccctcatgcgatcagccgccgcgttgaacgtcgatgcagtgttggtgacgccctcctgcggcgatccgttgtatcgacgcgccgcccgcgtgtcgatgggcacggtgtttcagattccgtggactcgtatcggcggagatgataaacactactggccattcaccggcatgcaggaattgcgcgatcttgggttcaccaccgttgcgatggcccttgaagacgattccatttcgctggaggagcttgttcgtcgtttgaacaacgacaacggcgaaaaggaccatatcgacaaattggcgctgattttcggcaccgaaggcgacggtctgtcgcatcacaccatctcccgcgccgacctgacggtcaagattcccatgagccacggagtggacagtcttaacgtcgccgcatcgagcgccgtggccttctattcaacagctgttcactgaaacagtcagcaaattttcaagactcgcgatgcaaactccttgcatgttgcagaaaatatgcaattattgagtgcgtaagtggtttgcgatgatgcagaccgaccaatgtgtgcggtgtcgtaacgacgctctaggagaggagttctcatggcaaagaatccgaaaattctttccatcgtgcttgcaggaggcgaaggcactcgtctgatgcctttgaccagagaccgggcaaagcccgccgtcccgttcggcggcgtgttccgtctgattgatttcccgctgagcaatttggtcaattcaggctatatgcagaccgtggtgctcacccagtacaagtcccattcgcttgaccgtcatatttccacggtgtggcgtttttcgccgttgctcggcaactacgtctcccctgttccggctcagcagcgacttggcaagcactggtatctcggctctgccgacgccatctaccagaccatcaacatcatcgaggacgtgcagccggatattgtggtgatcgtcggcgccgaccacgtctaccgcatggatttccagcagatggtgcagcagcatatcgaatccggcgcggagttcacggtggcgggtattcgccagccgatcagccagtccaaccagttcggcgtgatcgaggttgatccggagcacccgaatatgatcaagagcttccaggagaagccgcagaccacgaccggcctgccagatgatccgaactccattcttgcttccatgggcaactacgtggccaacaccgacgccctgttcgaagctttggcgcttgacgagaaggccgaagacaccaagcatgatatgggcggcgatatcgcaccgtacttcgcggcccgtaacgaggctggcgtgtacgacttcaactccaacgagattccgggagcgacgccgaccgatcatgcctactggcgcgacgtgggtactctgaagcagttctacgatgcgcatatggatctgatctcgtatgtgccggaattcaacctgtacaacaccgaatggccgatttacacgctgtccggcaatctgccgccagcgaagttcgtccatgccggtcgcgaccgtctcggacacgccaccgactcgatcgtctcccctggcgtcatcgtatcgggcggtgaagtgcatcattccgtgctttcgccgaacgtgcgtatccactcgtggtcccaggtcgtcgattcgattctgttcgacggcgtgaccatcaatcgtcgagcacgcgtctacaaggcgatcctcgacaagaatgttgtgcttaccgagaattcgaccgtcggtatcgataccgaacatgatctggcccgtggcttcaccgtcacgccggaaggcatcaccgtggtgccgaagggtaccgtggtcgacgactgacgttctgccgcacacagaacaaaagcgtgcttcccggcgtcgggagcacgctttttctgtgccattttttcttgatgatgatatccaatcaaatatcatcaaaatctgttttacaaaaaattccgcaacgaacatgcagtttcgctgcggaatcaacatatcagcaatatcaggttgatatatcacagattttctgtcagtattttggcagattgtcgaaattgaagccgagcgcagccaactgctcgcgaccttccggcgtgatcttttccatgctccaacgcggttgccacgtccagtcgatgcggaattcctcgacgaggccggcaagcgtgctcgcgcactcgtcttcgatcagatcagtcaacgggcatgccggagtggtcaatgtcatcgtgataatggcacgaccaagctcatcgatctcaatgccatacaccaatcccaaatcaatcacatcaatgccaagctcaggatcaatgacctgatgcaacgcttccttcacgtcggccgcagtagctcgaccaatgtcgtcaatagccttcaacgcgatgccgtcatcctgttcttcggaacaaccgcatgctccagcctgattgccgcagccacaagcgtcctgcttggtgtcttcgtgttcgatttccactggtttgccgtccttgaatcctttggcgagatttgggttaagcatgacgcgacgcgccgcggcctcgtcattgcccaatgccttggccacggaatcgaaaatcgaggcttgcggttcaggtaccaaggtatcgctcattgtcgctccatatatgattcgaatatgttccgttgagtagcctatcgcgttggctggagtttgtctcacgtgtttcgcccgttgtagaacgcggcgcacgaagcacgggaaacatcctgctttccaccatagaacaatacttgtcaggctttcgcggccaatgccttggccacggagtccttcatgccttcccatccgagcagcgcgcacttgatacgcattggatacttggacactccttggagcacgatgccgtcttccaacgattcctcggcggattcatcgtccaagcctttgccgcgtgattccatgagcttatggaacgttccggccaattccatggcctcatccacggttttgccttccaccagatccaccatcaccgaaaggctggcctgtgaaatggagcagccgtgaccgtcccacaccagtcgttcgataacgtgcggctcctggtcggaaacctccacatgcacggtggcctcgtctccgcaggtcggattgaactggtgggactcgccgggagtgcaatactcgtgggttgcctgaaccgtggtctttcccgcctgggaggcgttttcggaagccagatccggagcgaaatgctccttgccatgcggattcttcgaggcttcgagaatgacctcttggtacatctgctcgagatcgtcgccagacattgcaaaatcactcatatgcgttactcaactccaaaaaacggacggaccttcttcaacgcctcaaccaatgcctgcgcgtcttcgacggaattgtagatgccactggatgcgcggttggatgcgtacacgccgaagtgacggtggaccggctgcgcgcaatgatgtccgacacgaatggcgatgccctgcgcatcgatgaactggccaacatcatgcggatgcacgccgtcgatttcaaaagccaccgtgccgatgcgctgctcgttggtctgcggtccgagaatgcgcacgccgtcgatctgccccatcttgaggagttcgcctgcgataacgcgctcgtgggcttcgagattctccatgccgatattcatcagccattcggccgcgacaccggccgcaacgacctgcgcgaccggctgcgtgcccgcctcgaaacgcgcaggaggagccatgtattgggcttcctgatccatccaggcaagttccaccatggatccaccgaaattcgccggtggcaacgcctccaacatgtcgcgcttgccgtagaggaagccgacaccggtcgggccgtacatcttatgcgcgctccatgccgcgaagtcaacgtccaaagcgtggaggtcgatcttcaggtgcggtacggactggcatgcgtcgagcacaaccaccgcgcctacctcgtgcgcacgtttcaccatcggcgcgatgtcggtgatggcaccggtggtgttgcccacatgggtgacggccacgatctttgtgcgttcggtgatcacctcgtccgcagtgttggaaaggatgcgacctacactgtccagatcgaaccatttcaatgtcgctccggtacgcacggcaagctcctggaacggcaatagcacggagtggtgttcggccttggatacgacgatttcgtctcccggcttcacagcgaaacgtcgtgccgcttctcccccacgtcccagcgatgcgttgccgaatgcggtggctagcagattcagtcctgcggtggcgccggaggtgacaacgatctcctcttcgccttcagcggagttggcgccgacaagacgtgcgactttggcacgtgcctcttcgaacgccatggtgctgcgtgcggcaagctcatgcgctccacgatgcacgccggcgttgatggtgcggtaaaaatcgctttcggcgtcgatcacgcattgcggcttctgagaagtcgccgcggaatccaaatacacgagcggatggccgtggatctcctgatcaaggatcggaaattccttgcgaatcgctgcaaaatcggtcatgccagagcgctttcggaatcggatccttccggcaggtatgcgtcatagccggattcctcgagctcatcggccagttcagggccgccggtcttgacgaagtgaccggctgcgaacacatgcacgatgtccggcttgatgtacttgaggattcgcgtgtagtgcgtgaccatgagaataccgaactggttggcttccttggcgcggttcacaccttcggagacaatgcgcaacgcgtcaacgtcaaggccggagtcggtttcgtcgaggatggcgaacttcggcttgagcagttcgagctgcagcacttcggcacgcttcttctcgccgccggagaaaccctcgttcacggaacgtgtggcgaacttcggatccatcttcaggcgcttcatcgcctcggacagttccttggtccacgtgcggatggccggagccttgccgtcgacttcggtttttgcggtgcgcaggaagttggtcatcgacacgcccggcacttcgaccggatactgcatggctaggaagatgcctgccttggctcgctcgtccggggtcatcttgaggatgtcttcgccgtcgagcagcacctgtccggaatcgaccacgtacttggggtggcccgccagcgtgtaggccagcgtggatttgccggatccgttcggccccatgatggcatgggtttcaccggagttgacggtcaggttcacgcctttgaggatcggcttgatgccgtccttggtttcgacgtgcgcgtacagatctttgatttcaagagttgacatggttttcgctcctacgttctacttctcttccaacacctgggcgatcgcgtcgttctcgccgcgtgccaggcgcttgtcgataacgttcatgagatgttcgctgattgcgggaatgccgatttcctcgacgagttcgccaaaaaagcctcgcaccacaagtttgcgggcttcggtttccggaatgccgcgagactgcagatagaacagctcctcatcgtcaaagcgcccgacggaagaggcatgtccggctccgatgatgttgccgttttcgatttccagattcggttcggaatcggcgatcgcgcccggagtaagtaccaaattgcggttgagctcatacgagtcggtacccggcgcggtcggagcaatcagcgcgttgccgacccatgtggagtgcgcgcccttgccgtcaagagcgcctttatataccacacgactcttgcactcgggatggttgtgcacaatcatggtgcgatgttcgatatgctcgcccggatccacaaagtagatgccaagcatgttgagatcgccttgatcgccgccaaaatcctgatccatacgaatccgaacgacatcgccgccaagcgtgaccacggaatggcgcagggacacaccctcccccaagtggatacgctggttgcccacatgcttggagcccttgttccactcttgaatgaacgtggtggacacatgggagtccctacctgtgagaatctccacaccttcggcgatacgtgcatcgccgtcatgctctaccacaacgtcagcgtgggcgcgatcggcggcaatgatcaccaggtggaatgcgtccagatccgttccggcaccatgaatcttaacgagtatcggctggctgatttcaccgtcgatacgcagaattccggcacgggaggcggagttccattccactgcggacacacgatcgcagggcttggaaacgatgcccgtatcggcgtctcccggcttgccctcgctataggtcacgccttcagtaagagccgtgccgtcgatcatagtgacggcaatctgggtttcgttcgacggcgtgaacgcgttgaagaactcttcgacacgttccacaggggtataacgccaatcatcctgcttgcggtcgggcacttcaaatgcgtccacatcaaatgaccgcggcgagcgatccgccgaagagggcatggctgccggattcgcatacggatcgttcggatccgcaacgggaatattgatttcctgagtttgtgccatggtaatcagcccaccgatccttccatctgcaattccaccagtcggttcagttcaagcgcatattccatcggcagctcacggctgataggctccacgaagcctcgcacgatcatgcccatggcctcctcttcggaaagaccgcggctcatcaggtagaacagctggtcttcggaaaccttggaaaccgtagcctcatgtgccatggaaacgtcatcttcgcgcacgtccacatgcgggtaggtgtcggagcggctgaactcatctacaagcagtgcatcgcataccgtcgagttggacgatccttcggcacccttgacgattttgacgagaccacggtatgcggaacgtccaccgccgcgggaaatcgacttcgccacaatggtggagctggtatgcggggcaagatggatcatcttcgcaccggtatcctgatactggcccttgcctgcgaagccgagcgacatggtgctggccttcgcatacggctcggcgagaatgcaggccggatacttcatggttgccttggaaccaatgttgccatcgacccattccatggtgccgccttcacgcacgtaggcacgctgcgtcaccagattgtaaacgttgttcgaccagttctgcacagtggtgtagcgcacgcgggcatgcggctcgacgaaaatctccaccacaccggaatgcaacgaatcggtcgagtagatcggtgcggtgcagccttccacataatgcacgtacgatccctcgtcggcaatgatcaacgtgcgctcgaactgacccatattcggcgtattgatacggaagtatgcctgcaacggaatatcgacatgcacacccttcggcacgtagacgaacgatccgcccgaccatgcggcggtgttcaatgccgagaatttgttgtcgttgctcggaatgcacttgccgaaatacttcttgacgatttccggatacttctgcaccgcggtgtcggtgtcgacgaaaatcacgccttggtcttcaagatccttctggattgagttgtagatgacctcggattcgtactgtgccgcgatgccggagacaagacggcttttttccgcttcgggaataccgagcttgtcatacgtcgcacggatctcgtcaggcaattcctcccaagtcgtggcctgcttgtcgatcggcttgacgtaatacttgaaatcgtcggcgtcgaaatccttcagatcaacaccccattgaggcatcggacggttgatgaaatcgcgatagccttccaatcgcttttccagcatccattccggctcgttcttatctgcggaaatagcgcgcacgacattctcgtcaatgcctttttttgccgcttctccagcgaaatccgtgtcatgccatccgtacgtatagtcgccgaactgctggatgatctcgtcatcctgcttgatcttgtcttcattcactcgcgtgcgatcagccacatactggctcatctccacgtcagccgcggcgttgggcgcttggttctctgccaccgtacgctgcctccaatcactcgtttgtacctatgacaacctaacagaacgtggggctaaacactagcgcccctttcgctattcggcaatgatttgtcgtgatttatcttacatagcgtaaaggcggaaaccgaacattcagtcttccgcctttgcgtctttctgccgttagcccgcatatcaggcctgaacgtgaaccgtcgttcccatcaggcaccaattgtagaaccattcagcctgatcccagccgacgccgacgcaaccatgggacgtgttcttccccatagcctgaatactgctgtcgttaaacgcactttgagtggcgatgcgatgaatcgcgcaacctgttttcgagaaatagttgacgaatccaacatccttgacatcccacttctcggtgtttccatccgatagggtaagggtgccgctcatatcttgggactggtacttgagccacactttgaagtcaccgtcaggcgtgcagttgtcgtaggagttcggatcgcagtaggttggcgtgcacaagtcgccgctcggctggcactggcccgtctgataatcattgccctgaccggcagacatatgcatgacacggacggtctgcccattttcaatggctgtaacggtatgcgaagacaagctgactaccacggtacgcatggtttttttctcattctgtgggtcgcaagtgccttgaatacttactgaatcagaacctttggcaaacgcctcagcggcatcacggccaacattggtgtcgctaccatcagtaacggttataccatcatgcccagctacattggtttgcagcacatcaccgacactattaacgatgacatcaccgtcaactcgatcagcatggaagttcgatttgatggaatcgttatagtattgctgcaatttgtcaccatcgataatcaaagagccatttcgggtttgattatcgccgagcttctcactatccggtccaagcgtgatggccgatgcaatggactgcgcaccgaattccgccactttatggtcgccgatcttgatagccaccggcttcgctatccacgcgtcagcagaagccttggcctcgttggcttggtcatccgtgatgacgggatcagtaaccttatttttaagagtcaccatttgagcggtctgcttgccaaaggactcaagcacgttcttggcttctttgacgatatccgtcacatcgataccagtcccctgctgacctggcgtcacatcgaaagcggtaccatccgcgttgagctgtagcgacgggttggtggcggacacggactgcactcccaacatgtcacctaccgtctgggcgctgactcgagaatcatcgaaagactcgacgtcgacatcctcacgggtccagaatgcatacttctgaaagaaggaatcgtcacgtttcgcgttcatcacattttcggcgatggattccgcgtcaatggcgacgccaagatccttcaacgtgactttcttgctcgttccctcataggaaacgggaaccgtcaatgattccgccgtatcggaaatctcatggatgatatgatctcgggattgtcctgtcatggacttgccccagagcgtgacacctggcaacgcatgtgactggaagaaccagtatccgccgccggccacggcaccgagaagaagcatcaccgcaagaacaatccacagccacaacaggtggcgcttcttgctggcattcacagtcaacgctgcaccatcatcaatgggatcggccgtttcggcaaacgaatccaagctcacctgcgagatgacttttggttcatcgcccatgttcgggaaggcgaacttaccgttgccgctttccggagaatccatatcgttcaagctcatgctccctcgtaaaggtttttcattacgaatacgtcttgttgataattcaaggccaagcccttattatgcaacatggccatgaactcctttggactcatgaccatgttgcatatcgggttatccgacgttaatcacaattcgtcgatttagcgctcctgctggtggtccagagcggccttgaccagacctgcgaacagcgggtgcggcttggtcgggcgggacttgaactcaggatgagcctgagtggacacatagaacgggtgcacctcgcgaggaagctcgacgaactcggtgagttcgccgtccggactctggccggaaatgcgcagacccgcttcacgcagacggtccttatatgccacgttcacttcgtaacggtgacgatgacgttcagtgacatgcgtggtgccgtacagttccgcgacgatggaaccttcttcaagctcagccggataggagccaagacgcatggtgtgtcccatgtcaccattgccggcgacgatgtctttctgctcctccatggttgcgatgactggggtcgcgcaatcgggctcgaactcggtggagttcgcgtcctccaagccgaggacgtggcgggcgtattcgatgaccatggactgcaggccgaggcacaggccgagggccggcagcttgttctcacgggcgaacttcagggcaccgatcttgccgtcgatgccacggatgccgaagcctccgggaacgacgatgccgtcgacctggtcgagcgcggcggccgcgccctcctcggtctcgcacttatcggcggcgacccacttgacgttcaccttggcatagttggcgaaaccaccggccttaatggcttcggtgacggacaggtaggcatccggcaaatcgatgtacttgccgacgatggcgatgttcacctcatgcttcgggtggtgcacacgctccagcaggtcctcccactcgtcccaatcgacatcgtggaacggcaggccgagctcgcgcacgacataggcgtcgaggccttcgtcgaacagggtcttcggcacgtcatagatgctcggggcgtccacgcagttgaccacgccttcggaatccacgtcgcacatcagggagatcttgtccttgatggactggttcagcgggcggtcggaacgaagcaccagcgcgtccggggagatgcccagctgacgcagcatcatgacggagtgctgggtcggcttggtcttgagctcatgggcggcggcaatgtacggtaccaaggagacgtgcacgaacatgcagttctcggcgcccagatcgcggcggacctcacgcgcggcctccaggaacggctgggattcgatatcgccgacggtaccaccgatttcggtgatgatcacgtcgacgtcatcggacgcctgcgcacgcatgcgggacttgatttcgttggtgatgtgcgggatgacctgcacgcattgtccaaggtattcgccggcgcgttccttgcgcagcacttcctggtagatctggccggtggtgacgttcgccttctggctcaggtacacgtcaaggaaacgctcatagtggccgatgtcgagatcggtttcggcaccgtcttcggtgacatagacttcaccatgctggaatggattcatcgtgcccggatccacgttgatgtacggatcgagcttctgctgcaaaaccttgatgccgcggctacgaagcaggcggccgagggaggaggcggtcaggcctttgccgagagaggaaacgacgccaccggtgacgaaaatatgcttggtaacgtgctcttgagaattgccatgttgtcttctaaccatggaacttcagtctatcagcggcatgagacgcggcgtgtttccttcaatacaaaaaggcggggccatcattgccttgatggccccgcctagcaggaataggagatacattcagtcaatcattggcttatgagatcagtcctcctttctgcgggaggccgcgaacgcgaacacggatgcgatggcaagagccaccgcggccagtgcgaaaccggtgatggcggaaccagtattcgggctttgcacagcatcgctcttcttgtcggaagctggctggaccgcgggtttgcgcacggttaccgtgcgcgtgaaggtggcggtcttgcccctgctgttggttcaccgagtacacgagcgtgtattcgccttccttagaggtatcgaccgaaccttcgaccgtgatcttgtcggtcagatcgccgtcaacctcatcccatgcgctgacgccggacatcggatcgaactttgatcccagagtcacgctgtcggaagccaccagacccttgatgacaggcgcgctgtcggtatcgggcttggtgctgctgtcgagtttcagcacagtggcagacagtgcgcccgcttcgtacgaggccccttcggcgagatcgacattggcgatagcatcatcggagtagaccttgccgtcggctgcaagcacttggtaggagccgtttgccaagccttcgatcgcggtcttgtctacgttggcgttgaagatcaccacgtaggtgccgtcggactgctcggcctggtaggccacgacgccgtcagcggacttgagcatcgtcacgttggcgttgatgtcgttgtagtcggtcagacgcagcgcgttgatctgcttgcgcagcttgatcaggcccttgacgtagtcgacggaatcggcgtactgggtggtgcggtcccaatcgatggcgttcaccgcgtcgcccgtgttgtagctgttgccgtctccgcccttggtgcgcaggaactcttggccgagctggatcgcggggatgccttccgacagatacacgacggagtcggcaagcttggcacgtgccacggtcgtggcgtcgtcatccgtcgggacggacttcctgagcttgtcgtacagggtcatgttgtcgtggatttcggcatagttgaccacctgtccggcatcggcgtagtgatcctgcgcgttgccgttccagcaggtcgtggtcgcgttctcgtcgtactggcagccgagcacgttgtgggcgatcaggctctcctggtcggccttgccggaaacgaaaccggtgtcggtgtcggagaacacggatcccttcaagccgtcacgcacggaatcgttgaagaacgcgatgccgttgttcgtgccgtcggacgcgacttggtacgcgttcggctggatggtcatctcgccctcgtccatggtggtgttcatatcccagccttcgccgaggatgatgatggacgggtcgatctcgtcgagcgctgcacgcacttccttcatcgtttcggtgtcgatcagacccatgagatcgaatcggaagccgtcgacgttgtagttcttcgcccaatacgtcaccgaatcgacgatgtacttgcgcatcatcttgcgctcggaggccgtatcgttgccgcagccggagttgttgaccagggaaccgttgtcatcataacggaagtagtagccgggaacggtcttgttgaacgagtggttggcggcattgtagacgtggttgtacaccacatccatgatcacgcgaatgtcattctcgtgcagtcccttgaccatctgcttcatttcggtgacacgagaggcggggtcggatggatcggaggaatacgagccttccggcacgttgtagttctccggatcgtagccccagttctgcgcaccttgcgcgttgtagctcagatcgccggtctcatcaacggaaccgtagtcgtacatcggcatgatctgcacgtggctgacgcccaactgcttgagatagtcaagaccggaggtggcgccgttcgccgtcttcgttccggattccacaacacccagatacttgccccgcttgtcggctgagattccggaattcgggttgatggagaagtcgcgaatgttcatttcggcgatggtggcgtcagtggtcttgccgaattccggcatgcggtcgcctgcggagcccatgtcttcgctggagagcaccacggaacgttcgccgttggcgaccgcagcggtcgcgtacgggtcggcggagacgttcaccgtgccgtccgcgaaggtgagcttgtaggagtaggccgtgccgctagcaaggttcttcaccagggcgctccacacacccttgtcttcagaggccatgtcgatggtcttgtcgacttcggcattcacatcgtcggactggtaggtgacaagctcaaccttggtggcggttggagcccacaccttgaatccggtcttcgcgctcgtgtaagtggcgcccagatcgtcgccgtcataggcgtacttcttgtcgaaggcatccgtacgcaccaccgagcccgcaatggcgtcctgcgaaccgaagcccttgacttcgacggtgtacttgcctcgcacgtcaagatccttggccgtggtgatgagcaccttggtgccgtcggtcttgatgttcttgacatctacagccttgccgtcggcgtcagtgacggagaccttgccttcaagctcatccgcagtgacctttttggacagtcttgcggtcagcttgttgacgtcggagatttcaacggacttcatggacgctcccaacgatggacgtgaggaatacacggtggcgtcgccgcccatcagccacacttcggccgatgcggtgccgtccgattcgttgaacaccaaggcgtttgacgggatcttgtaatcggcgtcatccggatccttggccttccacgcatcctttccgtaacggcgcagcatgccgatgtcggaggctccgtcgacgttgtagtaggtgtagttggcgaaggagtattccgcgacctcgccccagtcatcgtgggtggtgaaggtggcggctccgccgttccaattggaagcccaggtccagatgtcccactggggaacggtgaccgaggtgtcttcggcgttgtagtacaggccgtcatcacggttgtagtggaccttcacggtaacggtgttggccttgcattcgtagtcgctcggagcggagtcgagggtttcgacggtggtcgattcgccttgatcctcatatttggtgccgtcgatccacacttcggctgtgccgtcggcgttcaccgtggcgctacggtcgccaccgtacttgttccagtctgcggtggtgacgatgaagccgaacttgtcgaacttgccgccgaaggtcagcgtagccaccttgccccagcagtcagctccggtgaagggatggttgactgccgagaggctcgagccgccagcgtctgtgccccacacgtacacgccgcgattatcggaatcgctggctggcttgtagtgcacgacgagtcgggtctggccgttgacggattccggattacccacggtcgcggcctgatcggccacacccacgtgcgtgatgcccgcgttggcgtggtagttgccgccgcccttcgggttctcccactggtcggtgccggtatcgtgaaacacgaagtcgatcttcttgcccctggtgtcgatggtggcgcgatagtacccctgctcgtcgagggtcatgtcggcttccggctggttccagtcatcgccaagaccgtagtggaccttcgggctcttccagctggaatcggcgggcttgtagtagatggtgacgcttctgtcgtcgggcagggtctcgtccccttcctggttcacgtcaggatcggacgggtcgttggccacgctggatgccgggtggctgtccttggtggcgcctgcatacagtgcgatggcggaatgcgccggtaccgtggtctcgaccttgccgttcttgacgcttacagtctgggagcagtccatggtggcgtacacgttgcagtattcgccgtcggcgagcgatgtcgtgtaggaggcgtccttgtcggtcttgccgttgttgatggcgatgaagcccttatccccgcgggagaaggcgatgttgtcgccgccgtcatcctgccagtcggcgaccttggtgccgttgacgtagttgcggaaggcgatcatgcctcgggtggaggtccagcgctgctcgcagttccagtcggagctgttggtggaacagacctcgtccatgttcacgtccggaacggatgtggcggtggctcccggtgcgccgttgtcgttctcatcccacttgtagtcggaaagcagacgcggcgtgccgtagtcgtaggcaagcatgaatgcgttggccagctgatacttggcaccgtccttgtaggtcagggcgccctcgttgcgcgcggtgtcccagttggtgacgaacacgttggcgtcttcggaggcgagatccttgctcaaccgctcattaagtcccttgaggtttgcgatcttgtctttgaaggtctggttcatttcggacttgaagccgaattcggtcaccgtgccgttttgcacgtagttgctcggctggatgcccgcggcttcggaggagttcccgatgacctcctggatccagtagatgctgtcggcgttcacgccgatcttctttgcgaacttctccttgatggccttcatgctgtccgtgtggatgtgcttgacggcatccatacggaagccgcgaacaccagcattccacagggcggcaagatagtcagattgaatatcctggaccttttcgctctcggagtcgaagtcccacatggagctcaggcggcattcctggacttcctgctggttggcgtagttggagatgttcttggagcagctgtggaagtcggaggccgtgatgccttccggatactgttcggtggcaaatcccgggtagtcgccggtcgaaccgttgtattcggttcctgcaacgccggtctgcttgccgtcggccacgtcggcaccggtggtctggttcagcacaacgtcggcgatgatgtcaacgccgacggcattgcactgcttgatcatgtttttgaattcggcttccgtgccgagcttggaatcgagcttgtagcttaccggctggtaggacgtccaccattgcgtgccttggatggattcctgcggcggcgacacctcgacgtatgccacgtcttccggaccgtatgtgctcgtgcattccttggcgaccgtgttccatgtctgctggaaggcgatgacctgcacgtctttcttcgcattcgtttgcgcctcgggctgagcctgagccatatgcggtaccgccaccaaggtggcgcacgccatggcggcggcgacgcctatggccaccgcacggctagccggccgattcattcgctgaacgaccattgttctccgttctcatcgttgagatcgaattccggcccccatggcaggttccgcccttcgacaacgtatgcgccatggtcatccgcgttacctgcggatcatctaagacacactctgcgatgaatgtgcatacgtttgcaccctagatcggggttcatcgtacagtagatgctgcgcatcgcaatgaaacagcgtgaccgattgcaatatacggaaaagaaggacaagcgaaagaaaatgctttcagcaacaattcattgtgttgcgcaaaacggcaatcatatttgcgattgttgcagctttttctgcaaacgaatgcaatgctatgtgaaaaccggatgcccatcaagagcatccggcattcatagttcctccgagactatctcaaggggaaatcggaaaatcatcacttcgattccaacagatgcgccaccgcatccaacgccagcttgtagccatagaaccccataccggtgatagtgcccgtcgctactggcgagatcacggaacgcttgcgaaattcgtcgcgtgcggacggattggagatgtgaacctccatcagcggcaatccctcatcgatcaccatatgcgcggcatcggccagaccgtaggagtaatgggtgaaagccgccggattcatcacgaccggggtcttctcgtcggcggcctggtgcatccagccgatcatctcggcttcgtcatcgctttgacgcacttccacgtcaagaccaagctcgctgccccactgcgcgcacagggtacgcagggtttcaagatcctgcttgccatacacgtcaggctgacgcacgccaagacggccaagattcggcccattgacgaccactactttagtcatattccacttccctaccttgtttactgctgaatacgacggaacgcctcttcaacggcgtccgcaggcggatcctcaagatgaatcggatggccgacgccctcaagcaccacgaaacgaagcttattgccgcgagccttcttatcccggtgcatcaatgcgagcacatcatcccatgtgccattgttccaggacgtaggcagccccagagatcccaacaacgaacgatgatagtccacgagatcctgatcgatgtaccccagaagatgcgacagttcggccgcatacacgcaaccgaccgccaccgcattaccatgacgccagcggaaatgctcaagcttctcgatggcatgaccgagcgtatgcccatagttgaggaattcgcgcaatcccgcctctttaaggtcggcggacacatggtaggccttcacgctcacggtatgttcgatcagctccgcgaccacatccttcaggccggaatccaagaacgtcgacccgtcgaaggcacgcaattcaccggcatggtcctcgaggatctgcagaatctccgggtccatgatgaaaccggacttggcgacctcgcccaatccttcgatgaagatgtcgttcggcagtgacgcaagcgatttcagatcggcaagcactccggcaggcgtatagaaagagccgaccaggttcttcccctgaggggtattgatgccggttttaccgccggtcgaagcgtcaaccatggccagcaacgacgtcgggcagttcacgtagcgaatgccacgcatccatgtggcagccacaaaccccgccaaatcggttgccgcgccaccaccaaggccgacgatcgcgtcagaacgagtgaaaccctcatcccccaaacgctgccagataccattggccacttcaatggtcttgccggcctccgcgtcgggaatcacaatatcgtacgcatcatagcccgcctgacgcaacaaagtacgcgcacggtccgaatgacgctgcaccggctgggtgtggataagcgccactttggcaggcttgcttcccaacacctgcgcaagctggcccatcacaccctctccgatacgaacatcgtatggttcgatggtggaaccggtgacatggactatacgttgatcaatcatttccatcagctttctcgccgcggcttggggagactggccacgcgtgcccacatgcacgttcgccacgctcctgaacaccgggtcacgttccttgtagagcttcttccaacgctcattggcatcgccattaagcatcggacggcctccaccgcgatttgcccgctccatggcttcctcaggatcggccataagatacacgaccttgccgccgtccgcgatatactgcgccaatccttcctgaatggaaggcgtcatcggcgctcccccgcccaaggaaaagataccgtcgaaatcctcgagcatatcaagcacgacgtcgctttccagcctccggaattccggttccccatacttttcgaagtactcgggaatccgcattccggcatcatgctcaatctcattgtccgcatcggcgaacggcagattcatcatctgcgccacttccttgccgacacgagtcttgcccgcccccatcatgccgatgatcacggcgacaggcctacgcataccactcatagacgaatcacctcatatgctcaggccatgaggcaacgtactgctcggcgttacgcttggtttcggcaacgcaatcgccgccaaacttctcaagcacatactgcgcgatggtcaaacgcaccatcgcctcggcaacaacagccgccgccggaaccgcagtattgtcggaacgctggttaatggcctgcgccggctcgcccgtggtcacatcgacggtacgcaacgccttcggaatggaaggaatcggcttcatcgccgcacgtacgacgatcggctgcccattcgacatgccaccctcgataccgcccgcacggttgcttagacgcgcaatacggccgtcatcgcccaccaccatttcgtcatgagcctgagaacccggacgcatggcctcaaggaaaccatcaccgatctccacgcccttgatggcctgaatacccatcaccgcactggcaagagcagcatcaagacgacgatccgattcaacatacgtgcccacgcctgcgggaacgccgtacaccacaacctcgatcacaccgcccaacgtatcggcgttctccttcgcctcgtcaatacgggcaatcatccgctcttccgcattcttgtcaagagtgcgcaccggagaagcgtccaacgcctcaagatcctccggtttgggaagcgtggcctgctgcggatcggtaatacctgcgccaccaatggaaagcacatgcgaaacggtacgaataccgaacgcctgctccaagaactgcttggcaacctcacccaacgccacacgcgaagccgtctcacgcgcggaagaacgctccaacaccggacgagcatcatcaaaaccatacttacgcatgccagtcaaatccgcatgccccggacgcgggcgagacaacggggcattgcggccctcacgagcaagctcatgatcaagcggatccgcactcatcacctcagtccacttcggccactcggtgttggcgatctcaatggccaccggagaaccaatcgtctcaccaaaacgcacaccagtcagcatacgaaccttgtcctgctcgaacttcatacgcgcgccacgaccatacccaagacgacgacgcgccaacgcgccaacaatatcctccgtggtgatatgaacgcccgcgggcaatccctcaatcatggcgacaagcgcctcaccatgcgactcgcctgctgtctgccaacgcaacatgccaactccttttctcacgaatgcaactagtggactatcttaacggtatgtggtatatgatttgcctgccaagtctgctttgtggactggccatcagcgttgaagacatccgttcacgtcgcattccacgcgcctggatcgccaccggatgcacagcgcaaatcatcgtaaacctcatatacgcactttccatcaacactctgtacctggcattgcaggcaatactcttcgccgtactgtcggccgtactgcaatgcgcgctcgctttggtgaaacctggttcattgggttttggcgatgtcaccgccaccttgctgatgggattggcagtcggcatgttcggtctgttcgccgtggtgttttggtggcttgcgattggtgtggtcggcttgttatggctcgttttgtggacacgtttcgatccgcagaagcataccgcatatgccggtaaaacgccgttcgccccagcgcttgtggcagctggggcgataggcattgcgattggcgttttattctgagatcagttcgcgttctcgttgttgttcttgtactcgtcgcgaatctgccagaactcatcttcggtttccacgaatttcgtttcgccggtctgcaggtttgtggtgacaaagtacagccacttgccgtccggaggattgacggctgctgtgatcgcgccatctccagggttgctgattggcgtgggcggcagtcccttgtggattctggtgttgtacgcgttgctgtcatcgcccaactggtcatcggtcaactggcttgcggaaataccaagaccgtaggcgaccgtggtatccatgccgagagccatatcggcgtcaagacggttgagaatcactcttgccacctggccgtagtatttttcgctgccgacttccgcctccgcgatggatgcgatattcaggatgcgctcacgttcgctgcctgtaggtacgcccaaggaatcgagtttgctcactcgcgcgtcgaccatttccttgatgatgtcttccgctgacttgttttgcacattgtagctgcctggttcaagccatccctcgaatttgccgccggcctcgtcaggaaggattccagcaccgccaccgtccatcacggcttggaactgtgaaacatccaagccggacacactcgccgcattttcgatgacgtccgacacacgttcacccgcacgcacttcggcaaaaccgccggcctggctttggtcagaaagcaccttgaccacatcggacgccctcatatgcgtcctcaatgcgtatgatcccggatacaacgtggcgccagctccgcttactgcggaagtgaaggcggctgcggatttgacgattttagctttaacaaggttgtccgcgatttccgcggctccctgcccggattccacgacaaacgtcacgcctttatcgcctgggcccgtgtaatcctcgatttggctttgagaattcgcttcgttcacggccttccaatgtttcagcgcgcgcacgccgaagaatccgccgacaccgatcagcacgatcaccaccagagcggcgataatggtgatatagcggcgacgacgcttctgctcacggtgacgacgcatgtccttacgtgatttcggtggttgcggcggcattgccgaaacgaaggatgcatcatccgacgaattcacccattgcgcgttatcggagaaaaaatcgtcgagattatcagtcacaggcctctctcctctggtctctctcttcggtcgatggccgtctgcaatatcaccactgcagactgctggtcgaccatcggacggtgctttcgtccaccgacctgcgcatcgaatagctgatgatgtgcagtcaccgtagttagacgctcatccaccaattcgatggacggcacttcctttagcgcatagttctcatcatctactgcgacacgcagtctcttctcaagattaacagtccatcgccgtgcttttttcgcgcttttgccttcttctccgcttagtagcaacggcaatccgactaccacatggtcgaccgattcgtcttcgatgacgtccacgacctcgtccaatgcacggaacgaatccccgtagacctgaatattgcctgcggggtgtgcaagagtgatgccaggatcagacagtgcgagtccaaccctggcatcacctaaatcaatgccaagccaaaccatgcttggtggttcagcccttcatggcctgattggccaaagcctcaagcgcctcattgatcttggtggcatccgcgccgccaccctgggcgaagtccggcttgccgccgccaccaccgccaaggatcttggaagcgccacgaaccaaatcgccggccttgataccctgcttgcgtgcagcctcgttagtggccacggcaaccataggcttgccttcctcgttcacaccggcgagagccaccacaaccgggaattcctcaccaagctgtccgcgcacatccagcacggtcttgcgcagcgcgtcgaaagagccgaagtgctcgacgttcttcgctgccaccttgaccggagcctgggatgccttggtttcggaaaccaaagcaggcacggaagccgcaagctgggattcgtacatggtcgcaagacgacggtcggattccttgagcctggcaagcagtgcgttcacacggtcagcaagctcgtccggacgggcattgaccatgtcggaaagctgtgagaccagcgcatgctcgcgagcgttgaactcataagcgctttcgcccacaaccgcatcgacacgacgcacgccggagccgatggaggcttcggacatgatgttgatggcaccgatcttgcccacatggtcgatatgggtaccaccacaaagctcacggctccatccatcttcgccgatggagaccacgcgcacgacgtcgccatacttctcgccgaacaggtgcatggcacccaaggcgatggcgtcgtcgaacttcatctcctgcgtggtgacggcaagattttcgcgcagcttctcgttgacacgcgcctcgacggagttcatcgcatccttgctcggggcgctggaccactggaagtcgaaacgcaagcggttcggcgcgtcttcagagccgcgctgggtggcctgcgggccaagctcctcacgcagcgccttgtgcaccatgtgggtcgcggtatgcgcgcgggcgatggcaccgcgtcggtcaaggtcgatgttggcgttgacttcggcgccgacaaccaacgtgccttcggtcaggcggcactggtgcacgatgaggtccttgatcggcttctgcacatcgtcgacttcgagcacagcaccatcgtcggaaaggatctcgccctgatcggcgagctggccaccggcctgcgcatagaacggagtgcggtcgagaatgacttcgatggtggccggaccggtgactgcggggacggagcccttgccttcctgcatgatgcccagcaccttggcgcgggcggacatgtcggtgtaaccaaggaagtcgatgggctggaccagcgtcttcttgaaatcgtcatagaccgacagatccacattgtgacgcttcttcagggcatctgcacgggcacggctcttctgctcggccatgagctcgcggaacttcgcctcatcgaccttgacgccctgatcggcggccatttcgagggtgatctcaatcgggaagccgtaggtgtcgtgcagcttgaacgcatcttcgccggaaacggcgtcggatccggattccttggccttggccacagcgaggtcgaaaatctcggtgccggattccagcgtgcgacggaacgcgtcctcttcaccatatgcggcttcggacacatcgtggaaggtgtcgttgagttccggatagctcggctccatagctgccttggaggtcggcagcagggtcggcatgaccggatcggtcacgccgagctcgcgcatggccttgactgtgcggcgaagcagtcggcgcagcacgtagccgcgaccgttgttggacggacgtacgccatcggacatgatcatcaatgcggaacgcacatggtcagccacgatgcggaaacgcacatccatggcttcgtcatcaccatacgtgcggccggacagcttctgggcggcttcgatgaccgggaagacctcgtcggtctcatagatgttctgcttaccctgcatcagataggcaagacgctccaagccggcaccggtatcgatgttcttgttctcgagctcgccaacgatgtgcaggtcggtcttggacttgacgttgtcgacctcgtagttttcgaacacgagatcccagatttcgatgtaacggttctcgtcggcgatcgggccgccttccacaccgtattcaggtccgcgatccacgtagatctcggagcacggaccgccagggccagggccgccggtggtccagaagttgtcctccatgcccatgatctggatgtgttcggggtcaacgccctcgttcttccacattgaacgggcttcctcgtcgtcggtgaaggtggtcatccacagcttctccggatcgaagccgtagccgcccttgtcttgcggggtggtcagcagctcatacgcatagtggatggcttcttccttgaagtaatcaccaaaggagaaattgcccagcatctggaagaacgtgccgtgacgggtggttttgccgacctcgtcgatatccaaagtacgcacgcacttctgattggatgccatgcggctcttcggcggagtctgctcgcccatgaggtacgggatgaacgggaccatgcctgcgatggtgaacagggtggtcgggtttggagagatcagcgatgccgaaggcacgataagatggccgtgcttttcgaaataatcaagatagcgcttcgcgatttcagaagtgcgcatatgagattaagctccttttttgctgaaaggcctagtgcctttcaaacgaattcgtgattgttgtccgaacgtacgttacgggaataagatcagctgatcttatccgcgtatttggtattaagttcagcctcgcgggctcgacgcgtttcgttgaactcattgaacaaaccttcaagggtgcgcacggcgacatgatcttgatccggcccgaacagaaattgtcgagccgcatcaggggtgttggccttgacgtacgcctgtgctttggtcactgccaccgcaccgatgcccacaccaatggagatccagaagagacgcttgaacatcactcccccttgttattgctgttgacgttcttcttgttcatgaaggactgcgcggtggttttcagggcatatgcagcggaagcaaccttgataaccggcttgcccaagaaggatccatacagatcggtcagggcgctgacattattggcggttgtggaagccgctgcggaaatcttgttgacgtcttccagcgacttgttgacctgctgcaccgtggtcacactctcatcaagcgcaggaatcgcatgatctcccgtttctttgactgtctcggcgagctggtcgaacagtttgccgagacgaatcaacgggtagatcatgaaaccggcaagaatcgcgaaagcgattgccgcaatcagaccggcgatttctccaacacccatcttgtacctcttttcagtcccacggttgcccgcgaacacaacacgcgcataacagtagtaaaaagcccagacctaaggcaagtttcgtccgccggtcactggttatacgatacgacggttaccgcttcagcgataggcttactggtgtcgaaatcgagcgtggtgaccgatccgttcgcagggcgttcgctgaggtcatagccttccggcgcgaaacggtgcataaggctcagcagcgtgttgccgtgggaaatctgcaacacgtcatcactgtccctcagcgcaggattcgaagcgatcagcgcgaatccctcctcgactctcgaccaatattccacgtcggactcggcatcgtggaatggatccgcttccttaaggaagtcgcgggtcgcaccaagaccgaactttgcgacgatgtcgttgtagttcttcgcaccgtgcggccctcccgcggcggtccacgccacgcccatatcctggccttcgaaatagccgtagaactgttcgcggaaatgcatgtcactgaccagttgggggcgggtgtgtcctgcggcctcattcacgtcgaggatgcgctgggctgtcatttgcgcacgcgtggtgtcggagcaatatgccgcggcgaaatcaaactccttcagtttgtttgcggctttgtctgcgtcggcgatgccggattccgtcaatggagaattagaccagccctgcaacctgttatatcggttgaaaaacgtctgcccgtgtcggacaagatgaagatgaagcaacatgggttccatgctaccctcacggtttgagcaaatccgtgctatacgatgttgttatgggtcattttatttcacgttggctaattcttaccgtcgcggcgggcgttatggttgcggttctgcccggcatgcacgccattggcgagccccctgtgcttggcatcgcggcgttcgccttgttcatggcgcttatcaatgcttccataaagccgattatccatgtcatagcgttgccgttctcgattatttcgttcggactggtcgcactggtgatcaattggctgttcatgcagcttgcgtcatggttggcgctgtcgtttttctctgtgggcgtcactattgacggattcgcatggtctgtgcttggctcacttgttatgacgattgtgagcggcatagtaggcggcatcatcggcgactgaaggcttcccgttgctcaaaaaggccgcacatgcgcttgagatagcgaagagcctcgcaatcctgacgattgcgaggctcttgctgtatgtccttatactgtatgttcttacagtatgtagatccagatcagcgggcgtagaattcgaccacgtactggatgttgacctgcaccgggatttcctcggcttcaggcttgcgagtcagggtggccttcagggaaggcaggttgacgtccagatagcccggaaccggcggcagcacatcgcggtgagtgccttcggccgcaatctggaacggaaccatggtctggctcttggccttgacctgaatggtctggccaggcttgacgcggtaggacgggcggtcgacgatgttgccgtcaacgaggatgtggcggtgaaccacgaactgacgtgcctgagcggtggtgcgggcgaagcctgcacgcaggaccagggcgtcgagacgggtctcgagatcgatcagcatggcgttaccggtctggccggcggtgtgggtgcccttctcgtaagcggcgcgaagctgcttctcagagatgccatactgagcgcgaagacgctgcttttcgcgcagacgcactgcgtaatcggactcagtgcgacggcgggtgcggccgtgctcacccggagcgtacggacgcttttcgaagatgcgctgagccttaggggtcagagcgatgccgagggcgcgggaaaggcgcacctgacggcgagaacgctgaacgttcgtcattggtttaatcctttgtttgttctgtcgttgtctgaacggagcgcacaccggtttccgatatgcgctgagccagcctctccagtgcttcttcgtgcatgcgcacgaacgacttgaacacgtgccgtaaacagctcgtatcggtcgccgacccactgatgggctaagactccagacggtatgctcccttgcgggcgcacaccaatcgttaataatacacatgagggcgggacgagctcgtcgtttcgccctcttcggcatgtcatgccatcatggcgccgctatgcttcagccagcactcccctgtccatgcgatagattcgatccacatacgtcaaggcatccggatcatgggtgaccatcaacactgcggtgccgtcgtgcgccacttcctgcagcagccgcatgacgatggcagtgctttcggcatccagatctccggtgggttcgtccgctatcagaagtttcggaccattcatcagagctcgcgctatgctgacgcgtctcatttcgccgccggaaagctctttcgggtagcattccgccaaatcgtcgacctgcagtcggcgcagcaatgcgtgcgcacgttccatggcatggtcctgaacgggatcgttgtgtgttttcgataccggagccgccgcgatgacgtccggaagtccgtcgtcaaccgtctgttcggaagatgcgtcggatacggtttcttccactgatttcgcatcagacgaatccgcaggtatctcaacatcgcgctgcgccgttttgccgttgcacagcacggaaggaagaatcacattgtcgagtgccgtgagattcggcagcaatgtctggctttgcgtgacgaatccgacgatccgattgcgtacgactgacatttgtttgtcgttcaaccgcgtcacgtcattgccgtccaagtcgatagagcccgatgtgggtttcagcagtccggtgatgagattcaacaatgtgcttttgccattgcccgaacggccgacgatcgccacgaactcgccttggcccagcctgaaatccacatggtccacggctgcgaacggtttgccgcgacgggtgaactcgcgagtgagctcttgtacttcgagaaccgtgttttccgccatcattcaccttctctcaaagtcagataggtttcgggagcggaaagtttcaccgccgtcgtcacggaggcgagcagtccggtaagcaccgcgaacacgaaactcactgcgatcaatgccaacacattccacatgttggtttgcagatacggcaactgcagctgccgtccgataagcgtgctgaacgggaaaatcgccagcgacgcgaccgcaatgcctatcacaccgcccaaagctccgatcatggccgattccttcacgatgatgccgaccaaagtggaacgattggcaccaagaatgcgatacgcggcgaattcacgtttgcgttcgttcatggcggacgagaacacagcaagcagcacgatcagccccatgacccagaacaccgcgacgaaaagggtcacgtagcgaatgatcacgttcagattggatttcgttgtggctgtgatgccccccggatacacgtatccgaggcttttgattcctgttgttttggtgatgttcgaagcgacctgctgggcggagtaaccgtccttgaccttgatgagcacggcggaaacggctttgtcggcatattcttccggaatggcggcatgccccaccttggcggaatatccgaccacgtcgggaacggtctgcatgttcacgaacacggaatcgtcgagcgacgtgccggtattggcgagttgcgccgccacggggaattcgtgcccatagagtttgaccgtgttgttgcccgacacgctgatgctggctcctgcaacgatctggccgcgctggagcgtgccgtcgaactgcgatgcgatccaaggggtgatcacgaagtcggtatcggggttgaatccgatgatctggactttctcgtcgcagcatgcggcggccaacgatgagatatatgtttgttccgtgatttcgtcgatgccgtcggcttttgccacttcgtcggtgatctcgttggtgaagtagaacgtgcttgccgatccgttggtcagcaacgcttcggcttcgtttttggtgttttgcggcgtgaccatgagatcggcgcccatacgttcctgcatgctgttcaagccggcttcaaggttcatggacagcagtgaaccaccatagaaggccacggtaagcatggcgacaacgatggtgagcgccgcggtacgaaacggtttgcgtttgagattgaccaggggcaacccgccaagggtgatgtgttgcgtcatattgggtcaggcgcgcttcgccggcttgagatcgagatatgccgcgattgccgcaagtacagccagcagcacgccgagcacgatcagcgtcggcaaggtgaccatatggcagcgcatcatggcacccttgcacacgccgatgagcacggtcggcacggcgatggtcagcacgccgagcaccgcattggcgaggtcaagaccggcgcgggtctgatcggatacgaacaggccgacaatgccaagcgccacgatcacgatgccgatgccgagcgcggcctgagccgtgtaatgacatgccatcggcgtttctttgaccgcgcatacgtgagcgaaggtctgcggcgcgatggcgatcaagatgccgagcacgatctgcgaaatgcctgcgtacagtttcttattcatagcttcctctcaaaaaaagacaaacaccgccgattattgcagggtctctttgaaaaagaaagtcttgttttttcctccttttcgtgctacagaggagatttcatccgttcttcatctccgtcatagcatttcaatgggtgccatacgcaacagcagacgcttgacctcaccattgccaaaatcaacggtaatgaccgaattcatgcccttgtcctgcgtttcaatgaccgtacccaacccgaaatgatcatgcgtaagcttgtcgccgacatgcacgtctgcaatgttcagatcattatggctaccggccgggcttgcggatgaggatttggttaaatccacaggcttgtttttcggcttgacacgtcgcgtggtgaccttgcccgatttccctcctgacttgccggagccatacgaaccatacgagccgtatgaggaaccggtccccgatcctccgcacgagcgccgggatgtggaaccatacgaggatgatgagccctgcgtagccgggccgccgtactgcgagcgccctgccccatatgaagacgatccgtatgaggaacgagaccaccgcgagccggaaccgtatgaggaaccataatccgactttccatacgaggaaccgccgaatgacatcgatccgaaatcgtcatcatcgtcccagccgccgaactcgtcgtcgtcatcctgccagctggcacgcatgcgttcggcgccggcttcgcgtcttttccaatcaatcagttcgtctggaatctcatcgaggaactgactgggcatcatgtcgctggcttgcccccattgcgcgcgtacggccgcgcgtgtcacatacaggcgtcgcttcgcgcgagtgatgcccacgtaggcgagacggcgctcctctgccagttcgctggtgtcttccatggcacgctggtgtgggaatgtgccttgctccatgccggtcaggaacacatacgggtattccagaccctttgcggtatgcagggtcatcatcgtcaccttgccggaatcttcgttctcccctggcaattggtcggaatcggccaccaacgcggtggtttccaaaaatcccgccaatgtggcgtctggcgtgttctgctcgaattccgccgccactgattgcagctgggaaagattatcgacgcgggaagcgtcctgcggatcctcggagcgctgcagctcttccaaaatcccactcttggcaagcacttcggcaaccacttcggatggcttcgtgtcatggtccttcgcaaaagccgcaagctcatgcatcatgtctcggaacgcactcaacggtttcgtcgtgcgcgtggacatgccttcgatctgttccatatgttcgatcgcttcgaaaaaagtggtgccatgggcatcagcatacgaggcaacgagtccttccgcacgaacgcccagtccgcgcttcggcacattgaggatacgtcgaacgttcacattgtccgcaggattcacgatggcctgcaaatacgcgagcgcatccttgatttccctacgctcgtagaatttggtgccaccgaccagctgatatggaagattggcattaatcatggcttcttcaagcgaacgtgattgcgcgttggcacggtacatgatggcgatgtcgcggtatgcgatgccttcctcttcgtggattcgcgcgatttcgttggctatccaccctgcttcctgttgtgcgttgtcggccgcgtatccgacgattttgtcgccttcgccaagtgctgtccacaattttttcggcttgcgattttcatttcttgcaatcaccgcgttggctgcgtcgagaatggtctgcgtcgaacgataattctgctcaagcatgatggttttcgcattagggaaatcctgctcgaaatcctgaatattacgaatatccgcgcctcggaacgcataaatcgactggtcggaatcacctaccaccgtaatccaagacggtccgacacggcccgctcctcgcatatgcggatcgggctgttctcctgaatcaatgccggaaagctcacgtacgagcacatattgcgcatgattggtgtcctgatactcgtccacgaaaacataacggaacttgtgccggtagtattcgctcacctgtgggcaacgctggaacaattcgacggtgcgcatgatcaggtcgtcaaaatccacggcgttcgccatggccagacggcgctggtactccgcatagaccacggcgaccagctcgtcgacgtcgccggccgaaacctgatatccgcgctggcctggcttgtagtcgcagttcacgttttttaactggtcctgccatgaagtcaatgaattcttgcagtcggagattttgccgagcagcatgcgcggcgtataccgtttcgtatcgatgttcaaatcgccgctgatgagcttgaccaaacgttcgcaatcagccgtgtcataaatggagaatccagaggtaaggccgatttccttgccgtctcgtcggaggatacgcacgcacgcggaatggaaggtggagatccacatatgttcggcttcaggccccacgagagcagcaagacgttcacgcatttccgctgcggccttgttcgtgaaggtgatggcgagaatgctgctcgcccaaaaaccgtgtgccagcagccatgcgatgcgtctggtgagcacgcgggtcttaccggatccggcgcctgctccgataagcagggcctggccgtagtacttcaccgcttccatctgttgcggattgaggtccttgattagactttgcggatcgcacaggcttggccccatattctgctccaccggttcctctttccatgaagattcaaagtcgattactgcgaaattcatgtctatcacacatgcaggtcagcgcaacactcgcatggtcaattgacacgcgtatgctgaacgtttatatgcggttcaccgtatgtcaacatcaacgccgccttatgcggccaacaatctaaggggattcatgaaggagctcgaagagcgcattcgcctgcagggtaccgtcaaaccgggtaatgtgctgaaagtggacgctttcctcaaccaccagtgcgatgtcgaattgttcgaccgcatgggtgccgcttgggcggagcattttgccgataagaccatcaataagatcctgaccattgaagcttccggcattggtatcgcctgtgttgccgcgcgtcatttcgacaatgcacctgtggtgttcgccaagaaggcgcagtccatcaatctcgatggcgaccagtacaccaccaccgtctactccttcaccaagcagaaggaattccccgtcatcgtgtccaagaggtatctcaacgaaggcgaccatgtgctgttgcttgatgacttcctggccaacggcaaggctctgaagggcctgattaatctgtgccatgatgccggagcgacggtcgagggcatcggcatcgcggtggagaagggtttccaaggcggcggcgatgagttgcgtgcagcgggatacgacgttgattccctggcaatcgtggagtcgatggatccggaaaccggtgtcatcgagttccgctcctgatcgtcgtatcttagggcacgtatcagcaaccattacaacctgttgctcatcacagtatgaatgaataagagaggattcgttgtgagcgaagagaagaagaaagacaatacgaacgaaaagaagggcgtttcctttgaagcactaagcagcttggacgcacctgtttcgttctggaagggcatcccgttcggcctgcagcatgtcatggcgatgttcgtggccaatctggctccgattttcctagtggcttccgccgccaacatgagtgccgagcagtctgccacgatcattcaggccggtctgctggtggcaggtctgggcacttgcctgcagctgtacggcgtgtggctgatcggctcccgactgccaatggtcacgggcatttccttcacctatgtggccgccgccatgtcgatcgcccagcatcaaggctatggcgcggttgccggcgcagtcgtgcttggcggcctgttggaggtagtgcttggtttgaccgccaagtattggcgtcgtttcgtgccgccgatcgtatccgcgattgtggttacgtcgattggtttttcgctgctttccgttggtgccaccagtttcggcggtggttccggcgctaaggatttcggaagctggcagaatcttacgctcggtctgatttcgctggtcgcctgcttggctttccagctgctgatgaagggtaccgccaagcagctttccgtgctgttcggcttggttgtcggctatgttgcagcgatttttatgggcaaggtcgatttctctggattctcgaatctgcaggccgtgtccgtgccgcatttcatgcctttccagcttgaattcgatccgggtgcgattatctccttcgccttgctgtacgtcgtgtcttccgtagaggtgctcggcgataccgcggcactcaccaaggttggtctcgaccgtcagcctaccgataaggagactgcaggcgccattgcaggagacggtctcatctcctccgtctctggcctgttcggatgcctcccgttgacgtcgttcgcacagaatatcggcttggtcgccatgaccaaggtcgtcaatcgtaaggtgattctttccggtggtctgattctgatgatagccagcttcgtgcctgctgtggcggaagtgttcaattccctgccgcaggccgtgcttggcggctgcaccatcatgatgttcggtaacatcattctgtctggcttccagatgatttccgaggccggctacacgcagcgcaacatcaccattgcagcgttgagcctcaccatcggtatcggtttcacgcaggtcggtgacattttcgtcaacttcccgccgctgttccagtccatcttcgcatccaactgcatcgctgtgtcgttcgttgtggccgtgctgttgaacgcgctgctgccgagcgaagagcatttcctgtcggctccgcagcatcaggaagactgagactattcagtcttaaggtgatatgaggaatccccctgctcaaacgagtcagggggattcctcatattcatcgcaaaactgctttatcacgattcacgagaagctattctcagtgtccttgcttaatccagttcgtaatcgcatccttaacggcttgggcgtacaacgtattggacatgccggggtgaataccatctccggcaagctcatcaggatacgccgaaatcgtagcatcccagtcaacgagaacaacattgtcggaatgggcggccgcgaagtcgctcaacgcgtcgttcgttccggaaacccaagacacaggggcatgcgcgttaatcagcacaagcacatgattcggtccaatgtcgttcagtatgtcattgagttggacatcggtcaccgctgaattcgtagccaagccgaccagcacccattggcgcaatccttccggctggcttttggctttgtctataagtcccaacgccttgatcatcgagcgtgaggtttccgcatcaacagtgattccagggaaaacggattgcaaacctttactggaggcaagcatcaccgagtcaccgaatgcgaccatctgctgcccgttaggcatggtgtgtacgggtttcttgggcgttggcggatgcttcctatcgaagtcgagatgcatgccctgctgctctttcagcattctcgcattctcttccaacgcgcgttccacactggtctgctttggtgcgttgtccaccacgtatccggacatcaagcatgtgctcaataccacgacgatcgttatccagcatctggcagcatcccacatgccattttccggaagaggacgaatcatggcgatgaatccgcctcgggcaacaggctgttccactaacttccacgacatggcggtacaacatgcggtaagagcgagcgtgattagcagcatccatccaagatgccgcgcaccccactgggggaacatcgccttggtgaacaaccataaaggccaatgccacaggtaaatgccgtatgaatatcggccgaccacatcaagtggtttgaacaccagcagatcctgcatccaagatccgaaaggaatggaaccggcgaccagaaccactgaaagtagcgaagccgcgaaaatccctccatagaaagcagcaggaccctgctcaacgtgctgcatcatccataacagaatcagtaatgccacaaaagccaccgcagggccgatcttgctccagaccagacgagcgcattccatgatcgccgtttcctccggacgaccgttgccacgccgtatgatcatcagcagccatgccagcatggcacctagccaaagtcccatggcatgtgtgtccgaaccgaaatacactctggttggatcggttcccgggtgatactgcaatcccatggaaagcgcactgcacacggcaagtccggcaagtaccgccaccggcacccaacgtaccagaatttttcgaagcaggtagatcagcaaaggagccaacagatagaactgcatcagcaccgacatgaaccacagatgacggaacatgtctggattcatctgcgagaaatagttggcgccactgccgatggcataccagttgtaacaacccagcatagccgtcactatctggttgttaatgcccaccaacatgtcttggttgatgaaccatgccaacgatacggtgacgggaatcatcagaatcagcgccgggtatattctgcgcagacgcttgaggtagtattccttgaaacctattcccttgccggaatcaatatgattcagcaacgacgagaaaatcagaaaacctgaaatggtgaagaatatgtcaacacctaggaatccgccccgcagagtgccctggtcgcagtgatacaacactatcgcgatcaaggcgatgcccttgaggccattcagaccgacaaaacgacgtcttaccacaacaatcaaccgcttctctcaacatgcgacgtatgcgcgttaggcacaacgtttcgtatcgtactaccagcccctcccccattatgcggaccatgaacagatatggaaagtcattgtctgggacgattggaaacgttcggcgatcgaaaccttaaaagcggtgaaacataaggattattcgaaaaagaaaggaccgtacgtcccattggcattggatttgattccaatggaacgtacggtcctcttcatacggtcccgtcaatcatttgactgcgggatctcctcgctcacttggagaagacgttgccgtaagtgtcttcgcctgcttctgcgattgccgcggacttgcgggcgattgccagctcctcgttggtcggaatgacgcagatggtgatcttggaatccggggtggagatgatgcgcggttccttggaacgggtggcgttcttctcttcgtccagcttgacgccgaacggggcgagcttgtcgcacaccatcttgcggaccacgtcatcgttctcgccgacgcctgcggtgaaggtgatcacgtctacgccgcccatctgagcggtgtagttgccgatgtagccgacgatgcggtgtacgtagacgtcgagagccagcttggcgtcctcgttgccttcggcgaccagacggtgaacctcacggaggtcgccgaagccggtcatgcccatcatgccggaacgcttgttgaacagagcgtcgagctcgtccacgttcatgtgggcgttgcggatcaggtggaagacgacggccggatcgatatcgccggtacggccacccatcatgaggccttcgagcggagtcaggcccatggaggtctcgaccggcttgccggaaacttcggcggaggcggaagcgccgttgccgatatgcagcacgatctgcttgaggccttcagccggcttaccgatgacgctcggcaccacggaagagatgaactcgtgggaggtgccgtgggcgccgtaacggcggatgtggtactggtcggcgatttccttgttcagcgcgtaggtgcttgcggccttcggcagctggaagaagaaggaggaatcgaacacgaagatctgcgggacgtccggcaggagcgcgcgcatgacttcagcacccttggcttccggaccgttgtgcagcggcgcgagcacggcgaggtccttgacctggttgatggtcttgtcggtgaccagagccgggttcgggaagatggaaccaccctgcaccacgcggtgaccaacagccacgatgccggcctcgtccagcttcggaccgaactcgttgaagaagccgagcacgcgcttcagaccctgctcgtggtcgtggatcggctcttccagctcatgcttctcgccgttgaactcgtgcttgtagtggccgtcaaccggctcgccgatcttctcgaccaggccggaagcaataccttcaccggtttcaagatcaaccagctgatacttgatagagctggaaccggaattgatgacaaggacggttttcgccattgtgggcatcctccatgtgttaatcgatgtgccgcttgcgcgactttccaaactttagattactctttgcttgctacaaaatagcgttttactgggcttcgatggcggtcagggcaaccgtgttgatgatgtcctgcacggttgcgcctcggctcaggtcgttgaccggtcggttcagtccctgcagcaccggaccgacggccactgcgccggaggaacgctggacggccttgtacccgatgttgcccgcgcacagatccgggaacacgaacacattgacatggcccgccacatcgttgcccttggccttggtggctgcaacggtcggcgaccaagccgcgtcgaactggatgggaccgacgaccgcgaggtccggagccttctccttcacgagtgcggttgcttcctccacgagatcaacgtccggtcccttgccggatcccagcgtggagtacgacagcatgccgaccttcggatcgaggccgaacgcctttgccgtttcggcggactggatggcgatttccgcaagctgctcagcggacgggttcaggttgatggcgcaatcggagaacactgcgacatggtccttgaagcacatgaggaacgcgccggacacgagggaagttcccggcttggtcttaatgacctgcagggccgggcgtacggtgttggccgtggagttgatggatccggaaaccagaccgtcagccttgccgagcaccacaagcatggtgccgaaatagctgtcgtcggtgagctgcttgcgagcctgttcttcggtcatgcccttcttggcgcgcagttcgcacagcttggcgaccatcggagcgagcacttcctcgtcgtccttggcctggaactgcgccttttcgagggatttgagaccaagctcctcgccgcgggcgagaatgccttccctgtctccgacgatgatcagatcgacgatgtcgcgctcaagcaggtagtcggcggccttgatgatgcggtcttcggatccttccggaagcacgatggttttcttgtccgccttggccttgcccagcagactgtactggaatgcgtatggcgtggtcggcgcctcgaatggagcctcaacagcggagataagctcttcggcgttgacattcgcctcgaatgcctccgtggccttggtcacggcgtcttcctcgtcaaaatcaacggcgggtaacgtccacaccggcacctcgtaagctgcgaactcctccttgagaggttccacctgttcgtctttgcatccggtgatgaacacgccggcgaccttgctgcctgcattctcgatgatggtcttcgacgcctcgacagtgcccaggacctgttccggagtgcggttgatggtgcatacggcaagaagcacgacagacttgagatcagcggctacgtcagcattgaacgcaaagatggacgggtcgttgatggcggatttgtccgttccgacaacaaccacggcttcgggctgggcggtttcgatggcttccgtgtaggcggccacgatatcggcccgggaaccttccttgtcggtgcgtgcacgcttcgggcaaacaccgacggattgttcacggctcagccccgagttgcttgcttcaagaagaacgtcggcgaaggtttccttgcgacaaaccgccggacggaacacggccgtcttcttggcagctgcgaatgccttggtgacgccaagggccacgacgttgcggccgtttgctgcttcagggctgataatggtgacgctggttagactcacgatgtctgctcctattcgttgtttttaaggtgtgtgactgcgctgtttcgcaccatgtgccattgtaatgcgtgaacggtaacagacacgcatttcatgacatggtgtcacaacgcattacaaagttacggatatggcaaaagccccaagggaaaatcccttggggctttgttcaagcaatcagcctatagaggctagactcactcgttatcgccagcggttgcggcggtagcggagacagcaccctgcttggtggtgttgacgccagagtagacccaatcggtgtaatccgggtgatcgtagccgttgtcgactgcgaactggaaggcttcctgacggaaggcttcgagctcgttgatcttgtcggcgtacttgtcagcatcgatcatgcgcagagcttcggcaacgagctcgtagcggtcgatgttgttcacgcgaaccatgtcgtacggggtggtggtggagccctgctcctcgtagccgtggacgttgaagttgtcgtggttcgggcgatcgtagatcagaccacgcacgtcgcgagcgtaggagtggtaagcgaacaggaccggcttgtcttcggtgaacaggtcagcgaagtcagcgtcggagatagcctgatcgttctccttggtggactgcagcttgaccagatccacaacgttgacgaccttgaacttgatgccgagctcgttgagcttgtcggcagcagccatgatctcctgagccggaacgtcgccagcggaggcgagcacgatctgggcttcgtcgttggacttggcggtggaagcccactcccactcggcagcgcccttctcgagctcagcgcgagcttcgtccagggtcagccaggtagcggccggctgcttaccagcaatgatcgcgttgatcatgttggtggacttgtagcacttctcagccacagcgagcagcatgttggaatccaccgggaagtagatgccgatcacgtgatcgttgttgaagcacttgttcagcaggacggaggtgacacccggatcctggtgagagaagccgttgtgatcctgacgccacacgtgggaggagacgagcaggttcatggaggagatcggcttgcgccacgggatctcgcggacggtagcctcgagccacttggcgtgctggttcagcatggagtcgatcacgtgcacgaaggactcgtaggagctccagatgccgtgacgaccggtgagcaggtaggcctcgaggaagccttccatctggtgctcggagagctgctcagtgacctggccggtgacagccatgtgctcgtcaacctgggaggacaggtagccggcgtcccactgcttgttggtgacgtcgtaagcggcctgcagacggttggaagcggtctcgtccggtccgaagatgcggaaggagtccgggttgttcttgatgatgtcgcgagtgtagacgcccagacgacgggtggcttcgagctggccccagccgtggccgtactcggcgacttccttgacctcgtagtcttcgagggccggcaggttcagctcttcgcggatcacaccaccgttggcattcgggttggcaccgatgcgcagttcgccggtcggcatgaaggcggtgacttccggcttcacggcaccgttctcgtcgaacagttcttccggcttgtaggactcgagccagttcttgaggacttcgaagtgagcctcggtatcgcgggcggaagccagcgggacctggtgggaacgccaggagccttcggtcttcttgccgtcgatgaacttcgggcaggtccagcccttcggggtgcggaagatgatcatcgggtagaacggacgagtcatgtcgtcggtctgggctgcggccttgatgtcgcagatctcgtcgaagacggtctcgaacagctcggcgaaacgacggtggatcgacaggtgatcctcgttgtcgaagccagcgacgaactcgtacggctcatagcccatgccgtggaagaactcgtggagctcttcgtcggagatgcgggacaggatggtcgggttggcgatcttgtagccgttgaggtgcaggatcggcagcacgataccgtcggtgcgcgggttgacgagcttgttggactgccagccggtggccagcgggccggtctcagcttcgccgtcgccgacgatggccggaacgaacaggctcgggttgttcatcacagcaccgtaggcgtgagacagggcgtaacccagctcgccaccttcgtggatggagcccggagtctccggagcgtagtgggacgggatgccgcccgggtaggagaactggcggaagaacttctgcagaccagcttcgtccttggtgatcttcgggaaggtctcagtgtaggtgccgtccaggtaggactgagcggtaccagccgggccgccgtggcccgggcccatgatgatcacagtgttctgctggtgatcagcgatgagacggttgatgtggccgatgaggaagttcaggcccggggtggtgccccagtgaccgaccagacggtgcttgacgtcttcgcgggtgaaaggctccttcatcagcgggttgctacgcagatagatctggccgatggagaggtagttggctgcacgccagtacttatccacgccttcgatagcttcctcggaaaccggagcgttcagcttcttccaaggggtgccaataacaggactcgtcatgtgtactcctgtactcctgcactgtgttgtgcgattgtttattttcattcggtcctgaatctcgcaaaaccttgcggttccgcggaacgattcattcccaatcacttgagcatattacgagcgaggtgcgactttttgctgtttttttgcgactgtgtgcgcaagtgtgtcgtttctgttagaaaatgagaacttttatcgggagatttgtgaatacttcacatggtatcaaaaagattgataaacggctcaatatcaacgatattgagctaccttcgcacctttttcacgttcgttttgcaatacttgcatgcggcgtgttgaaccatgcgtagtaagcaattgtgaggtttgttcactttctgttcacagcgtttccaatgtctgctcgcgtcgccacaatagaacagttagtattgttgcttcttcatacctcatatcaaaagggagagtgttatggctgcaggtcctgtgctcgttgttgatttcggagcccagtacgcccagctgatcgcacgtcgcgtgcgtgaagccaatgtttattcggagcttgtgccgcattccatgccggtcgacgagatgctggccaaggatccgcaggccatcatcctttccggtggtccggcttcggtgttcgaaccgggcgcgccgcgtgtggacaagaaactgttcgaggccggcgttcccgtactgggcatctgctacggcttccaggccatggcctatgccttgggcgcgaatgtcgacaaggccgcccttggcgaatatggcaagaccgagaccttcatcgacaagtcggaaggcctgctcgaaggctcccccgccgatcagaacacgtggatgagccatggcgtggccgtcaagaccgcgccggagggctttgaagtgctggcgcataccgagggcgcgcccgttgccgccatgcaggacgaatcccgcaaactgtacggcgtgcagtggcatcctgaagtcaagcacaccccgatgggccagcagctcatcgagaccttcctgcacaagtgcgcagggctcggcaacaactgggatgcctccagcatcatcgaggatcaggtcgcgaagatccgcgagaaggtcggcgacgcacaggtgatttgcggcctgtccggcggcgttgattccgcagtcgcggcggctctcgtgcacaaggccatcggcgaccagctcacctgcgtgttcgtggaccacggtctgctgcgcaagggcgaggccgagcaggtcaagcatgttttcgtcgaggcgaccggcatcaagctcatcgccgtggacgcctccgaagacttcctcaccgccctgaagggtgtgagcgagccggagaagaagcgcaagatcatcggcgaaaagttcattcgcacgttcgagaaggctcagcgccaggtcatcgaagaggcgggtgcttccggcaaggaagtcaagttcctcgttcagggcaccctctacccggatgttgtggaatccggcggtggcgacggcgcagccaacatcaagtcgcaccacaatgtgggtggcctgccggacgacatcaagttccagctcgtcgagccactgcgtaccttgttcaaggatgaggttcgtgccatcggtaccgagcttggattgccggacgaaatcgtctggcgtcagccgttccctggcccgggcctcggcatccgcatcatcggcgagatcaccaaggagcgtctggatctgcttcgcgaggccgacgccatcgctcgcgaggagctttccaaggccggtcttgaccgcgatatctggcagtgcccggtcgtgctccttgccgatgtgcattccgtgggtgtgcagggcgacgagcgtacctacggttcgccaatcgtgcttcgtccggtttcctccgaagacgccatgaccgcagactggtctcgcattccgtacgatgtgcttgccacgatttcgacgcgtatcaccaatgaatgccgtcagatcaaccgtgtggtgctcgactgcacctccaagccgccggcaaccatcgagtgggagtagttccccttggtttagatgtgccgaaaaacccagtatttatgcgggtttcgggacttggtacttttcgggcaaccgattttgcaacagatgaaatagtcccccttggcttgcaactaaacctaaaaatcgcataatttttaaggcttttgccctgttttgggcagaagcctttttgcatatttgataaaattttctctttaatatatcatcaaatcagataaaacagcgaggtggatagtatgaaaacagaaaaaataccatatatatttaagtacaaaagaaagaaacgaaattgttgctttccttataaatctaaaaaaacaaattgattgaacaaggcagatacaccgacgccgtcgatgatgttctctgcaaagtgctttctgccaagaaaagaaagctcaaaatcaaataatcttgccacgacataagaccgcctacacgatgtaagcggtcttatgttttagttcgataaactggaatttctatttgtgttgccatgtcattacataatctttttctccggtagcctcatctaagccactatgctgaatctcaaatccttctctcttataaaaagatattgcccgtgcgttcttttggtatacgttcaagtgcaacttattccttttatcccttgcataattcagcagaattttacctataccctgcgattgcatttcaccagaaacaaaaatgccctcaacatattcatcatttaaccctataaaaccctgtatttctgtatcatactcatacacataaacctctgctagtaacagcgcttcttttgctgatctgaaattgcttttccagtattcggcggggataaaattatgtgcctttatatttgtatccaaccatatatctgcaactttatttatatcatcccttttaaattctctaatcataacggtgactctccataaacttgaatttaaattataacggtctttgcaaatacaccatatctaccagctgtattccactctcatagattgggtggtcataattatctataaagaaatttgatatgatatgcgaacggacaaaaccacacttttcataaaatggtattgtcagtgggctatcgcccgttcccacttgcagaatggcatattgctctctgtaattattaacaataaactcaattaaggctcttgcataacctttcccttgatattctggaaccgtcgcaatgttcttgatttcaagtatgtcattttctttatcggttatgacacactcacacttgaccccattatcatcaagtacatacatcttgccgttatcaagataacggtcaaccatatcttcctgctcatctgctaataggagcaaatcaagatattgttttttattttctttaacttcaataattttcatcaatcgcacctacaaattctgatttatcaatctttaatatcacatattatacatcataaatatgaaaatttctacccgccatctgttgacctcaaatttaaaacaggcggctttttttattttcaaaaaaagttgaaaaatttttgctcagagggggcgcaaaatgcctctcccagttcaaacaagtgagtgggagtgattccaagctgattcgttactgaacgcaaaatcgcaatcaatatgatgaagcccccgaaagtgcgaaacttccggggcttcatcatgctttccgccttctaggctcgagccagataacacctctcaaggtgtcggacgcctcgtcgctgcttacctctttacgtacggtgtcaggtttccattggttccgtgtttttcgtaggcattatgacgtttgcgagcgccactacctttgccatgttggggccggacaaggccaagccgtgtcaggaaagctaagaaccatcgtggcttgacatagcggcatccgcagaatgattacgatcctgtgcaaacgtagaatgtccttcctccgtttttgcggaggaaggacattttcataccgttttcaatattatttgcggattatcctggacaatcattgctaggccagcatgctggtccacatgtttgcgaaatcaggaagcgttttcgcagtggtggcgatgttcttgattagaatgccgttgattttcagccccagcatcgcagcgaacgtcgccatgcgatggtccgcataggtttccatttcagccggcctgagattcgttgccggcactggcacgatctccagaccgtcggccagctcacgggcttctcccccgactctggtgatttcgttgaccaatgcttccagacggttcgtctcgtggccgcgcaagtggccgatgcccagcatgcgcgtaggcttgtcggcgaagaccaggattgcggccagcgatggcgcaatctcgccggccgcagtcaggtcgaaatcacccaagccgttgatatggctgctgccggtcacttcgcagtaccggacgccgtcgatcacggggaagctgatttcagcgcccatatgttccaagtatccgggaagcaggccgcccggctgggtggtggattccggccaatggggcacgcgcacggttcctccggcgatgagcgctgcgccaaggaacggggcggcattcgacaggtcaggctcgaccgtcacggtttcgggcaactgcacggctcccggctgcacggtccacacgcgggcgtgttcgtctgcgttggcacgcacaccggaaccttgcagatcggccacggtcatgcgaatatgcggtaaactcggtgtcttctcccccgtgtgatgcagttccaaaccgcctggcactcgagagccgacgagcaatagtcccgaaataaactgcgaggatcccgaagaatcaatgctgactacgctcggctcggcgcactggctcaccgtttgaggtggaatgattgtaaatggcaggcgcccttcctcgccgtggtattcgatacatgcccccaactgttcaagaccgtccaacacgggcttcatcggacgcgcatacgcctgctcgtcaccgtcgaaatccacaggaccgtccgcgaacatggcaagaccgggcacaaagcgcatcaccgttcccgcaagaccgcagaacaccttcgtaccaccgtggaaccggccgtcggacggcggcaccaccgtaaccgtggtgtcaacctgctcatcgatttcgcagcgcactcccaacgaacgcagtgcgtccatcatcagctcggtatcacgcgagcgcaacagaccgaccaatcgcacaggacgatgcccgagagccgcaagaatgagataacggttcgacagggatttgctgcccggcaccacaacggtggcgtcgagcggcttgccggcaaacggcgccgaccaaagattctcttgagatgcgttcatagggcttatcgtatccaaaacccgaggaaaacaacgcttcaatctcgccatacagcacccgtatcttgctcgaactcgacaatcaaatgccatccataccatttccgtttgaaaacccaggcggacagaactatgcgaatatcacaaaatgccacgaggaattcccgcgatcgtcgtgtttgtaccggaaaccggggaaaggatttttcaaaccgtctgaaacacctttgtttccaacggttttggtcgggctgacaggatttgaacctgcgacattctgctcccaaagcagacgcgctaccaaactgcgctacagcccgttcacgttcacaccccgcgaatccgcctcacggaatcgcaccaagtgaacacgagtttctattatagcgtatggttggacaacgacaggcttacaatagcatttcggaagggagagtggcatgggacgtcaccagcaggccgaatcgtcaggcatcatctcctttgtgacatgcgccgttatcgcctggttcgtcatgaacgcatacatgcagttcgccccggccatctggcgtgtcacgcagcgtctgttcaccgtctgctcgggaatcgtggcaggatgcggagtcgtttcattcagtttgggttacgcacgaaaatcacgttcgctgacactcaagcatggctgggtcattccggttcgccgtgttttcgagatccttgcgctttccgtggtgtatgcttcgaccattttcgtcacatcgttcatgatgttgtccatcgtcaacaacatgatgggcatccgcacgctgaaaggctatctgccgatcctatgcgcggccatcgcaggcgttgtaggctatatcactttcgtgcaggcggaacttatgaatgccaaaacgatcgcttccctactgccatttttcgtggtgtctggcgtgagtatcgcaggattgacgtccgacgatccgtactggtacaacaataatttctctcaattgggcgaccgtacgacgttcgccgcgcgtatgttcaattcgacgctgacgctcgcgggcatctgcattgtgatcatcagctatttcgccgtttccgagctcatcaccacgtatcgtctgcaattgcagtatctggattccaatgccatcaatgagacgccgaagcattttcgtacgaggattctgctgctgtcaatcatgttgacgttggccggcatcgctttcgtaggtatcggcatgttccgttacacaccgcatccgattttgcacaacgtgttcgcccgcggcctaccatgtttgatgagcgtgctgatgattgccctgccttggcttgccccgcaactctcaaaggtcgtatacgtggtttccgatcttgcgattgcgattggggcttatgccggattccaatggctgagcgggcataacacgctgacgaatgtggaggcgttggccggcatgatgttccttggctggttcatcattttctcgcgtcaaatcgccgccatcgaagcggatcgcgtgcagacgcagctgatactggcgcaatctgagagaccacgctccgtcgaggatcttgcggaagtcagcgaaactgttcccgacacagtttcgaggctcgccgcacaagtctgatgcaaggctgaccggcaaccgccggatttcaacatatacataccagtggggtggagccatcgcattggcgacgactccaccccactagattctgacggcataacgcgagtgcgccgtcagaagttgtagtgcttgttggacggcttcttgtcgctcatcaacagcaggaagcttcttgattgcgcagtaatcgcaaaaccggcctcataattgagttctggcccctttggattatgcgtgtcgacaattaagcgccatttcttgccatattgctcatcgggcagggtgaacatgatcggctcgtaatgcgcgttgaaaatcagaatgaaatcattgtcgaccatctgattgccgtaccagtcggtttccggaatatcggaaccgttcagatagatcatcacagtgaaggcgtgtgtgtttgaccagtcgtccatatccataatggagccggtatgatccatccattcgacctgcggaatcgcagtgctgtcgtctccctgctcgcgaccggagaagaagcggcggcgatgcagcacaggatgctcaagcctcaaatggatcagcttcgatacgaattcgagcaggtccttctgatcctcgtccagatcccagttcgtccaggagatcgcattgtcctggcagtaggcgttgttattgccctgctgggtgcgcgccacttcgtcgccgccgcagatcatcggaatgccttggctgagcagcaacgtggcgaacatgttgcgcatctgctgttgacgaagctcgttaacatccttgatggtcgtaggaccttcgacaccgcagttccaagaacggttgttgctttcgccgtcgcgattgccttcgccgttggcctcattatgcttctcgttgtagctcaccagatcgttcatggtgaagccgtcgtgcgcggtgatgaagttcacggatgcgaccggtcggcggccattgacctgatacaggtcggaactgcccatgaatcggctggcgaattccggcaacgtggacggctgcgagcgccagaagtcgcgcacgcaatcgcggtagcggccgttccattcggaccagctggacgggaagccgcccacctgatagccgccagagccgagatcccatggttccgcgatcagcttgacgcgggagatcaccggatcctgttcgacgatgtcgaagaaggccgacagtttgtcgacttcctggaactgacgggccaatgtggcggcaagatcgaatcggaatccgtcgacgtgcatttcggtgacccagtagcgcaggctgtcggtgatgagctgcagggcgtgcggcgagcgcatcagcagcgagttgccggtgcctgtggtgtcgaagtagtgtctgcggtcgttgtcgaccagacggtagtaggcgccgttgtcgatgcccttgaagctgagggtcggtccacggttgttgccttcggcggtgtggttgtacaccacgtcgaggatgacttccatgccggcatgatggtatgccttgaccatggatttgaattcgttgacctgttcgccacgctgtccggagctggaatacgcgttgtgcggggcgaagaagccgatggtgttgtatccccagtagttgctcaggcctttttcctgaaggaagctgtcgttgacgaactggtggatgggcatgagctcgatggccgtgacgcccagcttcttcaggtattcgattaccgaggggtacgccagacccgcataggttccgcgaatgtccggcggcacgtccatgttgaggttggtcatgccgcgtacgtgggcttcgtaaatcacggaatcgtgatatgagatgttcggatgctggtcgttgccccagtcgaaataggggttcaccacggccgctttcatggtatgggcggccgagtcgagcgtgttcatgctggtaacgtcatcggggcttctgaaccagtacgagtagaggctctcatcgccgtcgatgttgccttcgatggctttagcgtaggggtcaagcagcagtttgttcgggttgcagcgcaggccttgcgtcgggtcgtatggaccgtacacgcgatagccgtaacgttgccccggttggattccgggcagatagttgtgccagacataagagttctgctcggtcatttcgattcgagtttcgttgtcttcctcatcgaaaaggcaaagctcgactttttgtgccacttgggaaaagagggcaaaattcacgccggcgccgtcatagcttgcgccgagtggatacatcgatccgggtctgatttgcatgattcaagtatctcacgtttcagcccccaaatcgcaatttcgtgttgttcggcgattatttttacgattcgaaagaactcttgcctgtattttgccggtttcgtcgaatttgctcgtgaagaatagcgatcatggaattggaggccgtaatacgggtgccgcgcagccgctgccaggagacccacgccgattcgacgtgctcatcgccgtcgaaatgacgttcgacgggatgccatgcatgcaggtgaagcaccatgatgttggcaagctcgtcggtcatgccttcggacgagtaaaactgccccacatggtcgaattcgacaccgtcacgcccggcgggctccacaccggtttcctcacgaagctcccgcagcgcggcctcctccacgtcctctcccccgtcgatgagtccagccggcagaccgtaggcgaaggcgtcgcagccgatacggtattcccgttcgatcagatacaggtcattcgcgcaatcatgcaccagcatgaccacgcaaggcgcgtgacgcatcacctgacggcgaatcaccgtttgccctccgtcacgcatcggcaatgcgatccgcaggtcgtcgacgccgaaaatcgcaccctgatacacgtgcctgctgtcaagcaccgtgaccataccggacatgtccacgccatcgctggattcatccagcaatacgtccacctgggttccgtctaccgcctcgtcacacatgacgcgtcaccgttcctgcccgctcgaaggaaataccatattccatggatcggtattcatggaaatccaacgcacggcaggaatgtcgccggtcgcttccgcaaccgcatggggaacgtcttccatcgcatactggaaccacatggattcgatagcgctgtgcggagtgttgacgaacgccggacgcacacgcccgtcaccatggcccatggcaacgccggaagcacgcatggaagcctcatagcgggcctgctctatggcgtccgtcaccggatgatgccgcagatcactggtcacatacacgtcggcaccggccgcacgcacctcatcgaacaaggaatcaccggaacccggaagcaccgccaccgtgctgaccggaacgtccagatcgccgcaaacctgcacgccaagctcggtgtacggcagcgcgccagctactcgactggcgaaatcacgcaacgccacaggttcggcaagacgccccacacgccccaaaccgaccggatgctcggcatccggatcatcgatgggcaccagcggacgctgatccaccaaaccgaacatgtcagccgcagccatgccgacgccacgatacgccgcatcggcattcgtatgccccacccacaacgcgcatccggcaagattgagcttacgcacaatctcaccacggaaacccaatcccgacaccgcatgaacggaacggaagaacaacggatgatggcaaaccagcaaatcaataccaccggcaatcgcctgatcaaccaccgccatagagggatcagccgcaaaagcgataccgcgcacaggctgacgcaaatcacccacgataagaccaggctcatcccactgctccgcatagcgaagcggatacaacgtttccagcacatccacaacctgcttcagcgttgccatcattcctccttatgccattgctcgaccacgcacatccgcaacacacacgaaacccagtaccgtatcagtgcgcggcaagctgccaatccgaaccaatacccgtggaaacatccaacggaaccgccatatcgaccgcatgctccatggcatccttcaccaacgcagtgacacgctccgcctcacccggcgcaacctccaccacaagttcatcatgaatctgcaaaataatccgactggcaagaccagcctcatgcaacgcatcatcagcacgaatcatagcgatcttcataatatccgcagcagaaccctgaataggcgcattcaatgcggcacgctccgcagcatcacgtaccgcacgattcggcgacttcaagcccggaaaatacctacgacgaccataaatcgtctccgtatatcccttttcacgagccgaagaaaccaacgactccaaatactcatggaccttgccgaacgtcgcaaaatactgccgcttcaatgactcggcctcacccggcttaatgccaagctgctgcgaaagcccatacgtgctcagcccatatgccaagccatagctcatcgccttaacatgactgcgctgatcagacgtaatctcatccacaggaacgccatacaccaaactcgccacatacttatgaaaatccctaccggaacggaacgcctcaatcaacgcctcatcaccagaaagatcagccataatacgcaactcaacctgagaataatccgaactcaacaacgactcaaaaccctcaccaggcacaaaagccgaacgaatctcacgaccagcaggatcacgattcggaatattctgcaaattcggatcaaccgaactcaaccgaccagtcgcagccacagtctgctcaaacgtcgtatgaatgcgaccatcagacctgttcgtcgcatcaatcaacgtctgcacaatctgcttaagcttattcttctcacgatgcaacaacaacgcatcaagaaactgacaagccctatcattaccatacgaacgatcacgcaacacctgcaaagcagccgcattcgtagtatacgaaccagtcttagtcttcttcgtaggcttcaagcccatatcctcaaacagaatcttctgcaactgcttaggactttgcagattcacgcgctcgcccgcatactgccatgccgtttcctgcgcgtaattcgcgtcggcggcaagctgttcgcgcatgctcatcagcctgttcatatcgacttgcgcaccggcatgctccatgccatacagcacacgggatactggaatctccacagattcaagcaatgagaactgctcacgctgatccaatgaatccgccagtttgcgcgccagcaaaccaacaatcgcagtatggcgcggaagctggttgtcgttccgctgcgcactatcgtccggctcgtcgaaatcaagcgtgccttgcgtcgcgccctcggactgttcctcgatatgcaggtcaaggaaatgcgccgccgcctgttccagcgtgtcggcatggaaatcgggatggaccagatacccggcaagcttggtgtcgaacagcggcttcggcaacgccacaccgacgctttccagcaggtgggactgttccttatacccatgcaccaccatggattggtggtgttcgtcaagtaccgtttgcagctgggacgccatgtcacggtcaacacgattggtacgaatcgctttatcatgtgcagcgatcatcagcgacgcataggccgcgttccccggcttgctttcgccttccacctgcaacacccacgaatgcgccacggactgcgcacactgcttcgtatgatcaatggcgaagccggagggagtcgtcttcggcgcgatttcacgttcgtcatgcagatgcccgttcggcatcggcagattgtctcgtacccatgcttccaatgcttccggcgagtcaaccgtttcatactgaggtatttcgagcttgccggactcgtcttgctgcacgggatcgttggtgggcttccccgcattgaatgttctcagcacacggtttttggtgcgtatgccgaattcaagtctggtgaacagttggttgagctggttggcgtccacctgaccgaaagtcaaatcctcgatggacacgccaaggtcaaggtcacgcaccaaggcattcacggaacgattcagtttgacctgatcgatattggcccgcaacgcctcgccttttttgccgccgatttcgtcggcatgctcgataatctggtcaagtccgccatacaggttgatccatttggccgcgaatccatcgcccacgccgggaacgccggggatgttgtcggcggtttcgccacgaagcgcggcaagatccggatatagctccggcgtgacgtggtatttctccaccaccgcgtcgggagtcatatgcttcaaatctttgaaatgatgccccggatacaacacggtgatgttgtcgttgatgagctggaacgcgtcacgatcgccggatagcaccagcgtgcgatagcctgctttgtctcccatgctcgccaacgtgccgatcacatcatcgccctcgtatccaggtttttcgatgaacgtgacgccaagggccgtcagcatccgttgaatcaacggcagctgggtcaatagatcttccggagccgcatctcgcgtgcctttgtactgcggcagcatcgtattgcggaaggtaccgcctttgacatcgaaagcgacggcaagatgatccggatgttccgcgtcgatcacctgcgaaagcatggtggcgaagccccatacggcgttggtcgcctgacctgcggatgtactgaaattctctacgggcaaggcaaaaaaagcgcggaacgccaaggaatggccgtcaacgaccaatagcgtcccgcgcgtagtgccttccacagttgctgtgttagcgctcatcctctgcttccgacttctgatcaccgtacttggcgatgatggccatagccagacgcttcttcgggatgcgctggtccatggaggtcttctgaatccaacggaacgcgccctgctcggagaagtcagccttatccatcagcaggcccttggcacggtcgacaagcttacgttcctcgagggtttcctcagccttcttcagctgctcttccgccttcttcagctgctcttcggtttcgtgcagcttggattcgctgcgctccacattgtcgagcagatcgttgatttcggcgaaacggcccatggccacttccagagccggaagcagcttggattcctcatacggcttggtgacgtatgccatggcacctgcacccgtggccttcttgaccagatcggactgggagaatgccgtaagcataacgaccggagcgatattctcatcacagatgatgcccgccgcttcgatgccatccatacgaggcatcttgacgtccatgcataccacgcttggacggaacttgcgggtcaattcgactgcttcctcaccgttagcggcttcgcccacaacctcgtagccactatcttccagcatggcaaccaaatccatacggttcacggattcgtcttcggccacgacgacggtacgcttgcgaggtttgtcatcttcctcgatggactgctcaggcgctgcggcagcctgaagttcatcgtcggtgagcacttcgtccggttccgtggtcttttctgcagacatgtcggtctctttccactgtcacacccaaagccggtctcacaaaccccaacctggtcctggactgattcgatgccgttacttgcaatcgttcggattctggaaatcttcagcttttcacagccttgattcaccctccatcacgcaagttggaacgaaccggctatcttccttgtactttcatggatgatactagcagaagcctacaagcgcgtgttgccgcaatcctctttttccttcacgtgcaaagccgaaaaatccaagaaattccgcaatcctgcaaaggccttctttccacaatcccgcttcaacgttgtcttgtttatactggtcgtatgagtagcactttcactatcagagatattgtcaacgaagacgcaacggcatcagtcagcgattacggtgcgcatgtgctttcctgggcacctgccggcgaacagactgtggtttggcggccaaaggcgattcatcttaaggaaggaactgccatccgcggcggtgttccgattattttcccttggttcaattccggtttcgaaggcgggcatgtggcttcgaagaagcccaagcatggttttgcccgcaacagtttctggcattatgacgaggaagggtccaccggagctcgtttgcgctacacgttggattcgagtgagatcgacgcagacatactttcccagtttgtttctggcccgaatcctcaatttcatgccgtttacaccattgaagtcggccatgaattgacgatgtcgcttaccgtatgtaacgatggcgacgagccattgtcttacgaagaggcactgcatacgtatctgcaggttggagacgccgaacagtcgcaggtgtgcgggctggagggcaccgattatctcgataccgtattggacggcgatccccgttgcaaccaaggtaatgaacctgtgaccttccaaggcatggttgaccgcatctactattcggcggatacgcttgagctgcgcgaccccgtgttgcagcgcaccatcattgtctccaagcagggcgcagcgcagaccgtggtatggaatccgggagagcaagccggcaatgccatcggagatttgagcgacggcgaatggcgtggcttcgtgtgcgtggaagccgtcaacaatcgcgactgcgcggtcatcgtgcctccgcacgactcacataccttgcagcaaacactgtcggtcaagcactgaaagtaaatagaaactgctggttcgatgaacatcgaatatggtttccaatgtccatcgaaccagcagtttattcatcgacaatctttcctggactacgctaatcggcgtcatgtcgatcgtccggactcgatgaatatcgacgcaaagtacataacgccaataaacagccctgaacagttaccaaccgcaacaattgttgcaataaattgtccgatgacccagatgtcgtcacggagttcttttggacatacgctgacgttgatccaggcacgattgaatgcgcatcatcgtccactttcatttcgacctgtccctcatttaattcacttcttcgaaaatccggcctcatcagttcttgctccccacctcgattacagtcacaactagcctgcaggattcttcttccttggtatctttagggcagatcctcccatcccaaatctgctttgcataggtgaccgtaaccaaagaaaaatgttcacggaaccactcatgaaattcagaggccaatccggacggacaacaaacgctacaaaaagacccacagcctgataaatgattatttgttagctgcgtgaggtcaaccttcgaaacatcaatttcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatgattatttgttagctgcgtgaggtcaaccttcgaaacatcaatttcgccagacatgagcttgggtagaagcgtgtctcggaggtcttctaactgacgattctcatcctcaaggtgacgttgttcctcaagcagcggagaagcccactcttcaaacttggcgcacaagttgatgttagggagcgtgagctcgatgcccgccattgtctttcccgacacttccgggaaagtggtacccgagccagcatcggcaattcgatccttgttgcgtacaagaaaacagtagacaaaagctgtgccaatttctttatgcggcacgattgatttgaaaccttggtttgtggttacctcgtcggaagcaatggcgatgtagccgattggtgctcttgagctgaatagcacagtgcccgcaggcaacttcttaatgctacaagagtcgaacccaactcgagtaatgtcatcggctccgtgtgcaacgaacttattggtagtattcgatagatccttgggtgttatccagccaatcccttcatgacagtaatattctggcctcttcttggaaggtgtagccccgcccaccacatcacctatgtcagaaatcgtgccattataggtgcccgcccctctgaataggtggtcgtaacgagcaagcaaacattgctctaaataatcatttgctggtgcgcgggcacaatgttcctaaccgttattggaaggaacacctatggaaaccatcattaataatgttctgtcacagatgcagaacatgctcgatccgtcgcagctcaaacatttggccgaagtactcagagtcacgttactgccagctcaggaaacatcagcgccgcagaatctgctgacgctattcctcacggcaaaagaggtcgaaggctgctcgccgaaaaccatcgcttactatgagagcacgctccagcacatgacccaggcccttgccaagccctgcacgcggataaacagcgatgacttgcgcgagtacctcaacagatacgagaacgaacgtcatgcgggcaaggtcaccatcgacaacattcggcgtatcatgtcaagcttcttcgcgtggcttgaagacgaggattatatcgtcaaaagccccgtaagacgcatccaccgtgtgaagaccgccgtaatggctaaggaagtcctgagcgacgaaaacctggaaactctgcgggaccgatgcggcaccttgcgggatcttgccatcgtggacattctcgcatccacaggcatgcgagtgggcgaattggtcggtttgaacatagccgacgtaaatcttcaggagcgggaatgcttggttacaggcaagggaaacaagcagcgtcccgtctatttcgacgccagaacgaagctccatctcaccgcatacctgcaatcgcgtaacgacagcaatccggcgctattcgtcgctttgaatggcgatggcgaccgtatcagcatcggcggcatcgaaagccgcctcaggcggctcggcaaagacgccggcatcaatcgagtccatccacataagttccgtcgtactctggccacgcacgccatcgacaaaggcatgccgatcgaacaggtgcaaaaactgctcgggcatgcgagaatagacacgaccatgcactacgtcatggtcaaccagaacaacgtgaaagcttcacacagaaggtatttggaatgagctggcgagagacgacccttggtgagattaccgacttaaaaagaggatttgatttgccgaaaagccagcgtttgcaaggggatgtgccggtttattcatcatcgggaattaccggatctaatagtactgcagcagtagaggggccctgtgtaatcacagggcgatacggcactatcggagaagttttcttttcgggtggtccatgttggcctctcaacacagccttgtattccaccgagttcaacggcaacaatcctcgatttgtctattatcttttgcagacaatcccgtggcaaggatacacaacagctagtgctgtgccaggcgtcaatcgaaatcacgtgaatctctgccctgtcaagatacctgacagggcaacgcaagatgcaatcgtagaagtgcttgattccattgtcgacaaaattgcccttaataatcggctaaatgattatttgttagctgcgtgaggtcaaccttcgaaacatcaatttcgccagacatgagttttggaaggagcgtatctcttagacgcgaaagggcctgattctcaatgtcattggaatatatacagtccgaaattgctttcaattgatttgtcaaggttttgattaggtcaaagggaggataaggcacagtgagatgcctaagaccatcaattgttatttgcggttgagccgagcccgttgcataatcgtacaactgatgtagcataaaatactgttttagatactcgtaatatcgtctatctttaagttcaattatgagtgaatttgacgtaataaagcttttcggcagtgagacaagaactttacctgaggcagcacctcggcaagaaattagtatctgaggctcttcgtacaagtacttagaataaaagccaatctggccattcccgccaaagaccggatatccatcctccactagttcatttttcgctagcccttttccgtacttgatatcagcaatatcgaatagagcgatcctttcttcgatatgagatgcttgattttggaaaacagtagaagcaaagtctgccaaataatcatttagccgattgttgagatcgatcttgtcatcaagaacatttagcagttccgcaactttgctttgttctccgcgggaagggagctgcacaggcatgttgcgaatatcggcaacattaatatgcgacacagttgcgccattggccaatcgcagcattctgtcacgctgttcaggagcattcagataataattcagatattcgggaaccacgaaagacgaatcgggtcgaagaagcattgtcctttgtcccaaacaaacctcaatcccaggtgagacgatagctacatttccggctggtgcttcacgtgcaagaatcagatcaccctgccttggtacagctcgggagacacgtctctcgtatacgtcttgggagaccctgtgaacatcagtcagaatcaatcttccgcgcccaacattaggtgttcggatgagtggatatcccaccccttcatccttagcgctggtatgtggacaatcgacaatcaactcgcagacgtcctgcagtgtcacctgctcacatgccatagccgatggcctccagattcttcttgatctgctcttgcagacggttggattcctcgaagcatttggcgatctcgccggtcagacgggtcatcttctcctcgaatggctcatcgtcttcttccacttcggcgacaccgacgtaacggcctggagtcaggatgtaatcctgcgccttgatatcttccgtcgtggcgatggcggagaagcccttctccgtttccagagtgccgtcacggaacgcgtcgaacgcagtcgataccttggcgatgtcctcatcggtaaactcgcggagcctgcgggacaccatggttcccatatcgcgcgcgtcgatgaacaacgtcttgccggactgcttcttgttcttggtgatgatccacaagctcacaggtataccggtgctgtagaaaagcttgtccggcattgcgatgatgccctcgaccagatcggcatccacgatcttggcgcggatctcgccctcgttgttcgtctggctggacaacgcgccgttcgccagaaccatgcccatgcggccggaacggttgagatggtggatcatgtgctggacccatgcgaagttggcgttgccctccggtggggtgccgtactgccagcgtacgtcgttctcgagtttctttcctccccagtccttcaggttgaagggcgggttagcgaggatgaaatcgaatttctcggtcttgtgcaggtcctcgaagaacgtgtcggcattatgatcgcccagatccgcgtcgatgccgcggatcgcgaggttcatggtcgccattttccacgtggtcggattggactcctggccgtacacggagatgtcgttaatgttgccctgatggcgtttgacgaagtccgcggactgtacgaacatgccgccgctgccgcagcacggatcgtacactcgcccgtggtagggttcgatgacttcgaccagcgtcttcacgacgcacgcgggtgtgtagaactcgccggcgttcttgccctccgcttcggcgaatttggccagacaatattcgtaggtgcgtccgaggatgtcgcggctatcgcccttttcggccatcttcacgttggtgaacaggtccacgacttcgcccagacgtcgcttgtcgagctcctggcgtgcgaagttcttcggcaggatgcccttgagcttgttgttctcggcctcgatctggcgcatggcctcgtcgatggccttgccgatctcgggcgtgtgcgcggccgctgcgatggtcttccagcgggcgctctcgggaacgaagaagatgttctcactcgcgtattcgtcgcggtcctcctcgaagccctctccctcctcaacgagttcctggtatttctggtcgaacttgtcggagatgtacttcaggaagatgaggccgagcacgacgttcttgtattcggaagcgtcgatgttgccgcgcagcttgtcggcagcgctccagatctgttcctcgaagccgatctcggcggtattgtccttcttctttgccatgtcttgtattatcctcctgctcgtcctattcgctgatcttggtgtcggcccacagctcgcactgttccatgacggtcttcatggcgtcctcgacgccttcgggcggatacttgtatttgcgcagcaaacgtttgatggcacgccgcatgccggccctggcgctttccttcttctgccagtcgatcgtggcgttgctccgcatcgcatcggtcaactcgcgggctatcgagacgagctggtcgttgtcgtagaagtccttgaccgcctgcggctgggtgatcgcgtcgtagaacgccatctcctcgtcgctcaagccgagcttctgcgcgtcgtcgcggtccttcatgatctccttggccatgttgacgagctcttcgatgacctgcgcgttcgtgagcatgccgttgagatacgcgttcaacgtgttctggagcatctcgctgaacttctgggatttgaccacgctggtgcgcccgtacgcccgcactttctccttgatgaggcgtttcaggctctcgatcgcgatgttcttctccttcatgccggcgacctcctggaggaacgcctcatcgaacagggagatctccacgctgtccttctcgaacaggttgagcacaccgtccgcatgcacgctctgctggaggatctcgctcacctgcttgttgaactccgtgtacgtcatgccgctgcccccgccggagccacgtccggtcaggcgaaggacctgcacgcgcaatacggataggtaagccgcctcatgcgcgtcctcttcgcttaccatgcttttgcacaggctcagcgcctggttcatgagctggcattgcttgaggaacgattccatgtcttcgtgccgttccggatcgagcagccagtcggttccctccgcgatggcgtcggcaagcgcctccctgctgttctggaagatgagtttgcggtagttgaagccgtacatgagatcacggcacacgtcgagcttttcgaggaatttcggataggcggtctcggcgatgttcatgtcgccgtaattgtgctggtcacggctggtatagtccttcatcgcccgcttgagcgcgcctgcgatgccgatgtaatccacgaccagaccgccctccttgcccttgcacacgcggttgacgcgggcgatggcctgcatgaggttatggcccttcatcggcttgaacacgtacatggtggacaggctgggcacgtcgaagccggtgagccacatgtccacgacgatggcgatcttgagggaatcggaatcgtccttgaacctgcgttccatctccttcttgtgcgtggtgccgccgcacacgtcgaaccattcctccggatcctggttcgacatggtcatcaccacgccgaccttgtctttccattcggggcgcagctccatgatcctgtagtagatcttcatcgcaatcggccggctgtacgccacgatcagggccttgccggccaggacgtcggcgcggttgttctcgtaatggtccacgatgtcgcggcacaatgcgtcgatggtttcaggagtgtcgaagatggcatcgaggccgccgaggtcatgcttggacttctccacgctcgcctcgtcggcctggtccgcgaactccttgtagaccgcgtcgatgcggcccagcgcgttctcgtcaagatggagcgagaccacacggctttcgtagtagaccggcttggtggactcgtcctcgacggactgggtcatgtcgtacacgtcgatgtagtcgccgaagatctcgcgggtgttgcggtcatccgtggagatcggcgttccggtgaaaccgatataggacgcgttcggcagtgccttgcgcacgacacgggccgcgccgaccgacacatgaccgtccgcgttgatccgttcggtcaggccgtactggccgcggtgagcctcgtccaccatcaccacaacgttgctccggtcgcacaacggctcgtcgccgtccgagaacttctgcatggtcgtgaagatgatgccgttcgcctcacgaccctcaagcagttcctgaagattcctgcggctctcggcctggaccgccttctggcgcaggaacctggcgcagcggctgaattgtccgaaaagctggtcgtcgagatcgttgcggtcggtgatgaccacgatggtcgggctttcaagataacgctgcagcagatgtgcgaagaacaccatcgaaagcgattttccgcttccctgggtgtgccagaacacgccgatcctgccatccccattgacggcctcttccgctctgacgatggctttccgcaccgcgaaatactggtggtatgcggcaatgatcttcacgaccttctcggaggaatcgttgaagcatacgaagttttggatgatgtcgagcagccgttccttcgggagcatgccgtcaatcatggtgctccatgccgcggctttcgttccggaatagtcgccgtccgccgacttccaagccacgtaacggtcctcgtcggatgtgatcgtgccgaccctggtctgggtcatatcgctcatcacgcagaacacgttgggcacgaacatgctcggtatctgcttcatgtactggcgcaattgcaggtacgcgtgtgaagcgtccgtctcctcgcgtgacggggacttcagctcgaacaataccagcggcatgccgttcacgaagatgatgacgtcgggacgtttctcggaatactccacgaacgtccactggttcacgacatggaaatcgttgttctcgggatcgtcgaaatcaagcagccggacgatgtcatcacgctcttccttgccgtcaaagaagtgcacttcgactcctgattgcaggtagtcattgaatatctcgttgcgctgctccaggctgccgatctcgacattctgaatcttccgaatggcctcctcgacggctgcttccggcagatttctgttgattcgtcgcaacgcatccgggagaatatcaggaaggaatacgtcgcgatacgagtcgtcggtgcggcgaacatcgggcccgtacaggtgctcatatccgagtttctccgttagatgttcgacgatcagattttcgtaccattcctcgttcagtggatccatggacgtgatgttgttcagagaacactccgaaaccgtacgagattcgactttggaaacagtcattgttcaccccacaaacatatggattctctcgcaaaccatctttcggtttagtctatcaattaacctatcgtctggatgtaaccaacatgagtgtctgctgtttttagattacgtcatgctgtcttatttttgttcagtagaacaagaaaaacgcccgcagcttaaacgccgacgggcatattatctcttcctctcatctacttcccaaactcaagcctcacacctcgattctcgtctggaagcccgccgcatgatattttcgaaagcagaccccctcaaaaaacgcaccgcacatccgattatcgaattcacctctcaacaaccgaggctcgtttatcacaggcccttcatctatcaccagtgcacatctctgcgcagtcctttaagagcttcgttttttgttaaaaactccgatggttcagcatctcgtaaaccgtctttgttgtgccgttgagaccccaaagcaatatagcaagctttctttgcacgggttattccgacatagtgcatgccaagagattgctcaatatctttttgtactcctttatatggaggcatgataaaacgataggcttcaagacaaaaaacgatgtcaaattcaagtcctttagccttatgataagtaagcacattaatctcatctgattgagcaggacgaaaaccccttctaagaatatccacgtctttaacggtgctgcaatatgcctcgatatcttcatcacatcccaaccccggcccacataggtcagctatagcaaacgctaaatctgtttggtttaccagatcttcttcacgaactccaaagaagtcatcaacaagagcaagtccctgattccgctttgttgttttgacattcctccggcagttctttccattgtccataattaaagttgttatccttaacaaccttaagcttcaaaggtctgttaatgatctgaggagcaaaagagataataatctggctaagacaccgctcatgatgcagatctgctccttcgacagtccgcgcttcgagcgtgggcgagccaccacatcctccaacacgggacgagactgcgcgcgtacttgtcctcagaagatcgcaattcattgatggcccgtctgcgccccaatgcgcccatgccgaacaactggctacggatctcctcggtgagacccatcaccctcacctccaacaactgtaatctcagtgcaactacagttgtgaacatgaaggctcatgtccactctgagttaacagagccaaaaaaacgatttgtgtggcattcacgacattatgcgaatgccacgcgaatcgttttttattggttttgctttaaggagcacaggatttgccgttaaggcgctgaactcgatgcctttttcagaaccgtttggcaagctgcttctcgcacactccttggagccatgtcaataccgtgcagaaagcaagatatatcacgccgacctcgcaataaagcaccagtggttcataggcggtggcgacgatacgctgcgcggccatgaacatctcgaccacggtgatgttcgcggccagtgaagtgtctttcaccaaagagatgaacgtattgaacaatgcagggaacgccgaccggaaagcttggggcagcacgatcagcctcataatggtcagatagctgaggttcgtggtcaggccggcttcgacctgcccctttggcaccgcgagaatagctccgcgaagtgtctcagaagcgtacgcgccgacattcagggagaaagcgataagtgccgagggaaacgccggcacgacaatgcccacggacggcagaccaaagaaaataacgaacagttgtaccagcagaggagtccctcggaacacccacacatagaattgcgcgattcgatgcaccataggaaccttggctactcgaacaagcgccacggcgatggccaacaccagacctattgcgaacgatatcagtgtcagcgggatggttaccgtcagcccaggaatcagcaatttcgtgaaggaaccgatgatgattcccaacagtctgtcatccatgatgcccgatcctcatatccggcccgctttcgtcggatccgcacgcattatgcaaatccgttgagaacaggcaaacccatctttctactgctttaccgaaacgtcctctccaaagtacttgacagacagtttcttcaatgtgccatccttctgcagcttcgcgagggcatcgttcagcgccttcaccaagtcgtcctcacccttgcggatcgggaaggccgccgcggggctgatttcggactttgccgcgatctgcacatccgcgtccggcttctgcttgagatagtccagcacggcgagcttgtcgttcaacgtgacatcggcacgaccggaggtaatggcgtcaaccgcctgcgcgaagtcattgacagagacgatgttcgcgccattctcctgggccgtctgattccagttgctggtcttggtctccgccgcattcttacccttgatgtcggagaagctcttgatgtcgtcgttgcccttcttcgtcaccgcgacgccctgcgagtaggtgtacaggtcggtgaaatcgtacttctgcttgcgttcatcgttcggagtcacctggtcggcaaccgtatcgaactttttcgcgtccacacccgcgagcagcgaatcccaattcgcttccacgaacttggccttgacaccaagttcctcggcgactgcggtggcgatctccacatcgtagccggtcagattatcgtcggtatcgtggtacgagaacggtgcatacgtgccttccgtgccgaacacgatctcaccgttcttcttgacctgctcaagctcgctggtggcggaatcatcggatcccgcaccgttcgaggatccgcatgaggcaaatccaacgaccgaaacgacagcaagcgcggcggcagcatatttcttccagacagatttggtatcagacattttcttcctgttctttcttaacgttttggagggtttgttgattatcaattactgaattcagacgttggggatttggagtgcgtctgctgaattgtcacgagttcttccggtttccaatcgtccagcacgttgacatcgtgtatcgatgacagaaaacgtgcggttcgtggctcgtttggatggctgaagatgtgttccggcttcccctgttccacgatgttgcctccttcgaagaacacgacttggtcggaggcgttgcgggcgaaacgcatttcgtgggtgaccatcagcatggtcgttccggaatccgccaaggatttgataacggcgagcacgccgtccaccatttccggatcgagagccgatgtcggctcatccaacaccaacagttctggatccatggcgatcgcgcgcgcaatggccacgcgttgctgctgaccaccggacagtttgctcggatatcggtccgcgaatccggccatgcccacccggtcgagttcgtcatatgcgattcgtacggcttctttcctgccttttcccttggcgtggatcaggccgatggccacattgtccaaaaccgttctgttcaaaaacagattgtaattctggaacacaaaaccgattttcgcgcggaccgaagcgatatcctttggcttggtgctggtgagggacaccgggccttctccgaagtcgatggtgccagcgttggcggtctcaagaaagtcaatcgttctcagcaaagtggatttcccggatccgcttggaccgataatcgagacaacactacgttccggaatgtccaggtcgacgccgtcaagcactaattgcgattcgaacgactttcgaactccacgaattcgtatcatattcgcctccccagttcatccaatcgtgacggtcaggccaatgcatcttctgtgatcgcatcgttccacttgtcggagtgtttctccgaggccttctcgaacgcctggcccagatcctctttgagatcggcgacatcttcaatgccgatggcgagacgaatcaactcatccgtaatgcctaccctcagcctctcctcacggggaagttcgaagtgggtcatacggcacggaagctccgccaggctttcgacggcgcccagtgaaaccgcaaggcggaacagtcgaagattgtcgagcacatcaacgggatcgattccgtcgacgacctcaaagctcaatacgccgccagcgccgcgcaaccccttggccgccaggtcctcgccatcggtaagacccggataatagaccttcttcaccaacgggtgggcaagcaggtatttcgccacatcggcggcattctcctgctgtcgttccaagcgaagagccaatgtttggatgcccttacgcacggaatcgcattcaacgggtgcgaggacaccaccgagacggttctgggcgaagtagacacgctgcccgatctgctcatccttcaccacgactaggccagcgatgacatcggaatgacccgcgagatatttcgtggcggaatgcagcacgatatcagctcccagatcaaggggattctgcagataaggtgtcacgaatgtattgtccacgataacgatcgttccgtatcgatgggcgatttcagcgatcgcgtggacgtcgttcaccttcaacagcggattcgtgaccgtttcaaaatacaccgccttggctggctggattccccgtttcggatcccctgccacagcacgctctacatcttccagaacgcgggtgtcggctgacgtgacctccagaccccagcggttgaaatgctcgttcagctgcgaatacgaaccgccatagacattgtctccggcaacgatgcggtctccaggctggaaaatggacagcaccgcatggatcgccgccagaccggaggcgaaggcaaatcccctagtaccatgttcgagctgcgcgatctgcctttcgaggtattcgcgcgttggatttccgctacgtgcgtaatcccaacggggcatggcatcgaccgactcaaatgcaaaagtggacgatttatagatcggcggattcacggccctggtgtcattgtcgttcaccggttcaccgtggaccagctgtgtgttgaatcttgccatcacgcaccccctcgggttgtagagttgtttcgcgcgcacatctttcatgcttgcacgatcatctacttaacccgaaaagaaaatgcgccacacgcttggacttatcgacataatttatatgacgtttaaactgttatcaggataatttattagcttttatcaatggagcaagacatcgctctttggtttttctttcgtcctatttggcttcccatgcaccgcaacacgcacaaattaccaccctttaaaggtggaacattgggtacaccattcgagagagactaggcgtcataaagatgctgtggtgcacttcaagggcaagatcatccaagtcatcgaagacagcggccaagccacccagtaccgtattagcgtgacgcccacggattatggcggatgggatgagcaggtcgatgatctgccgcacgtcggactgggtggtcggaccgttctggcccttcagaccaccggcgagggtgatgacgccatacaaactagtttgttttagtttgcatggcgttcttgcggacgccaactccaagcctcacgtcgctcgcgcagcaacttggttcacacttcacgggagcctacgttgcccggtccgaaccggtccatcttccatctcctccatgcgcgtttagagtctccagggcactcccggcgaccccgatgctgatgatcgcgttcaagtcacggtccagccccaatccgcattccgtcaaccggaaaaacaggatgcgcagactctccataccaaacgtaagacattgagctataatcgtcttacaacaatcagcaaaagatggaggtcgagatgaccatgacttcggtgacggtccgcgtggacgacgccacgaaaaaacaggctacggacatcgtggaggatcttggacttgacctgtccagcgtgacccgcgcgttctaccggcagatcgtcagggagaaccgtatcccgctcagcctgtcgaggcaacccattccggctgagacccttgatgcgctcgacgaggtgcgcgaaaaggcggagacgtggagataatctacaatctggtggatggcaagacactgagctaccacgtaactgcacatgcgtcagatgggtttcaaaacaaaacagccgcggcgggtgatacgtccacggctgttcatcaatccggtgcccccggtgggactcgaacccacactgtacagattttgaggctgtctcctctaccaattgggatacaggggctttcgcacaacttgaccatattaacacagaaaaatgattttgcaaagtccttgagcagtcggcgtttcgcgccatactcgacaccttgatcgcaacctgtcgcagtctgcaaatcggcaacatatcaacatcatccaaaaacaacgggagggcttccatccaaacggacggaagccctcctattcgctaatcagtcagccactgaccgaaacgcatctcagtcgcaagcaccgacggtgtggacgtagatggaatcggtgcgacccggctggtgctcgccctgggcggagctcagcacaacgatcttgtcgccatcggtgaccttgccggcatccttcaggatcttatcggtgaagatcatcaggtccttgcgggacttgtcgtggtaatcctcatcgagcaggaaggactcggtaccccaagacagagccagccagtgataggtgtgctcgttgttggtgataccgtagatcggggtggccgggcgttcgcgggacacgcggtgcacggtggaaccggtctgggtgtaggcaacgatggccttggcgttcagcttgtcagccagatccacagctgcggaagacacagcgccggtggaagacatatccaggttcttcagctccgggatacggtcgaaaccgtgctcggtggcgaaggaggagatacggctcatggtgctcacggtgactgccgggtacttgccgacggcggtctcgttggaggtcatggtggcgtcggcgccgtcaaggatggcgttggcgcagtcagatgcctctgcacgggtcgggaccggggagttgaccatggagccgagcacttcggtagccacgatgaccggcttggcgtactggcgagcgagctcgatgcagcgcttggtagccagcggcacctcttcgagcgggcactcaacggccatgtcgccacgagcaaccatgataccgtcgaaggccttgacgatctcttcaaggttctcaagagcctgcggcttctcgatctttgcgacgaccgggatgcgacggccttcctcgtccatgatctcgtgggcgcggtcgatgtcggtggcgaaacgcacgaaggacatggcgatgatgtcggcgccggtgcggatagcccaacgcagatcggcttcatccttctcggtcagagccggcagggacaccgcaacgcccggcaggttgatgcccttgtggctggaaaccggcccggcaacgacgaccttggtgtacacgttgttgccttcgaccttggtgacctcaagacgaaccttgccgtcatcgatgaggatcggatcgccagcatggcaatcgcccggcaggcccttgaacgtggtggaagtgatatgctcgtcgccctcgatgtcgtcggtggtgatgacgaactcctggccttcggtcagctggaccttgtcttcaccgtcggcgttcttcttgaaccaaccgcaacggatcttcggaccctgcagatcaaccagggctgcgacgttgcggccggtggccttggcggcggcgcggaggttgttgtagaccttgaggtggtcttccggagtgccgtgggagcggttcagacgagcgacgtccatacctgcttcgacaaggctggtgatgccttccagggactcggtagctggaccgatggtatctacgatcttggctttacgcatgaatgcctgcctattcttgttgatattgattttggatctgacgaccctgtttccaaccgaccagtctactagcaaaaagcgctcacttccaccctgaaacgaggcgtgttgtgagcgctcacatttttttgataaaaagaaaccgcatgtttccatgcggtttctcaaatcgtcacttttcctttgcttcgatggcacgcatcttcagtacgctggccaatgcggcaccaccaatcgccacaacgatcaccgccaaagacagccatgtaggcacttcaggcacccaagcgatcggttgaccgccgttgatgaacggcaacgaattgccgtgcaatgcctccataatgagcttgactccaatgaagcccagcaccacggaaagtccaagaggcagatacaccagcttgtcgagcagctcgccaagcaggaagtacagctgctgcaagccgagcaatgcgaacacattggacgtgaacacaatgaacggatccttcgtcaaaccgaaaatcgcaggaatggagtcaaaggcaaacatcacatcggtggtgccgatggtcagaaagacgatcagcatcggagtccaatacttggcaccgtttttgacggtacgcaacttttctccgtcatactcatcggtgatcttgatcaccttgcgcaatgcacgaatcaagccattctcatgatattcctcatcttcgtctcccccagtgaccaacttgatggcggtgacgataagaaatgcgccgaacaggaagaacacccaggtgaagcgggagataatggccgcgccgatgaggatgaacacgccgcgcaacaccaatgcgatcgtgatgccgatggacagcacgaatttctgcagctgttttggcaccgcaaaattcgacataatgatgacgaagacgaatagattgtcaatactcagcgaatattccgtaagccagcccgaataaaattcgatggccggcttagaacctgcgaagaaccacataagtccgccgaagatcaacgccatgactacaaagaacgcgatatgctgcacgcattccttggtggagggcacatggggcttacgtccgatgataaacaagtcaaccacgaagaagacggcaagcaccgcgaacgtggcgatttcaaaaacaagtggtgtttcagccataatccactatggtacggatgccgtatgaccggtcggaactatttgctcgcctccgtcatctgccgaagttcctttttcaggtcgcggatctcgtcacgcaaacgagccgcaagctcgaattgcagttgttcggcggcggcatgcatctgctcggacagttgtcgaatgagatcagctagatcctgcgcgggcaatccggccttgagaatctcctcatgccgtctgtcagattcctccttgctggtagcaggcacgccaagatgcgagttgccggctttgccttcattacggtagccggtaccgagcaatgtctgggtgtcgacgtcctccttggcaagcatgtcgttgacatcggagatcttcttgatgagcggcttcggatcgatgccatgttccttattgtaggcaatctggatatcacgacggcgattggtctcgtcgatggccttgtgcatggcttcggtgatgtcatccgcatacatgatgacggtgccggacacatttctcgcggcacgaccaatcgtctggatgagggaacgataggaacgcaggaaaccttccttgtctgcgtcaaggatcgcaaccaacgatacttccggcaaatcaagaccctcacgcaatagattgatgccgacgatgacatcgatcttgccctcacgcaattcacgcaacaattcgacacgtcgcagggtgtccacatcggagtgcaggtattcgactttgatgccacgctccagcagataatcagtaagatcctcagccatcttcttggtcagcgtggtcaccaacgcgcgttcgttacgtgccacacgatccttgatttcagcaagcagatcatcgatctgcccgtcaaccgggcgcacatcgatttgcggatcgaccaatcctgtcggtcgaataatctgttcgaccacaccgtcactcaagccaagctcataatcgccaggagtggcggaaaggtagaccgtctggccgacgcgctcaaggaattccggccatttgagcggtcggttgtccatcgccgaaggcagacggaagccatgttcgaccaacgtgcgtttgcgactggcatcgccttcgtacatggcgccgatctgcggcacggtaacatgcgattcgtcaatgacgagtaggaaatcgtcagggaagaaatccaataacgtatgcggcggcgtgcccggctcacggccatcgaaatgtcttgagtagttttccactccggaacatacgccgacctgggaaagcatctccaaatcgtatgtggtacgcatggtaagacgctgcgcctcaagttccttgccttgtttgcgtagttcagcggtacgttgatcaagttcctgctgaatggtagacaacgctcgctccatacgttgcggccctgccacatagtgcgatgcggggaaaatatggacttgcgattgacgcccgatcacatctccggtaagtggatgcagggttgaaatacggtcgatttcatcaccgaagaattcaatacggatggccagttcctcatatacgggaatgatttcgacggtatcgccgcgcacacggaaagtacctctggtgaaggcgatatcgttgcgcttgtactgcatggcgacgaaagtgcgcagcaagtcgtcacggtcgatctgctggccttcctcgagaaacagcatacgcccggcatattcttccggcgtaccaaggccgtaaatacaggaaaccgttgccacgaccacgcaatcacgacgcgtcagcaggttcgccgtggccgcatggcgaagccgttccacgtcgtcattgatgttggaatccttttcgatatacgtatcggtttgcggaatataggcttccggctggtagtagtcgtagtacgaaacgaaatagctcaccgcattgtctggcatgagttcacggaactcggcgcacagctgcgctgccaacgttttattcggttcgatgatcaacgtcgggcgttgcagacgttcaataagccatgccgtggtggcagttttgccagttccggtagcgcccatgagcaccacatcgttctcaccgttttcaatgcgttccgcaagctcttcaatcgccttgggctggtcgccgctcggcttatatggcgatttgaccacaaacggcttgttcgtgcgttcaatattgaatcccatacctacctcgcttccgtgcgccattgttgcattagcatatcaatatgctcgaacatttgttccaatgactgtgtggaatcgatgatctcatcggcaatggcaagacgctgttccacgctggattgatggttcacacgattccatgcctggctttcgctcatgcctcgcgttgacatcattctgctgaccctcacctgttcaggcgcttcaacagttacgatatggtcgaattcaaaaggaatgctgtcaattacttcggcgagtaacggtatgtcatgcaccactactgcttggcaatcaacttcaacagcctcatgttcgagttgcactgcaagttcataaatcagtggatgctcgattccgtccagcatcttgcgttttcgttccgcatcagcgccggaaaacacatgctctgccatccacgctcgattgagctcgcctcgatcggtcaaagcatcggagccgaaacattccactatacgctgaaggccgatgctgcctggttccaccacttgacgcgcaagcagatcataatcgacaagtactgcaccaagctcacgcagtcttgcggataccgtgcttttgccagctgctatgccgccggtcaatcctattcgaatcaccacaaccgccattgtaatgcgcttcgcatgcgcgcttgccatgcacatacgaaaagaccccgaacctgaatcaggaacggggtcttttctaaaatctagcctgagctggattggatcctagctcaggatacaatcacttgccgagcagctggtcgcgcagagcggcgagctggtcggagtcggcgagggtgccggcggaagtgttctcggaggagtagttggaagacacctcttcgaccttctcttccttcggagcctggccatcttcagcggcggaagcttcagcgttctcgagctccttggccacaaattccttatgctgctcccacagatcgtgagcggtggcgtactgggactcccactcctcacgctgcttctcgtaaccagcgatccactcgttggttgccgggtcgaagccttccggatacttgtagttgccctgctcgtcgtactctgccggcatgccgtacagagccggatcgaagtcctcggaagccggatcgacggagtcgttggcctgcttgagggacagggagatgcggcgacgatcgagatcaacgtcaatcaccttgacgaagacttcttcgcccggcttgacgacggtctccgggttctccacgtggcggttggccagctcggagatgtgcacgaggccttcgatgccgtcttcgacggagatgaagacaccgaactggacgatcttggtgaccttgcccttgacgatctggccaggaacgtgggtgcgagcgaagcgctgccacggatcttcctgggtagccttgagagacagggagatgcgctcacgatcgaggtcaacgtcgagcacctcgacggtaaccttgtcgccgaccttgacaacctcggacgggtggtcgatgtgcttccaagacagctcggaaacgtggatcaggccgtcaacgccgcccagatcaacgaatgcaccgaagttgacgatggaggacacgacgccttcgcgaatctggcccttcttgagctgggacaggaaggtttcgcgcacttcggactgggtctcttcgaggtactgacgacgggagagcaccacattgttgcggttcttgtcgagctcgaggatcttggccttgatggtctggccaatgtacggggacaggtcgcggacgcgacgcatttcgaccaaggatgccggcaggaagccgcgcagaccgatgtcgacgatgaggccacccttgacagcttcgatgacggtgccttcgacaacgccatcggcttccttgatcttctcgatgtctccccaagcgcgctcgtactgtgcacgcttcttggacagaatcagacggccttccttgtcttccttagtgacgacaagggcctcaatggtgtcgccgacctcgacgacttcgtccggatcaacgtccttcttgatggaaagctcacgggaggggatgacaccctcagtcttgtagccgatgtcgagcaggacctcgtcgtgatcgaccttgacgacggtaccttcgaccagatcaccatcatcgaagttcttgatggtggaatcgactgccttgatgaagtcctcttcggtgccgatgtcgttgatggcgaccttggcgacttcgttattgttctctgccattaatttggtttcttacaaatagtgggtggataaaatcggtcttcaattatgtgcgtgcgatataacacacgcaaggcataagtttacatgggaccatgcacaaaaaaggcgtgccgtaacccgcgacacgcccgaaattacttcatattttcacacacagagcgcaattacagctgacgctcggccatctcgaccacgttttccagcagcatggcgcgggtcatagggcctacaccgcctggattcggcgtgtatgccaaggccttctcataacaggctttatcgacatcgcccttcacgcgataacggccgaccccctcgtcgaacacgcgagaaacaccgacatcgaccaacaccgcgccttccttgatatcttccggcttgacgaaaccggcggagcccatggccgcaacgatgatatcggcctcacgcatatgcttgcgcacgtccttggtgccggtatggcacagcgtgaccgtggcattcaccgccttgcgagtcagcatgagaccaatagtgcggccgatggtgatgcctcggccgagcacgcagacctctttgccgtccaggtcaatgtcgtaggctttgagcagttcgatcacgcctcgcggagtgcatggcagcggagtagtgatctcgccgcgcgcatgcaacacgagttcgccaagattatatgggtgcataccatcggcgtctttcttggggtcgatcagatcgatgatggcgttctcgtcgatgcccttcggcaacggcaactgcacgatgtagccggtgcaggcaggatcggcgttaagctcctgtacgacttcggcgatttgttcgaatgttgcgtcggcaggcaactccttcttaatggagttcacaccgatttcagcgcaatcggcatgctttccggcaacatatttgacggatccggcatcggaaccaaccaggatagttccaagaccggggttaaccccctgctctttcagcgctgcgactcgctcggcgagattcgctttgatctgcgcggacaccatctttccatcgattttcaccgccatgccggccactccccttttcgttgtctcattgttgtattggcatttgcatgtatcgtaggctatcttggtttcagtcgtaagtcgcacacgtatttatgagatgaacacgattagggcggttcaggaagagggcaatcgacatgcgcttgcacaaacgttctttgttacgcgctttcgctgcgggaatcgcgctttgcgtggcgttcggcacggcagcatgttccggagggtcaacttcgcaggagaatgacgcctccgccgactccgaaaccccaaccgaacagatcactccaatcgaagtggtcgcctcggtcaatcaatggggttctcttgccgagcagatcggtggcgtccatgtgaaggtcacgtcggttctctcttcaaccgatgtcaatgcgcatgatttcgagccgaaaaccgacgatatcgacaaacttcagcaggcacaggtcgtagtgtccaatggtgccggctatgacacttgggccaccaagaacctcagtaagaccatggtttccgtttccgcagcacaaatggtgggcgccgtcgagggagacaatccgcatttatggttctccagtgacgcccgaaacgccatggccaaggaattggccgacacatatagccgcatcatgcccgcgcaaaagaaatatttcaacaacaaactcaccgcgtggaacaggcgggagaagaaaatagaaaaggacatgaaggcgttcagcgactcgcataagaacgtctcctacgccgccaccgaaccggtggcctactatctgctcagcgacatggggttcaccgacaacacgccggaggggtatctgcaatcgtccagcacgaattccgagccaacccccaccgatcttcaggaatttcaggaattgctggaaaagcataaagtcgaggtgctgatcaacgacacacaatccacaagcgacgccacgaacacgctgaccggcattgcttacaaatccgacgttcccgtgcttgatgtcagcgaacagatgccctccgattacaccagcctgacatcgtggatccgcgctcttatcctgtcgttgaccgatatgttcgatgaacaatccgatgccgacgatcaggatgcaacaagttccgacagcacgtcggaaaacgcggattccttggaatcaaccgcagattcctcgacgcaagacaacgatcagacaacgaacggatcgaacgatgcgccgcaaccaaatccggtgaaatgattgttcggcaaaagcgattgccgaacaatcgatcggtaatcgcttttgccaagaccatcctgcgtccaactgaatgcgggatggtcttttttgtttgcctgacgttttgctttttacgcaaagcctctcgtctgatcgttacgacggtttcaacgacaatccttattgagaatgattgtcaacaccatttgcgagtatgtacgtgcattcaaatcaaggagaagccatgcacgacgagacacctgcctgcatcgaattcgacgacgcctgcgtcaaacgaggcggtcacgtcatctggcaacacggcacgttcagcattccgcaaggctcggtaaccgcaatcgtcggtaccaacggcgcgggcaaaaccaccatgatgaaggccgagctgggattgattccaaccgcgcacggcagcatcaaggtactcggacagcctgcaggctccgcaaaccggcgcatcggctacgtgccgcaaagctacgcatccgacatcgaatcgaacatcaccgcggaacagtcggtgcttctcggcttgacgggaactcgattcggcattcatcccgtcaccaaaacacttcgcgagaaagcccgcaaggccatggacttcgtcgagttacaagacaaagcgaattatcgcctatccgaactttcgggcggactgcgccaaagggtcgccatcgcgcaggcgctcgtggatgacccgaaactgctgatgctggacgagcctctcgccaaccttgatctggcgagtcaacgcgccactgtgcacgtactcgccaaactcaaccgcgaactcggcatgaccatccaagtggtggcacacgaccttaatatgcttctgcccatcctcactggagccgtctatctgcttgacggacatccacactatgcaggcatgaacgaggtgctggattcccatctactcacgcatttatatggcacgaccgtacaggtggtcaccactccgcaaggagatatgttcgtgacgccaagcgaggacgagtctgaaaacatgagcatcgatgcgcatgctccagaagaaatcgcgcaatttcaccatcacagccacaccacgcaggaggactgagcatggacggtaccgtattcgctttcgacccggattgggtttccacgctcaacgccccattcatgacgaacgcgtttctcgccggcctgtgcatcgcattggcagccggcgtgatgggttatttcaccatcgccagacattccacattcgcagcccacgccttggcacatatcggactgccaggtgccaccggagccgtattgctcggcctgcctgtttccgcaggtcttggcgtgttcgctctcggcggagcactggtgatcggcgcgcttggcaagaaggcttcacagcgtgagatcgccactggaaccgtactcgctttcgccaccggccttggtctctttttcgcacgcatgtcaagctcggcttcgcagcagatgcagtcgattctgttcggctcgattctgacgatcaccgacggtcagatcattggtttcgcgattttcgacgtgctgcttttggctgttctggcagtgatctaccgcccgctattgttcagttcgcttgacgaacaggtggcacaggcaaaaggcgtgcccgtcggtttcatgaacatttgctttatgacaattatggccggcgtcattaccattgccgttcccgcagtcggcacattgctgatcttcgcgttggcgatcacccccgccgccaccgccaacatcatcgcccgctcaccattcaaggcgatggtcgtcgccacggtgatctgcctgatttcgatttggggagggctcatgatttccgccatgttccccgctcccccgagcttcatcatcgtgacaatttcgacgttgttttgggcggttgcgaaggctattgaatccttcaaaagaaagtagcagaaagaagtatcggaaagccgtcagcgggcgaaatcagactgcctgacgagtcgatggatcaacaggttccaccaaagcatcggcaatcgcggcgacgccttcgcccgaaccagtgaatcccatgccatccgttgtggtggcggtcatggacacctcacaacctatggcttcagacaacgctcgttcggcttcttccctgtgttttccgattttcggccgattggcgatcacgaccacgctggcactcactggcttcataccacgttcgttcagataatcgaccgtggtccgcaacatttcggcgccatgcttgcccgcgccatcggactgcgagccgacaccgaacaaggtgccgatatcaccaagaccggccgcggaaagcaatgcgtcaatcaacgcatgagcggcgacatcgccatccgaatcgccctcgatgccatcgccctcccaacgcaaacaggcaagccataacggcttgcctgcatcgtgagatgcgaatcgatgagcgtcaaaaccctgaccgatacgcatgaaacgccttacctcttcttggacttcttgctttcggcctcaactcgggccagcgtatccatggcagcctcctcgggagcctcggtatgatgctcctcatcgccgggctgggccggctcatacccaaggttcacgtccagcaaacgctgggcctcggcttcatcaaggtgttcggacagcgaaatctcggaagtcagaatgctacgggccttggtaagcatgcgcttctcaccagccgacagaccatgctcgtcaacatcacgctgcgcaaggtcacgcaccacttccgcaattttattgacatcgccggtggcgatcttctcgacattcagcttgtagcgacgagaccagttcatctccttctcaatgatcggagtgcgcagaatctcgaacaccttggccacttcgttggcgtcgacgatatctcgcacaccaacctttttggcattatcaacaggaacgttgatgaccagaccgtcagacgaaagcaccgacagctgcagatattcgcgggtgattcccttgactgtccgttcggtgatggcctccaccttcgcagcgccgtgacgtggatagacgaccatgtcgccgaccttgtaacccatgaatcctccgtgaaaagcttacacaaaacccgaattattgtgccatcaggggtggacttggccaaaaacacttgaaaaacggaaaaataggcgcgacacgggccacttttcttccgtttcatgcttacacttttgccatggctacagaatccaagatcaatgaagatgtcgttgctgttcctgttccccagggcacactggatgcagtaagcaacggtacgttctacaatcctcacgaggtgctcggcgggcacctcggttccggcaagcatgcggatgtcgtcacgatccgagtcttgcgtccgttggcaaaatccgtgacgattatcactgaacaaggtcaaacgctcgcaatccatgaatacaatggcgtcttcatggcactcgttcccgccgccgcagcagaagaggggtacggcgtgccagattaccgtattcgcacggagtatgaagacggttccgttgtggtgtctgacgatccctatcgttatctgccgaccatcggcgagatggacatgtatctattcggcgaaggccgtcacgagcgcctgtgggaggcacttggcgcacatgtgctccgctatgacgatccgatgggttcttctgaaggcgtagatggcgagcaggtggttggcaccgcgttcaccgtatgggcgccaaacgcgcatgccgtgcgcgtggtcggcgatttcaatggctggaacggacgtacccacgccatgcgcgaacttggttcttccggcatttgggaactgttcatcccaggcattgaggccggcgaaatctacaagtatgaaatcctcaacgccaataacgaatggaccatgaaggccgatccgatggagcgctcccacgagattccgccgcgcaccggatccatcgtggtcgaatccacccatgaatgggatgatgccgattggatggccgaacgcgcggccagcgacccgcataacggaccggtcagcatctatgaggtgaacgcctccagctggcgcaaggacgtgaacgactaccgtgagcttgccgacaagctggttccctacgtgcagaaggaaggcttcacgcacgtggagttcatgccgttggcggaacatccgttcgcaggatcctggggttatcaggtgaccggctactacgcgatcgattcgcgtttgggtggccccgacgatttcaagtatcttgttgagaaattgcacgaggccggcatcggtgtgatcatggattgggttccggcccacttcccgaaggatgcgttcgcactgggccgcttcgacggcacgccgttgtatgaggatccggatccgactcgtggcgagcacccggattggggcacgtacgtgttcaatttcggacgtcgcgaggtccgtaacttcctggtggccaacgcctgcttctggctggatgagttccatatcgacgcgcttcgtgtggacgcggtctcctcgatgctgtacctggactacagccgtgaggccggccagtggcatccgaacatctacggcggccgcgagaatctcgaagccatcgacttcctcaaggaagccaacgccacggcatacaagaacaatccgggcatcatgatgatcgccgaggaatccacggcttacccaggcatcaccgcgccgaccgacgccggtggtttgggattcggtctcaagtggaacatgggttggatgcacgacaccctgcagtatctgcatgaggagccgattaaccgcaagtggcaccacaacgagatcacgttctccatggtgtacgcctattcggagcattatgtgctgccgatcagccacgatgaggttgtgtacggcaagggatccatgttcggcaagatgccgggcaacgattggcagaagtatgccggtgtccgcgcgctgttcgcctaccagtgggcccacccgggcaagaacctcaccttcatgggcaatgagatcgcccagtacggcgagtgggatcatgacggttccgtggattgggccgcgcttgaatggccggaccaccagggtgtgcaaaagcttgtcgcggatttgaacacgctgtacaaggcttcccctgcactttggagccaagacttcgacccggccggcttccagtggctcaccagcgatgacgccgatcacaacacgctcagcttcgtgcgtatcggcaaggacggagagcaaatggtggttgtggtgaacttctccggcgaggcatggaccgactatcaggtaccgctcaccaagggcggcaaatggaccgaagtgctgaccacggatgatgagatctacggcggttccggcattcacaatggcacggtcgaagcgatcgaaggcgaataccattcacgtgattggtccgcgaaaatcaccgttccggcactgggcgcagtattcttgaagccggaactctgagaaaggcggaaagctatgctcaactcatcagcacaacccacaacggctccacgcaccgttctggtggtcgaagacgagccgacactggccactgccatcgcgcagcgcatcacagcggaaggctggacggcgcgcgtggcatccgacggcgccagtgcggttcaggccgcgactacgttgcgtccggatctggtcatcatggacatcatgttgcccgtgatggatggtcttgaggccacgaaacgcatcgtggcggagcgccctgtgccagtgctgatcctgacggcacgagacgacgaggccgataaggtcatcggcctcggtgccggagccgatgactacatgaccaagccgttctccatgcgcgaactcatcgcccgttgcaaggcgttgctgcgccgtgtagatcgtgccaaggtcatcgccaaaaactccgaaaacgagaagcttctcgatttcggctccttggtcatcgatcccgcgcaacgtatcgtcaccgtcaatggcaagcaggtgcacctgacccctacggaattcgatttgctggccacgctggcccgcaagccgaagtccgtgctcactcgcgagaaactgctcgaggaagtgtgggattgggtggatgcttccggcactcgcaccgtcgattcgcacgtcaaggcattgcgccataagctcggttcgaagaccattcgtaccgtgcatggcgtcggttacgcgttcgaaccgccagaagtccaagactaatgcgctaaaattcggtggtatgcgtactaccgatacaaaaccagggcgttcggtgaatccattggaaaccgaacgtcctattggtttgttctcatcgctcaaaattgaattgagcgttctgatcaccatctccaccgccattgcgttcatcatggcgtggttcctgctcaaagtagggctcagcgtatggatcgccatgcccattaccctcgccgtggctttaggaatcacatatttcttctccagaggactcacctctcccctgcgccaaatgcgcgacgccgccgaagcgatggcggaaggcgattacaccgtgcgcgtccatgtcgactccaatagtcgcgatgaagtcggccagctcgccctcaccttcaacgaaatggcggaagagcttcagcatgccgaccagatgcgccgggacatggtagccaacgtaagccacgaattacgcacgcccgtatcagcgcttcaagccatggtcgaaaacatggcggatggcgtgatcgatcctacgccatcaaatctggaaagcatcctcaatcagacgcaccgcctgtccgatctgatcgcgttccttcttgatctttcccgcatggaagccggcgcggcaagcctgcaaatcgaaatgttcaatttcgccgattttcttgacgaaaccgtggaacctttggaaatcgccgatgccgggcatgcgcatgacatcgaaatgcatgtgcccgacgatatcgagatggcaggcgatcaggaccgcctgcgccaactgttcaccaatatcatcgcgaacgcgctcaagcattccgcggacaataccacggtgcttatcgaagcacacgaaaacaaggatttcggcaccatcgtcaccaatgtcgtcaatttcggatcgcagattccgcaagaggcgcgttccgacattttccgccgtttcgtcaaaggaaaaacaggtccgggcaccgaatcgggcggaaccggcttgggattgtccatcgcacgttgggccgcccagttgcacggtggttcggtgagggtcgtcgatgacccgcgtggagccgattttgaaatcattctgccgaaataccatgttacggatgacgaatagaggatttctcacgtcactgcacttgcgtgcgtgaccatgcttgcgttgggccaaccttctgcgttcccgccggagtgtgagccaaagcaagcacggtcacgaccgtggcaccctccttccgcatcgtttcgacgcaactgcgcatggtcgcaccggtcgtgacaatatcgtctaccagaatcaccatcgtattgcgcaaggaaaccgaaggacacaccgaaacatgccccttcaaacgttgcgaccgttgcgccgcaccgctggtctgcactgatttccctttgacccccctgttctccaacgcgtcacgcaccgtcacctcgcagcctgtttcctcccgtagaaaacctgccagatgtttggcgatcggcatcatatgtttacgtccgcgacgacgtattgaagcgggagacgaaggcgcgggaaccacaacaacaacatcatggcatgaaccatgcctatcacgaacgaagtcaataacgccagacgcttttgcaagggcgcatatcgcatcggcgaacgcacggtcacattcctcgtcgccgtgatccttccacgcgagaaccgcccttctgaccgtgccacggtaccatccgcatgcgaaccagcgttgcatcgccacaccgtcaaacgactgtgcggtcggctgggaaaacaatgccctgcaagcttcgcatagcacttcatccggtttgtcgcacccggcgcagccccggggaaacagcagattaaccaccatcgagcatgccctcgccattgagttcatgcgaaacctcccaacaggttctatcgcgatagactggcgatgattccaccgcacaatttcacggtatcgttcggacaggtaaccttcaccgccctggtgcctgcctttgccgcgggataatcgttaccgtccggatccatacggtctcccacaaaaacaatctgcgccaccgtaatgccgagaatatcggccaattctcgaacagcgaacgacttgtcgacgtttttttcggagatatcgacgctgctggcgccgcccggccgtacctccaaatgcggtagatcggcggcaaccgctcgtgccagacgattcttcttctcgttggttggatcccacgcctccttggcttcgatgggcgcaagctgccctaatgcggagaatgtgatctggctgccacgatcctcgatacgttcaccccaaacgtgcgtgagccagataccctgttcgcgcgcattgcgttccaacgattcgtaagccttcgcacgatcatccgcgctgaggtcatgggcgaagaccggcgcccaatccgatccgccccaacggtaatatcgggtgccgctggtcggcataagatgcagatgcgaccgattggcttgacctgtcaaccgttccaccacctgacttttcagcaatgcatacttgccaccggtgatcaccgcgacatcaatcaacgatgtcaacgcggagaagcattcggccatgtcgtccttcattggctttttcgaccttgccaacgtgttgtcgagatcgaaggcgataaggcgtactccattgcacaattcctcgatatccacgtcgttccaacagggcacggaaatatccgtcatgatcgtttcctcctgtgtcgatgcaatgaacaatatgctatcgcatgattcgcgcaaggccctgatatggtagaagccatgtatcaattgccttgggaatcaacagtgtatagaaaccgtcatggtcgtgggacccgcactcccatgttcggtaccagacttccacgttatcgtacaagaagcggtatgttcgacgacatgctggtggctcagatccgtaggctcaacgatgcatggcccgaactggtggcaccggtacagtttgcggtcgaggatgttccgccatccgacccggcaccttgggaggccactgcgcacttgggctcgcagtctttccccgcggaacatggcattccgccgcgcgtcgtgctgtaccgtatgcctttgcaatcgcatgcgcgaagccgtatggacctgcaattcgccatccgcgacgaagtggtgttgcgcttggcggaactgtatggacgccgtcccgaagagatcgaccccgattggggtatgtgatcaacgcacgacggtcatgttctggttggccagcacctgctcgcgggcttccttcagatccgttgcgccgataatcgacactccggccagtttcgcatccgatacgtctttttggctgatacggatgttccacaccattgattggtccggatcggcaaagcttacggcggcaacgtctccatcgttgatatccgccagatcaaccgttgtcgaagcgccggattggagagcaatctcgcgctggtcaacagtatctccgacactgttgtaggacgtcaatgttgccgtgcgctcatcgcccgatatgttggtgatgcccacttgagccgtggcatggtcgggcacggccatggcggagacgctcatcggcactgaagcgttgaccaaggcgaaatcagcctggtcatcatcgccatcattggtgatcttcgcggcgacagataccggctcgctggcgctgatggtaagtccggtcgccgacttgggaactgaacccaggtcgatgaccgaaacgcgattcgattcgagcgtctgctgattggttttcttcagaccttggtcatccgtccaagatacggtgacgtcggcctgccgagacggatacacatacaggttgacggcatcgccttccgtgagtccgtcaatcgccaatgtttttgcggcaacagtattgggaaccgcataatccgatccttttgcaaccagaccatccatggctatggtgcgtaccacggccgcaacgggcgtgtccacgctggacacggtaacgtacaaagcatcctgcccggaagctgctgcggcaaggttcagcacagattccttgcccgcgccaaccgtcaacgtcgaaccagtagacaatgccaaagcacccgacttgtcggatccccaaaccttgatgttcaccgacgtggccttagccgacggattggccacgaccagctgctgggtcatgcctgttttggtgcccgacaccatcagcgactgcttcaaagccggaacgacgcaggaagcagcggaaacgcctttcaaatctccctcagtagcccaagacatcaccgaagaggccgctcccgttccatcggaagccgacagcaatcgggtattctgcaattgggctccgtcatcgaccgtgccggacgccatgaaaatatcatcatccgatccggcatcatccttgttcaacaccaatgacgaagtggcttcatcagctccgagaagccctacggaagagcggaacaccgaaccgaaggacgcataacgcgccgacgacatgatattgccgttggacgcttgatattcgctgtctccatacacatcagtatcagctatcgtcattcgtgctggacaatatgtttccagctgacgcggactgacggtgcgggatacggatgaacgctgcgttaccggcgaatccgcatgaatccaagtcgggcggtagattacggccacagtcgccagtgcgacaatgaccaacaccgacactatggccagaattacacgccaaaccgttttggaacgggaatgtttgctcatgcttcctcctgaccgtgacgcctcatgcgcggaagcgcaaccaagcaatacgctgcgagaacaatacccatgcaccacagccatgcctgacgccacacactcgattcagcctgtcgatatcccttgcggtcgatatgctgcttggccgtatcttggatggtgagacgatagtatgttcccgcatcagtacttacgacattctgcgtgccatcggaagcgctgatattggaactcaactgatcggttatctccttttgcgccttgtcttcgccggagcgcaccacatagatgcctccgaatcccaactcgctcaaatcggcgacggcgtcggaatcagcattcgacaacagctgcgcgcaatccttggcgatggccttgttcgcatcatcggaacgtccgaacgccacttcgacacgctgtgccggagagctgtcgatcaaatcacctcggcgggtgcgcatcacattgtagctgatggaaccggcactatccgcgcgtactgcgagcacacgcctcgcctcatcctgcgcaagatagtcggaagcaacaatcggcaaaccggaatcactggtcgaaaccgtgttatggtctctggcgacataatcaaaaccggcactcgccacaaccgacgccgcaatcagcatgaccagcacgattcgtgccgcacgcccggcaataatgccagtagaagcgccattcctctcaacttcgacatcgccggtgggcctctgccacagcatgacgaaacgttgcaccgcaccgcctgcgaccatgcacacgcaagacagcagtcccatcatcgtgaatgaaacgccgggaagcacggaaccggccacggcgccatccgcatcgaccgcaaccacaaccgcggcggaaagcagcgacgtggcaagacccgcgatcgccacgacccacatcatacgcgacacgcgaagcacgaatggcaggaacagcgataccgcggcaagaagcacaatcaatgccaacattgcagcagccacatactgccaaatctcgccggatacggcaacgccgaacgcacgggaaacaatatccgaaagatttgcgatcatcggatgcccatcatgcgcagacgacggcaatatcacactgccaaaaatctgacgccacgtacctgctcctgcgaaacgtaccgtgttgaccaatgtgggcgcgcatacggaagcggccggcagcggaatcagcagcagcgtcgttctatgggagcgtacaagcatcaggaacacaaggaacgacaacatcagcggcagcagcaattgcggttcggccgcgacgacgggaataaagcacaatgccgcaagcgccgcggcctgcacggaagcctgcggattgaccagatcttccgtacggtacatgcctacggctcggaaagaaaacgcgaaggccgcaggaagaaacaccatgaccgtcatcatcgtcacgtcggcatcgctgtacacgttcatcgacaatgcgatggcgaaccatgccaacgcgatcacgcaacgcaccgtgtcggaccgagtaaagattccagccaaagcccagaacgacagcaccatcaaaggagcggacaagaagaacaccacggcgactgcggtcgcaacatggccagccgtgaatacggaaaccaccatgagcaccagcagccaaggcgcgctcggggcgctgattccagttcccgcggtatacgcccacgacgtggtggcggcatgcaccaactggctgaaactggcatcggtcggcagcaacgtttgagaatatatcgacgcgccggagaatacgctccgaagcacattccaatataggaagacgatccatgcgaaggcgatcaccgccgatgcgatggcaagcccccacctgcgcatgagccttttacgcagatgcgccttggcaagagggctgaggatcacagtgccacgctggtcaagaaacgcacgcttgcgatcgttccattggccgatctgctgacgagtcgtctgcaatgcggccaatgccttcaaggagaccctactctgctcacgcaatcgggcacgggccctccatgcgcccggcaagtggagcaacgaacgccaaggcagggccaattcgcaacaggcatggtatggctgtttgcgcgtcaggcacagcacggccagtcccaacgccttcagtgtcgaccagatccacagcagcggccaccaagaacgatgcacgtccgtatacgcgtatttcgtattcgcctcgcgtaccgcaaggtacggatcgacgcggccttcctcatcttcaacaggttggccgtttttggaacgcacgccttcaaatcttgccctcctatgggcgattcgcgcctgcgggaccaccaccacacggccaccgcccaggcagatgcgcctgcacaggtccgtggattcggcgaacgtgccgaaccatggatcggcacccttccaagtacgcaaggtggccaatggaaccagcgcgccggaaagcgacacagccaacacatcctgccggccatcatactgttcctgatccggctcaccgtccaccaccagagacgtgacattgtggtgccccgcatacaaaccgacgttatgcaggctttccgcctgccaatccaactgtttcgcgccaagcaaagacgcagtcggcgtgtttttccaagcatcgagcaacacctcaaggcatgactcatcggccggcctggaatcgtcatgcaatgtccacagagcaccgacccggtcgtcaagatcgatctgttgcattgcacgagccacggcattcatgaatgaagaggcacccttcactcctacgagaatgacacgtatggtcttgctttcgggaacttccgtaagcacaccggcaggcgacgggataacgctaaacgtcatctgcataggctgctcaacctgattggtgcaatccgcaacgataatagtgcctggaagcacacgctgtgcgagcaccgcggcaaaagtggatgagaaaaaacgtagatcgctttgcgcggtaatcaccgcagccacggatgaatcggcatcctgccgatgggagtacggcctgctgttgagcagatcggtcacaattccctggatatcgctgctggcgttagaattcataatttcaagtgtacgcacagggtgtgccgtgcgttatgcccgttccttgtgttccttcttataccgacggcgctcacgttcgctcatgcccccccaaatgccgaaacgctcatcatgctcgatggcccatttcaggcattgctcacgaacctcgcactgggcgcacactcgcttggcatccctggttgatccgcccttttcaggaaagaacgcttccggatcagtctgagaacataaagccctatgctgccaggaaacatcatcatcgcttttgaacagaccccacagttccgcaagcggattatcggaggactcgtcgatcacgccccacatgcgtcctcccctgctatacgtatgcgcacttttagtcgtgttaaattacacacatgcaatttctttttgtcaagttttccgccgtgtcaatcactataattcgagaaaaatatggtacatggtacctccaagaacgacgggggcctgaagcagaatccgtgaaaatcggggaacatctctataatcccatgacagagtagtggtatgttctagaacgcgttgagatatggcgtgatcttttgtataaacaggaaggcgataccgtgaccacatcaccagccggcgataagcttcctaacgtcaatggactgcgagacgcaaagccgcgtcacagccttggctatcgagtgcagcatcgtgcgaggacgatagtcgcttcggtcatcgcggcgatgctggtgttctcgggaaccgcagcggccgcaacatggctggatgtgaatggcatcatcaaagaccattcggtcgaaatcatcggacaaggctcacttgacgccaacacctcgatcatcgatcccaactccggcaaacccatcgaattcgtactcatcgggcaggattcccgcgatggcgaagagaaccagtccgtcggaggcaacttcgacgacgtggtaggcaaccatcaggccgacaccacaatggtggcgcagatttccgcggaccgcaccaaaatcaatctcgtttccattccgcgcgactccctagtggacataccgcagtgcgaaacgaccaacggcacgattcccgcgcaatacaatgtgatgttcaactcgattttcgcgaacgcataccagaccggcggcgatctcgcttcagccgcaagctgcaccctgaatgcagtgaacagcctcaccggactgaacattcaaaacttcatcgtcgtggatttcgcaggactggtcaaaatgatcaatgccgtaggcggagtcgacctgtgcatcccacaggacgtcgacgacccctacaccagcctgcaactcaccaagggcctgcaccatctggacggacaccaggcaacgcagtacgcacgaacccgccatggtctgggagacggatccgacacatcacgaacaaccagacagcaatacctcatcaaacagttgatgaacgaagcgctcagcaagaacctctttactgacaccgcacagctctaccagctagcgaaatcagccttgcaatcactctatatctcgcaaggcatggccgataccgcagcgcttgcaggtcttgccatgagcctcaaggatttcaatctgtccaacctgtattcgcagaccgttccggtagtatccgcgccgtcggacccgaatcgttcggtctggaccgatgaggcggagacgctatgggagaagatgcgcgcggacaagccgatttatggttccgacgaatccgacgcgaacacggatgccaataccgcaggcaattccgacggtccttccgataattcgacggatggcactgacaatacggataatatgggcactgacaacacgggttcccaggaagccgcacagacgcctgatccggtcactggtctgatcacgcaagccgatggcacgcttatcgatccgaacaccggtggcaccgtcgatccggaagatggctccatccatgacgctcttaccgggcagtacatcggacttgccgatcgttacctcaacgcgacagtttgtgccgttcccgcaaagaactagaccgctttcaccgaatccgttcctacacggtgtaaatggtgtaggaacggatttctttttggaggatattgtatgagtgaagagaacggcggcaaggaccccatgcccgcaccaccgagcttcatcccgtctgcaggacggaagaagacggaatcacagcctcacaaatccacaattccttctcaatccggctctccgtcaattccaagtttttcgcctgccgcacagccagcgcgctcaagtgccccgcacgccagcaggcgtacagcgcaaccatcatccgtaactccatccggttccagcgctccacagagtttccgtcctgccgcaaactccaccagcagaccacgtaagtcggcatcatcgtctcctgcatcgtttgctcctgcttcagctccgaacaatcaccgtgcgtctcagcaggtacgaggatcctcctccatacccactggcatgccacgaacaacgcgacagaacacgcccagacaacctttgtccggcaatagcacaacaggattccaatccactgcgaaagccatgctcccccacagaaaacgacatatggggcgggtcattctcgcgtttttccttgctgtgattctcgccttgggactgtcgatattctccgcatggaattgggtggatggacagctcaacaaacagtcttggttgacgaacaaagccgataccgctggcgaaagctggctgatcctcggttccgacgaacgcgaaggcaccgttggtgacgctggcgacgtgaccggtttcagaacagacaccattctggtactcaccaaaccgaaatccggaccttcctcactgatttccattccgcgtgattccttggtggaaatcgaccagagttacatgaaaatcaacgccgtcgcccaactgtacaacggcaaacaactgattaacgaagtcgaagacatcaccgggcaaaaaatcaaccacgtggcaatggtgcaattcgggggtctggtcaaagtggtcgacgctttaggaggcgtcgaattatgctacgaccaggatgtaagcgatccgtactcccagttgaactggactgccggctgccataccgccgacggcaccaccgcgcttgcgttttctcgtatgcgttacgcggacgcacaaggcgatttcggacgtgcagcccgtcaacgccaggtcatcaacgccatagtgaaaaagggcgcgtccaagaatacgctgctgaacttcggcaaagtcaaaaaagttgcggaggctgcgttgggctccgtaaccgtggatgaaaaggcttcaacctcatcgctgatgcgcatggctttggcgttcaaaagcgcttctggggatcaaggcatttcaggaagcgtttattggaccgatcccgactactacgttgatggtgtcggctcaagcgtgctcttggacgaggataagaacctcgaattgttctccgaattggctaaggggacccatcgggctggcactgtaggcacgcttgccgaacagcagggctgatattccggtcggaggatgtggataactcatcctccgaccacaaccctggtttcagcttgcacccgctcatccgcattgcccactatggcgggtatgaagggcaagaacaaacgcaagcataccgatggattcaatgaagaccggctgatgctcatcagttggtccgcacctgtgctggcacagctcgtcatgcttgtcataatgatcgcgcaacggcaatggctatatgtggccatgcttgctcctggactcatcagcagcgcgttgtctctggcatccatggcgttgcgttccaatcagaagcagcagcatgacgaaccggtctccaccacctatgcaaaggtggtggagaccgcaaggcaaaacagccattcgccgttcgccgcaatgccccatatgtgtttcgagcggttctacgctctggacgaggacgcgctgccttggcgcaccatcacacgaacatggctttcctccacatcatcctgccctataggagtcacggagcatggcttgtttcgcacggatctgcaacgatcaggaccgcatgccatggtagcaggcaccacgggttcgggaaaatcggaattgctcatcagttggtgcttgtcgctcgccatgcaatacagccctgatgatctgcattttgtgtttttggatttcaaaggaggatcgacattcaacgctttggaacatcttccccacaccgttggcaatgtctgcgatcttgatttgttccacgcgattcgcgcgttgaatgccattgaacaggaattggtgcgtcgtgaggctctggtcagcgccgaacgtgtttccagattcgaccaattggtccggcctccggcacgactggttgtggtcatcgatgaattccatgcgcttcgagaccgtctgcccgactatatgcaacggctgaatcgtcttgcgtcacttggccgttcccttggcatgcatctgatcgtctgcacgcaatatcctatgggccaagtccatgccgacatgaaagccaatatctcgctgagcatatgcttacgggttacagaccaaatgcagtcgaacgaattgatcggcatacgtgacgcagcgctgattcctcccagcattcccggtgcagcctattgcaatgacggacaacacaccacacctttcctatgcagcgcggtccgcgatgtcaaccgacttgtccgcaatattggaacggccgcacgattccacgcctgcaaacgccccgatctcctgttttccgagcctctcacgcaacatgcaacgcaatccgatctttccatcccatcaaaccagtcatggcataacgttccctttgcgcttgccgacgatggcgtattggtgtataccgccattcttgacgtgagccaacagaatatcgccatcatcggtgcctacggcagcggcaaaaccaatctactgttgcattgcgcacgctggctatatgacacgggttgcgccaatattcgtttcacacgcaaaaccgaacatggcatggtgacggatgacggcaaacccttaccgtcgcataagcgaaccatctggattgtggatgatgcggacgaagcgcttaatcccttttcctctgcgcctgaagcgaacgaattgcgtgaggcgttggtcaatcccaatatcacagtgattgccgcggtggaaaaacctatttccgcactgctggaccgatgtccgactcgtgtggcgttcccctgcggagaacgttccaacgatctgatgctcggcattcccggcgcaattctggacgggttcgcagccgacgactataccctcccaggtcgtggcgtgctcatgcaacaggccaaagcatgccctattcagtgcgtggaattccaaggtttttaacgattcgtgggattcttttcgcgaagactcttgaaaagtcgcgcgattcgtggttatctgagtaacggacttacatgccgtacatggcaagaggaaggcgattatatgagcagtgcttttgactggcgcgccaaggccgcatgccgcgacaaggatccggagctgtttttcccggtcggcaatacaggcgccgcctatcagcagatcgaagaggccaaggccgtctgccgcacctgcaaggtgattgacgcgtgcctgaagtgcgcgcttgacaccaatcaggattacggtgtttggggcggtttgagcgaagacgaacgtcgtgcgctcaagcgccgtgccatgcgtgcccgccgctcccaagccatgcagatgcagatctgaaattttcaaagatccatcattgcatacgctctgcgaatagcgacttacaacgaaaatgtccggttgacttcccctggtcaaccggacattttcgtatctttcctatcgttcctgcgccgcacgcagcttcatatcgagcactactcgggtgccaccgccacgacggggctcccaacggaccgtgcctccgaaatcgttgttgacgaacgtgctgatgatctgcgttcccaaaccggatccggaggaacgtgccataccatcatgctcctcattggccaagcccgtgccatcgtcttcgaccacaacattgaggttgttgccaccgcgtcccacggaaatcgtgatatgaccttctttgcgaccttcgaagccatgttccacggaattggtgatcagctcggtcagcaccaatgacaacggcgtggcatcctgcgccggcatcatgccgaatctgccgatgaagtcgatgtcgatatgctggtcacgcatggtggccaaatccaccgccatcttcaacaggctggaaatgaccttgtcgtaatcgacgatttcatcggcggtctggctcaagccttcatggaccatggcgatggtttgtacacgacgctgcgcctctttcagctctttcttgacctcttcggacttggtcttacgtgcctgcagtcgcagcaatgcggaaaccgcctgaaggttgttcttgacgcgatggtggatttcggaaatcgtcgcatccttggtctgcagttccttttcacgacggcgaagctcagtcacgtcgcgacatagcacaacagcgccaacgcggccattggcatccatcaacggcagcgaacgcatggacaccgcggacttgttggcatcgagttcggaatcgacggcggctttgccactgagcaccagaggcaaggtttccagcacgggatcgttctcgcgcagcaatttggtgccgatttcgctcagatactccccctgcatggtgctgaccgatcccaaacgtcggaagcagctgatggcattcggcgaagcatatcgcacgataccttcgacggtgagcacgatgaagccgtccgccacacgcgcattgtgacgctggttcataatcggattacgatatgggaactgaccgcgaggaatcatctcatacagctgcttacctgcgctgatgctttcggattcgtaacgtccgttcgactcccgggtggccatattcgtctcacgtaccaccaagcccagcgtcttgccattatgacgcaccggcgcgtacacattgcacaccgtggactcgcccacagtgcggagcaccgtggaacggaacaccgattcggaagccatcgcggcatccaattcagcgctcatttcctcctcgacaacgtcgccgaccacatcgtcggccctcaggctcatcaccgtggatggacgacactgttcggcaataatgtatttgccctcgccattttgcagaatgagcagcagatcagcaaaactcaggtcggcgatcacctgccagtcggcgaccagatgatgcagccattcacgatcttcgtcatcgaaatcgggacgggtcgtcaagatatgtgagaaatcagccatgcgctccatcatacgcatcacaccagaggttttgcacgacacgacgcatattgcaggaaaagcaatattgacatatccatgagttacggtaacgtaggttacggttccgtaacttacagtggaggcacacagatggcgaaacccacagacgtagagatcgaggaaaaacgagcgatcatcgccgaggcacgcgaacaggcccttcaagccaaggccgatattattcgcgtgaaggcacgcaacaaggccgagaacatccgcaagaaggccgacggcaaggcgaaaatggctatagccaagggcgaagctcgtgccgcgaaaatagaaggcatcactccggcggagatcgaacgtaagattcgtcttgacgtgcacggtcgccccaagccggcgatgcgcggctggattcatgccgtggccactcctctggcattggcggccggcatcgtgctgatctgcctggcacacggtaccggtttgaagtgggcctgcgccgtgttcatgacgtgttcgctggtattgttcggcaattccgcctgctaccatttgggcgattggtcacctcgcgtcacggatgtgctacgacgcatcgaccatatgaatatcttcctgctgatcgcaggcacttatacgccggtctcctttgcactcgaaccgttctggcgcaattcaatcatcgcgggcatgtggatctgcactaccgtggcgctcatcattcacgtcatctggatcagcgccccacgctggctttacgtgattgtgtatattattttcggtgtttccggagtggcattcatgggattgttctggatttcgccatatgccggtccggcggttgtggtgctgttggccgcaggcggagcctgctatatcgccggagccatcgtatacgcgctacgtaagcccgatccatggccgaaggtgttcggcttccatgagattttccactgcggcaccgtcgccggttacgcatgccatatggtggcgatctacatggtgatcgtgcagctatggacgtaagttcagatcatatctgattgcagtttgacgaaatatacgaaaaggctggttcatccgttgtattcgatgaaccagccttgtatttatatcgctggaatatcagattcagcttatgacgaacatcactcaggcgagcggcttggcttccttgatggtcacggaaatctcacgtccgttcggagccgtatacgacaccgtgtctccctcgtgagcgccgttgatggccgcgccgatcggggattccgggctgatgatgctgtagtccgtggcgatggacaggtcacgcgtgccaagcacgtagaccatttcacgtccgttgacatccagcgtcaccaaagaaccgtcgccgacttcgccggccttgggcgcggtcagaatcttcgcgttgcgcagcttgacggtcagttcctcgatgcggccctgatttactcgctgagcctcacgagcggcctgatagccgccgttttcgctcaaatcgccctcggcgcgtgccgcggaaaccttggaaaggatttcgtcgcgatactcgccttcgcgccaagcgagctcttccttcatcttgtcataagcttcctgcgtcagcagaagcgttttttcttcggccatgttgcctccttgaccttggaaattactctatgccgcttagtttcagcgggtggagatgatgtcgatcacgaacaccagggtgtcttcgccgccgatgccggcctgcggaacgccacgggaaccatagccatactccggcggaatggataccaccaagcgggaaccgacgttgtgccccggaacggtctggtcccaacccttgatgacctggccgacaccgatgccgaagctggccggctggtgacggtcgaagctggaatcgaacggggtgtctttgccccagaccacaccgtgatagttaacggtgacggtgtcgccgcggcgaaccatcgggccattgccctcgagcagctccacaaccttcagacctgccggagcggtctcggacgggaattcgatggtcgggcgatcgccgaactcaacattgacaacgggcatttgagatgccatggtgaacctccttgaaaagcacaatgccacctagactagcaccaaccaccgctagcattcaacgacattgaccgccaaaccaccttttgaggtttctttatacttggacatcatgtcttcgcccgtgtctttcatggttttaatggcctgatcgagggtcacgatatgcgttccatctcccagcatggccatacgaaccgcgttgatggcagtgttcgcagccatggcgttgcgttcgatgcatggaatctgtaccaaacctcccacgggatcacaggtcagtcccagattatgctcgatgccgatttccgcagcgttctccacttgctgtggagtaccgcccatcaccgcgcacaaaccggccgcagccatcgaacatgccgtaccgacttctccctggcatccgacttccgcaccggaaatggaggcattgcgtttaaacaggtaccctaccgcgcctgcagtgagcaggaaggtaataacaccctcttcgttcgcatggtcaacgaaatgccagtaatagtgaagcactgccggaatgattcctgcagcaccgttggtcggtgcggtgacgattcgcccaccgccggcgttttcctccgacaccgccaaagcgaacaaatccacccatgccgcatccgacgattcgagcaccgcatccgcgcgtttcttgtctcgcgcaagcacatcactgttcgaggcaagccttgcatacattttcggtgccctgcggggcgcattcaaaccgccgggcaacacggtctgcgacgtatggcatccgtgctgtacgcaacgacgcatcacccgccacacgttatccagttcgctgcgaacctgcaccgccgactgcatggccgtttcgttggcccacacaatgtcggcgatactcatatgttgcttctcgcataatgcaatgagatcgtcgcatgacgtgaatggatatggcacatccgagccgtcatcaagtgaggaatcactctgctgatcggcgaaagacgttccgatcggcggacgctcatgaatgccgatcatcagatcctcggcattgccttgccgtacgaagcctccaccgatggaataccagacctgttcgtcaacaagattgttctgctggtcaaatgcctggaaacgcatgccattagggtgcgcggccaagcgatgccacacgtccatcaccacatcatgcgcatagtcgaaatcgatgcgatgcttaccagccagcagcagttccccactcgactcgcattcatgacgaatgatgttcacatggtccgtatcgacggtttgcggcatgttaccttccagacctgccacagtcgcgcgatcggtaccgtgccccaaacccgtcaacgcaagagatccatacagtaccgtacgcacgcgtctcacacggccaagcgttcccgtatgttcaagcgattcgacaaatttgcatgccgccaccatcggaccaacagtatgtgaggaacttggtccaacgcctatcttgaacatttcgagaatactgaacataccaatcgtcgccttgcttctcaggtgccttgctcaggctgcatacaatgcacggaacatgagaatcataatgatcaaaccaatgatggcggccgtaacttccaccaccagcatgataatggccgtggttttacgattgccgagtttaacgtcaagtaacttggcgaacaggaaggcgacgaaaccaagcgctgcgccattcaacgcaatcgcaccaatctggccattggtgagcacactctcccccaccatggcaagcacggaattgatggtggcggagaacaccagcaggctccacgcaccgtaaccgataagtccaacaatcgcatatgcgaacggtcggaaccgttcacgcattttgagcgtgaacgattcggcgcaccacagcagcgcaaagcccacaacgaacgtgaacgccactgccatgaacaccgcttccatagcccatgggatcaacgccaacgacgccttcaacaacgagaaatacagcggagaacaagccagttcgcccacagccaaaactcctgcgacgataatcgcttgggagagcatcagcggaatttccgtatcgggctgttcgattactggcttgatatctttcgacgtcatactttttccgttccagtcggctacttggggttatcaatgccgccagtgtaataacggattgtttcgtacgtgctatccagcaatatttcacaacgtcattcggtgccgccagcgggaatcgaacccgcaatccgaagagaccgattttaagtcggttgcgtataccagtttcgccatggcggcaaggcatcgaacaagccgacgcccaagtcattatgccacgttaacgttcggcaagcaatcgcgtgccgtaatccaacacaatgccatcaagcaaaccgtgttcgctggccatgaaggagtcgatatgctgaccatggtcggcataggccgcttcgctgactttggcgagcacacgattccacaccagtgcaccgccaccgaccacgtcaacacgacccgggtgaatggttttgtaggtcaggcgctcttcgcgcggcatcgtaaggaacttgttatcgaccgcataagcgtcttccagcgagcagctggcaccatccaccgcggaatggtcgtattcggtcaatcccatggccagagcggtcatggtagtcactgtgccagacacgccgatgatagtgcgggttttgcctgcaggaaccgttttgaacgcttcatcgatatgctcgtcgatgtcggcaatggcctcttgaatctgcgcttcggtaggcggatcgttcttcaagtggcgttcggtcatacgcaccgagccaatgttcatggagaacgcggcctgcacctgcgtgttcggatggcttacgccatcgccgccaagcaccaattccgtagagccgccacccaaatcaaccaccaaatacggagcttcgacgtcgcgacgaaccacgctcgtggcaccaaggaagcttagatcagcctcttccgtaccgggaatgacttccggacgcacgccgaggatctgctcgatagtgtcttcgaattcctcacggttctcagcatcacgagtggccgaagtggcaacgaaacgaatgccatccaccggatgctttttcagcacctcggcgaattcgcgggcagcggcgtaggcacgttccaatgcctcatcggcgaaacgatgcgtcttatcaacatcctgaccgaggcgaatcacacgaagaatacgcggaacaatatcttcaacgccgtcttcgctgactcgggagaccttcagacgaatcgagttcgtaccgcaatcaatgccggcaacagtaacggatttcattgcttcttctttctgtctgaatatggttcagtcttcgttttccaccgtgcaacggcatacattggggtcgaattcatgacgaatcgcctccaatgccatgtctccgatcggattggcgccctcgcccatcaccagcgtttgcgccagcaaggcgtgcagacacttgatgcgaacaggcatgccgccggcactggtgccttcgatatgctcttcgctgtcttccatagcaacggcgatttcatgccggaacgccaaatacagttcgtgcgcacgctcgtaggcggctttcagatcgtcatcttcagccaaaagatcgttgtactccttcatcttgccttcggcttcgatgtgggagatggctttcaccgcttccgggccagtcaaatagcaagtggtagggaaaggcacacctcccggcagcagcggacgcgtgaccacagccaaaggcctgccgcacacgcaacgtgctccgacagccaccatgccacgcgggtaacgacccagctgacgctcgaccacagcaatatcatgctcggtggcaggctggtcgagaaccttcttcgccaaggttttggcctgttcgctgattgtcataccctgtgtcactcctgctgatctcctgattgctgttggttgttgtcttgtgaagtctgctgctggccaccggattcctggcttgttccattcgcatccgattcaccggttgacgtactttcggacgtttccctcgatttcgatttcacttcgtccgattggtcggcttgtttgaacgaatacgccatctccttgtaccaaggcagtacggttttctgcgattcatccgtcttttttgcatcttctgtggtttcgccggtcaccgcttcgggatgttccacacgaatcgcctgttctcctggaaatacgaatcccagacgatcccttgcctgcgccgtaacgtaagctttgtcatcccaacgcgcaatgtcgttttccagttcctgcttttgcgctatcagcgcagcttcctgcttcttcaagccattcaattcagccatattcagcgcataggtatggaacgtcgacgccagctggatggatcccaaagccacgataaataccgccacaaagaacgcgatggggccagcgctgccccttctggatgctttcttgcgtgactttgaactcatagcaatgaaaatacccgccgcgttcgacgaggaacacgacgggcactctacatcagcgcatattcgatgcgcttacgctcacttggcgatgtacttcttgcaggccttgaaagcgctgtagccagcatactgagcggtggagccgagctcctcctcgatctcgagcaggcggttgtacttggcaatacgctcgccacgagccggagcaccggtcttgatctggccggtgttctttgccacagccaagtcggagatggtggtgtccggggtctcgccggaacggtgggaaaccatggaggtgaagccgttcttggtggccagctcgatggcgtcgagggtctcggtgacggtaccgatctggttcagcttgaccagcagggagttggcggcgccgagctcgatgcccttagccagacgtgccgggttggtgaccagcaggtcgtcgccgacgaactgcagacgatcgccgagcttggcggtgatggcagcccagtcttcccagccttcttcctggaacggatcctcaatggagacgatcggatactcgttgatgaggttctcgtagaagtcgagcatgtagccggcttcacgatcgtcgccttcgaagtggtacttgccggtctccttgttgtagaactcggaggaagccacgtcgagggagatgccgatctgcttgcccggctcgtagccggcggcggagatggcgtccatgatgtagttcagggagtccttgttggacttcatcttcggagcgaagccaccctcgtcgccgaggccagtggccaggccttccttcttcaggacgttcttcagggtgtggtagacctcaacgcctgcacgcagagcctcgctgtaggtgtcgaagccgtacggggagatcatgtactcctgaatgtcggtggcgaagtcagcgtgagcgccaccgttcatgatgttcatgttcggaaccggcaggatgtggccgttggtgccgccgatgtagcggtacagcggctggcccgcggactcagcggaggcgtacagagcagccagggacacgccgaggatggcgttggcgcccagacgacccttgttcggggtgccgtcgagctcgatcatgacctcatcgagagcgcgctggtcggaagcatccatgccgatgaccttcggagcgatctcttcgttcacggccttgacggcattgagaacacccttgccctgatacacggacttgtcgccatcgcgacgctcccaagcctcagcttcaccggtggaagcaccggacggaacgaggcccaggccctgagcaccgtcttcggtgtcgagaacgacctcaacggtcgggttgccgcgggaatcgagaatctgacgcgcgtaaacgctttcaattactgccacaactactccttataaacgttaggttgtgatgacattgcctagaatagtgcgttttgtggacgtatggcaaacttatccgacacgatttgtgtgaacgctcacacaaatcgtgtcggatgcgtctggaacttcacctgctatttctttggcgttggcttccagtcaaggtcatccagcaattggttcgtccaaccaacgatttcatcagagctcattggaccagatcccagcgaacctgcgaacggcgcgggaatcaggtatgttttagtcatcggacggtattgaatgcccttgtagattctggccatgcgcatttgcacggattctcgcggctcgaatttggcgacacgaacgttacggccttgcccgatgatttcggtaatgcccaacttccttgccttgaaccgaagtctcgccacatcgaacagcgcctcgaaatcgaccggaggcttgccgtaacgatccgtaagctcatcacgcaactcgtcaagatcggcttccgtacgagcacccgccaacttgcggtaggcttccaatcgcaatttgtcggaatcgatgtagctgacgggaatggacgcttcgatcggcagatcgatggtgacagcaaccgattccgtacgttccggttccttgtactgctcgacggcctcggacaccatgcgcacatacagatcgaaaccaacaccctcgatatgcccgctctgctcgtcgcccagcagattgccggtgccacgcagctcaagatccttcatcgccacgtcaaaacctgaaccgagcgcagtgttctgcgcgatggtggccagtcggtcatgcgactgctgggtcatcggcttggttggatcatataggaagtacgcgtaggcacgctcacggcctcgcccgacacgaccacgcaactgatgaagctggcttaggccgaaacggtcggcatgatcgacgatcaacgtattcgcattggaaatatcaagaccggtttcgatgatggtggtgcatacgagcacatcaatgtcgcgatgccagaagtctcggatcacaccgtcaagctgcttctcccccatcttgccatgggcgatgccgacatgcgattccggcaccagctcgtgaatcttcgcggcaaccgaagcgatgtcttgcactcggttgtgcacgtagaacacctggccaccgcgcaacagctcacgtctgaccgcagcagtgacctgagcatcctcatacgcgccaacgtaggtaagcaccggcaagcggtcttccggaggcgtggccaacgtggacatttcacgaatgcctgtaacggccatctccagcgttcgcggaatcggtgttgccgacagactcagcacatccacattggtacgcagcgccttcaacgtctctttgtgttcgacgccgaaacgctgctcctcatcgatgatgaccagtcccagatccttgaatttgaccttcggtccgagcagtttgtgcgtaccgatcaccacatcgacggaaccgtcttcaagtccctcgatggtgtcgttgatctccttggtggtttggaaacggctcatcgcccttacttccaccggaaaaccttcaaaacgttcggtgaacgtctcgaaatgctgttgcaccagcaatgtggtcggcaccagcacagccacctgtttggaatcctgcaccgccttgaatgcggcacgtacggcgatttcggttttgccgaatcccacgtcgccgcaaatcaggcgatccatcggcacgggcttttccatatcggatttgacttcgtcgatggtggtcagctgatcagcggtttcttggtacgggaaagcgtcttccagttctttctgccaaggggtgtctttgctgaaggcatacccctgcatacgttgacgtgccgaatacagtttgaccagatcttcggcgatttcgtgcacatgcttacgtgctttcgccttggtggcagcccagtcggatccgcccagtttgttgagttttggagcgtcggcaccgatgtatttgctgacttggtcaagctggtcggtggggatgaacagtttgtcggcaggtgcgccgcgcttgctggatgcgtattcgatgaccagatactcgcgtgtggtctggttggcgcccgctccgatggtacgctggcgcatttcgaggaacctgccgatgccatgctgctcatgcaccacgtaatcgccggctttgagctccataaggtcgatggccttacggcgacgtttcggtgtttttgcctgtcccgcggccgatgtacgtccggtcaggtcgcgttcggtaagcagtgcgactttcgcggcattatcgacgaatccgtcgatggcacgcgatctgatgcagtcgaagttggcgattcccgtttcgttgatggcacgtttgagtcgaacaagagtgccttgcgctcctgcagtgacggtgacggcatagccggcatcaagaagaccttcgataccggaagctgtcttggcctcatctccgcgatattctccaggattggtggcgtcgagctgaacgcggccttccctactggagtccacaccgaaactcgtaagcttccatacgtcatgcctagagaacaccagtgaggaaatcgtttcctcaaaatcgtagaaattcgcctgatcgaatgtgattggagcaccggcaccatgaccggatgcagcaacatgccaactggctgcaaggaattcattagccgttttggcaagatcgtcggcagcgcgacgcaatttttccggatcggacagcatcaccaacgcacgcttgggaagcatgccctgcaccggttccatatcatcgactaatgcgggaagcaacgattccatgccttcgacaggaatggcgttggcaatggattcaagcatgtcttcggcgtttggaatggagccgatcagggatttcgcacgcacgcgcaccttttcggtcagctgcagctcacggcatggcgtggcccagaccatcggaatgtcactgccatacgtacgctggtcggatgcatggaattccttgatggtatcgatttcgtcaccgaagaattcgatacgaaccggatgcggcaatgttggaggaaacacgtcgataatgccgcctcgcactgcgaattcaccacgatccatcaccaagtcgactcgagtatacgcattctccaccagtcgatgcgacgcctcatcgagcgccaactcctcaccttgggagaacaccagcggctccacatcccccaagcccgcaaccacaggctgaatcagggaacgcaccggcatgacgagaatcctgatggggccaaacagcttgcttccctcttgagggtgcatcagtctgcggaacaccgccatacggctcgccacggtatcggcgcgaggcgaaagacgttcgtgcggcaaggtttcccacgcttcaagctgtgccacatcgtttggatcgccggaataccacgaacgaatcgcctcaaccatttcctcggcctcgcgcccggaagccaccacaagcacaaccggtcgtgttcccgctgccccggcagcgagcgccggacgcaatccttcgggaacgccaacggtgatgctggggtctatgtcggattccggcacttcgatctcatcggaaatcagcgcacgaaaatcctcatcagtttcgagtacgtcgagaatgccagccagcgaacctgacgtcggcagttgcaccggttcagcggccattgaactgctcctgagccttggcgaggccgttgaagatgatggtttccgccgcgtcggcaccgtcggcaaggaattccggaagctgcttgcgctgatccggaccgaatccgcccagcacccaattcaccgtgttgtcgtgggcgtgggcgccgcgttgcgcatgaccgactcccatgcgcactcgggcatactttggcgttcccaaggcacgatcaattgatttgatgccgttatggccgcctgcggagccgcctgccttgactttgatacgtccgaaatcaagatccatgtcgtcgtgaatcaccacaatatggtctggttcaatctgatagtaggcactgatggaagccaacgcattacctgactcgttcatgtaggtgagcggctttgccaggaagaatttgacgttacggccagacaggttcatcacgcctttgccgagcatggcaagccctttatggtcggaaaagttgaccgaccaacgttcggccaacagatcggccgccataaatcccatattgtgacgggtgccttcgtatttggatcccggattgccaagtcctgcgatcaaccagaaatcagatgccattgaaatcgttccattcattcatacatacgtttgtgcgcgttcatattgcgtcacattgtctcgtcttgataaccgcaaagattgtacttacaggtcgagataccagtaactcatgtcacgcatggtgccggtggaatcggtggcagcagttggcatgaggccaaactgtgtaaaaccgaaccgtttcatcagtgcgatcgaaccggcattgtctgcgaaaataatgccgcatgccttacgcatattacgctttcgacattcttcaaccagtttggtgagtgtgtatgtaccgactcccctgccctgccattgcggatcgatataataggcgagatcggtgacgccgtcgtatcctgcgcgatcgtagaaaacggaaagcgcgctgaatccaatgatccgcctctctccgtcatcatctaccgtttccgtaacgaacaccgcatacggatcatgatgcgattcaacccatgctttgcgctgttcgtatgtgcgtggagttatatcggccgatgatccacctcgtatgactgcagcgttgtaaatgtcggtgattgcttgaatgtcgtcttgcgtcgcgatgcggtaggaatactcgatcatgtttttgagcataccgggcatatgcagaaggcggaagaccggttccccatatggaaccagtctcccgccttatgcaaacagcaatcgtacggaacttgtgcggaaactactgctcgagttcgagcgccttgttcaacgcttcctgaagtttcttctgcgcctcgccataagcggaccaatcgcccttcttcatggccgcgtcggaatccttcattgcctgggaagcgtcgttaagcgcgctcttcagaccgttgctcatcgtgccggagctactaccggtattgccggaactgctgtcattgcccgagtctgttccagatgacgaatccgtgccatcggttccggaagaaccatcggtggaggcatcgccgttggtatcggacgtatcagtcttgccactggtcgagccgtcgacgttttcagcatcgccagcggatgcaccggagttgccgccgaacacctgatcgagcgcttcgtccaacgtgttggcgaatccgacctggtcgccgaaggccaccaacaccttcttcaacagcgggaaactggtggaaccggaagacttgacgtacaccggctgcacgtacaccaatccgccgccgagcggcagtgtaagcagattgcctcgctgcacattggtggaaccggattcaagcaaattaagttccttcgacacgtcggccgacgcattgaagttgttctgtgcctgaccggggcctggcacattggaatccttcggcaactcctgcaatcgaagcgtgccatagttcgcgccgatcttgcctttttcgtggcccgcatcggaatcgacagacaggaatcccgtcaaaatctctcgagttgacgtgcctgcgggaatatacgacgacgtcaacgagaacaccggttcgttggatccaccggtctgcagcgtcaaatagtacggcggctgcagaatgtcgcgttcctgagcctgctgggattcggtcggatcgaccggagtctgccagaaatcctcaccggagaagaactggctggcgctcgacacatggtacttggtcaacagttctcgctgcaccttgaacaggctttccgggtaacgcaggtggctcatcagatcgccggaaatctccgacaactggtggtactggccggggaagatcttctgccatgccttgatcaccggatcggattcgtcccacacgtacaggtccacggaaccgtcatacgcatcgacggtggccttcacggagttgcgaatgtagttggcgttcttcgaagccagctcactcaccgtggccgaagattccgtagtggaatccttggaggcttcgcccagatcggtcatctgcgaatacgggtaggcgtcagacgtggtgtagccatcgacgatccacttgacacgaccatccacgaccgccgggtacacacggccgtcaagcgtcaggtatggcgcgaccttggccacacgctccttcggggaacgatcgtagaggatctgcgattcggagttcacacggttagagaacagaatctggtcggagccgaaacggatggcatacagcagtcgggagaagatattaccgatcttcgggccgccattgccaccgaacgtgttggtggcgccttcggaaccggtcgggtaatcgaactcccaagactgcgtaccttccggagcgcccacgatcgaatattcggaagcgttcggcgagaagtagatacgcggctcgtactgttcggattcggtgagcttgccttgggttggaatacccgcctcaaagaacttcggctggccgtcggccgtcaccttgttgccgtaggcggccaccacaccatagccgtgcgtgtatacggtatggtcgttgacccagttacgattgtcaagaccggcaaggtcaagttctcgtgctgcgatcaccgtatcttggctcacaccgtcgacctcatacttgtcgacggcaagagtatcggcaaacgtgtaatactgcttggattgctgcagctgcttgaatgtcggggaaacgatctgcggatcgagcagtcggatctgcgcggtcgattccgcggaatcagccaacgcaccagcctcgccttccgtagtggcctgatactgttcggtcttcacattgttcagaccgtatgcttcacgggtggcgtcgatattacgctggatataggtagattccatttcctgcgcgttcggattcacacggaaacgctgcagcagcatcggccatgccacggtaagcaccaagctcaccacaatggcggatgcgatggccacggtcggcaccttccacgctttaagcgcttcggaagcacgcaccgcaatcggagcctggccttccaacgcatgcgacttcatgatccacacgccgagaatcacaccgagaatgacggtgatggcagccatgatgaaggtgacgggaatcgtggcgttgaccgtggtatacgtggcaccggtgatgcggctaccctcctgcgtgaggtgggagaacacgccaagcacctgattcgtcgcccatgcgaacatgttgagcatcagccagatgccgatctgtctacgcgcacgcttggtgatgtggaacagtccacgaccatgcactggcatggtgattcggatgccgcccatcatcacatgcgtgacgatggagaagatgatgccggcaagcagcagcaacgacactgccgacatgatcagcttcaagccaggcaatacgaacacatagaaaccattgtcgatgccgaattgcgggtcggtggtgccgaaactctgcgcgttgaacatcagcaggatttcagaccaattcgcattaaactgcgatccgaacatcaagccgacgatcaatgaaatcaccacagccacacgacgtgcactctttgagctcacgcccttgcccacttcgatggtgtcgccgttaatacgaatcgtggaaccatcggcagcatcggggcgagcccagatcgccagcgacgcggacaggaatccgaccgcggcgatcagcagcgcatacgccacccacaggcctaccctggtacccaactgcgtccaaatcacgctttggaagccaagctgcgcataccacatgacgtcggtgatgaactgcgccaagccaaagaacaggccgatgatgatggcaagcgccagcaccacaccgattagaatcttgttgccgttcgacgatttgcgcggacggttcggctggcgtgtgatacgcggaccggacggacctcttggaggcatgttcgccgaagaccgggcggtgttatcaccatcggtttcgacattgagaatgatgggatcatcgttgccggatttattggcacgctgcccttgggagcggttcggaccgctttctgggtcgaacatgggaccaaacatatcaaaaaaagacatactaatagcctatcgacaggcacggaacggctttatgccgctagcctaatgtttacgcaattcacgaacacgaatccacccgttcttttcttatgcgatcgtattcgccatcaccggcatgtgatagataatgacactatgaggagagttcacgttcatttcgctcgttgtgctgccgcactgtgcgccatcgcactgccgctatcgttcgctgggtgttcatccagcgcgagtttgaatgctggctccaaccaatccgagcaatccaattcgcagcagtccgatgcatcacatgatgcgcttgacaaatccaacgtgccaagcgtggtggacgactcgccgcatggcagagccgtggctgcagtcaatgccatgagtcttgcagagcgcgtcggtcagctcgtcatggcacccctgtatgcgggatccgatccttcgacattgcaggatcttatcgtgaaccagcatgtcggatcggtgttgatcatcggcaattggaattcgggaacggctggcgtcgccgcagccacatccgcattgcaatcgtatgcgccggccaataatcagctgttgatgaccactgatcaggaaggtggtttggtgcagcatcttcaaggcgctggtttcgaccagatgccttccgccaccaatcagggttcaatgtcgaccaaccagctacggcaatcggctgccgtatggggttcccaactcaagtcggccggcatcaatgttgatttggcgccggtggtgggcacggtaacggtagatagggcttccaatggcccgatcggcgcactgtatcgtgattttggtcttgatgcggacggcaatgccgaccatgccaaggcgttcattcagggcatggcggattcgggtgtaggcagcgccatcaagcactatcctggtttgggttcggtgacgggcaacaccgatttcaccgccgacggcattcttgataccaccactacgttggacggtgcggaaatcggcgcgttcaacagtacgttggaggcgaacccttccatggtgatgatgtcgcttgccacctatcaggctattgatccgaataatcccgccgtgttctccagcgctttggtaacggattatttgcgcaatacggtcggattccaaggtgtcatcacttcggattctttgtccgccactgcgttgggtggcattcagccgagtgatttgggtgtgcgattggttgaggccggcggtgatcttgcctgcattggcgctttcgattatgttcagcaggttttggatggtttgaacgcaaaagccgcggctgattccgcttttgcagacaaagtaacgcagtccgcgattcgtgtgatgacattgaaatacagcatgggactcgcttcttgattgcgaaatattgattgcggaacatgcaatcgaatatcttcggtataggaataatcgcaagcaagcaacataaatataagaacaacaatccccgtcttccgaaatgaaagacggggattgtttatgtatggccgttagtttcagcaacagcaactggtgttgggatgcttgcgatcgtattcctctcgcatgcgccagtattcgcgttcggtcagcggggtttcgcagggatgttcgcttgcgaaatgctccagatagtggtcgtatttcgcttctccgctgaattcgcgcacataccagacgaatccggccttggctttcaataatgcggaccagattcgtctgaccatggtggtgaatccctgcatcaggctgcggcctgttccttctgcgccagctcatagctcttggccgcgtattcgcgctgcaccttcttttcgagcttggtggcgatcaggctggacggtgcgaaccattcggattccacgaacggctcctcagacgtggtttccacaccgaacttgcccttggcaagaatcttcacggtctggtagatgccgacgaccaggaagattcccatcatgaccatgaagaacacggagagcacgccgtcaaggtacgcattggagagtgcggccttggcgttgaccaacgcttcgccttccaaagtgccaccatcgatcagcgtctgatacttggaagcggtggcgaagtaactgatcggtccgacgatcttctggaagtcggcggtgaaggtcacggccacatcccaaacgagaggaacaacaggaatccacaggtacttcttatagccaagcttggccacgcaaacggtgaccagcatgaagcatgcggcggcaagcagctggttggaaataccgaaaataggcatcatggcgttgataccaccattcgtatcgcacacgccgacccacagcaggccaccccacagggcggttgcgatcagtgtggtgatgatgttgcccggtttccacgtcggatcagcgaacttcttcagcttgcgcacgttgcccagcaactcaccaatctgataacgggccacgcgggtgccgttgtcaacggtggtgaggatgaacaacgcttcgaacatgatggcgaagtggtaccagaaggccatggagtcatgaccgccgaggtaggacttgaggaagttggccatacccatagcgaacgtggtggcgccgccagtgcgggaaacgatggtgttctcgccaatgtcggaagcggcctgcttcaaagcgtcggcgccttcgtaggtcttggcattgccgttctcgtcgacagaatcccaagtgaccttcatctggttgccttcaatgtcggaaaccttcatcgaatccacggccttgaccgcggcctcagcctgctcgtcaggagtggaagtggcggtcagggtcacgccggaagcggtggagatctgcgaggcggacatgttcgtggagaagtagacgccctgggaaatggtgatggctgcaatcagtgcgatcacggcggtgaaggattcaaccagcatggagccgtagccgatcatgcggatctggttttccttctccacagccttcggggtcaggccggagctcactgcgccgtggaagccggaaagagcgccgcacgcgatggtgatgaacaggaacgggaacaggttacctgcgaaggtcggtcccgtggaggtggacgcgaattcagtcagagccggcatctgcacggacggattggcgatgagaatgccaagcacgagcagcacaagcgtgccgatcttcatcagcgtggacaggtagtcacgcggggtgacgagcagccagtgcggcaacgcggcggcggcgaaggagtagatcaccagtgcgataaccagttccttggcgttcaacgtgaacacgtcggcgattgccggaacgctggagatccaaccgccagcgatgatgtcgatcacgagcagcacgaagccgagcaccgtggtttcgataacgctacgatgcaggaaacgctggaagcagcccatgatcaaggcgatcggaatggtcataccaatagagaacacggcccacggcgaggaagccatggccttgatggccacgagcgcaaggaatgccatggcgatggcggtcatcacgatcaggaagatcgacaggatagtgccgccgaacttgcccatttcgtcggttgccatctgaccgaaggaacggccgcgacgcttggcggagatccacagcatgagcatatcctgcacggcgccggcgaaaatcacaccgagaatgatccacatcacggacggcagataacccatttgggcggccagaataggaccaacaagcgggcccgcaccggaaatgccggcgaaatgctggccgaacagcacgcgacggtcggcacgttcgaagttggcgccgtcatgcacgcgctcggccggcgtcgcgttcgcatcgtcggtacgcatgatcttgatctgaatataatacgcgtagaaacggtaagcgatcgcgtaggagcacaatgccacaaccacgaaccagatggcgctgatctgctcgccacgggaaaccgccagaatagcccaaccaatagcgcacacaatggcgatgacggcccacagcagggccttcggccacgtccacaccatcttcggcttcacaccgacagggagccccttcgaattgcggatgacgcgttccgcttcctcaggcgtgtaatcatccttgaactccagtttgccgggcgctggaaccgcggcattggcagtgcttgctgcactagtcatattgttctctctcgttagatataactcttctatacagccagagccgctcaacacagctccttattggctaaagaaaaagagtaggcgcgtcaatcgcatcaacgcatttcttctcacgatatgggatatcagcaataacaactgtggaaaatccctataaaactcacttcagatttgggcaatcctacaaaacagacaatcatgcaaaaacaagctgaagtaatgccatatacacgacgatgccgccggcgatcgagagcagcatgttgcgtttccatacgtgcagcacgacgatcgcggcgatggcgatcgcttcgggaatgccgtggcttccagcaaaaggattgacgtttttcagcgaatacaccaccagcagtccggtcatagcatacggaagcacgttgccaagatagtcgatgatgtgcggcggtttctttggctcgggaaagagcacgaacggcagaaaacgggtgatgatggtgccaagcaccgccatcagtacagtgacgacgccctgccatgtggtcatgatcatgaccgcacctcccctacttcgttacgatccgcagcggattcgaccaccatcagcatcatcacgtttcccaacatcatcaggtttcaaatcatccaaatacggacgcaacataatgaacatcaccagcatggcaatcaacgacgggatcatgaaattgtcagcaccgaacagcgccatgcaaatcaccggcaccacagtgcccgtcaacgccgccatatggcttttgcgtttcgttgtcaactattgatccacgaaaataaccacaaacaatgcggtcatcacgaaatccaaaccggtggtgtcgaacgtcaatcgcccgccgacaatgcctccgagcgtcgctccagccacccaggaaacctgattcagcagcgacacgaagaaatagaaccagccgcggtcaacatccgccggtatttgcgcgccgttgttgaccgcgaacgtctcatcacacatggcgtaaatcaaatacggttttttcgcccccatgttcttgaaacgccccagcatggacagtccgtaaaacaggtgccttgttcccatcatcagcgccaacataagcgtggcgaacggattgaatgcggaaaccagcagattcaccgtaacgaattccatggaaccggtgtagatgaatgcgctcatgcacaacggccacaggaacgaaaacccgcgggttcccataagcactccgtacgacatggccagaaagaagaagctgatgcaaatcggcagcactctggggaacgcggctttgaacgcacgcgtcttcactcccccattccgctggctcatccgcattcctccctgccatacgtggcaagcccgttcgcgaccacaatgccttgtaaccacccaattgtctaatcgttcaattcatggtaccgacagtcatgtttcgcaaacacccgcacgcatatcgacattgcttataacgcgttccatcgctcatccgcttcgcccgccagcgaaacatgggcatgcgtttgacttcaagtacttgaactttctatcttggcaacagaacgttttcaaggagagttatcagtgagtgacatgcacgaggttcgtcaggcgttactgaccggcgaacgcgccgaattccaagcatcaggcaagcgatatatcgacacgattttcgatgatggcgaatcaccgttgaagcatgcgcatgatattgagcttaagtcgagttcgttcaaatggaagtatccgctgtggtattgctcggatattttggcaaaggattgcacatggttcgagatggcacgcgcgggcgtgtggtatacgaataccattcgtgttgaggattgcacgtttgaagcgccgaagaatttccgccggtgccatgatgttgcgttgaggaatgttgatttcgtcaatgccgaggaaacattatgggcttgttcgaacgtttcactggaaaatgtgagcgctcgtggcgattatctggcgatgaattgttccgatattaaagcctataatctgcgtttggttggcaattatccatttgatggcgcacgtaatattgaaatcacaaattctcgattgatttccaaggattgcttctggaattgcgagaatgtgacagtacgtgattcattcatttccggcgagtatttggcttggaattcccgtaatgtcacgtttgagaactgtacgatcgaaagtctgcagggtttgtgctatgtggataatctcgtattacgtaattgccgtctaatcaatacgacgcttgctttcgaatattcgaatgtggatgccgatattcacagcactatcgatagtgtattcaatccttcgtccggcacgattcgtgcggctgtcatcaaggaattgactcttgacccaacgaagattgatccgaacaaggtgacgataattaccgaaaacaagtaaacgtcaccgtcgatcaaaaagtatttataatagttgagggtctgcaatttaacttgcagaccctcaattgttttatatcacccaacaatcggtgttgtaatcaaatactgatcacagattgtcggtgtcgatggtgatggtgaccggaccatcgttgatcaggccgacgcgcatgtgcgttccaaagcggccttcgcgtactggcacgccgccagaacgcagcgcctcgttgaatttgatccacgtgatgctggcatgttccggtttacctgctttgacgaagctggggcggttgcctttcctcacgtcggcaaacagcgtaaactgcgaaatggagaggatttcgccgccgatgtctttgatggaacggttcattttgccctgttcgtcttcgaaaacgcgcaggttgaggattttgtgggccagccaagaaagctgttcctcgccatcctcatcactcacgccgaccagcagcatgaagcccggtccgatctgctgcggttcgaaggtggggtcgatggtgcccagttcgttgacaacgtcaacgctggcttgactcactcgttgcactactactttcataaccccaccttaccgcgcgatcagtttcgccttggtatcggccggcttcagtagaacttttcgccgttgagctgctggcccaccaaaaccattcagcagatcgtccctgcctcatgtttgtcagtgtgtgctatgcgttgatgccgcgcgtcgcacagcgaccgaagccagcaaaccgatgagcagcatgcagcctgccaccaaaagtgtccaacggttgccctcaatgaacccggaagtcatcgcatcggcgattttcggcgcttcgtcaccgaattgggccgccgatccatctccgctgcggaacgagccaattacaccgccagccgagctgctgaccgccttggccagtccatcgccgactttagcgggcagtccaagggattcaagtcgtgccggcaacgtcccattgatggccatggtcaatgccgcgcctgagatggccgagcccatggcggtgccaagctgacggacggtggactgggtggccgatccttcaccggactggggaatcggcacttcggacagcaccacgctggtcagctgcgcggaagcgagccctaagccgcagccgtaggcggtcaaaggaagaagctgccaccacactgcgaattccaccggcatgaggactgcaatcacggctaccgcgatgatctcaatcaccaagccaagttggaccacgccgaccggagtgaatttggaggccagcatatgtgcctgactaccggcgataatagagcccaatcccatcacggccagcatcgcaccggcctgtagcgtgtcgagtccgcgcgcgttgatgagatacagcggaagcgcgaacaccagcgcgaactcgccggcggcgatggccgcagccgacagattgccccacgagaatgtcttgatgcggaacagggtcatgtccagcatcaccggtcgcccggctttgcctcgtgcaagttctacggttatgaagacgaccagcaggagcataccggcgaccagacaaatcggcaccggcgacagccagccgtggttccatgtcagaccacccatcttcaactgagtggaagtctgcttccaccagccgtaggtctcgccttcgataagtccgaatacgagcagggcagaagtcagtgcggacagcaccacgcctggaatgtccacatcaatgctttggaatcgaatggtagaagaagcggttgaggaagtgatgttcgaggtatggccaccggtctttggcaccaaaggaatggttgccacaaaaatgatgatgcctagcggaaggttcaccaggaaaatccatcgccaccccaaggtctcggtaagcacgccgccgagcaacggtccgagagcggcggctgaactcattaccgcgccccagactccgaaagccgcagcgcgatacttgccacggaacgtggcggacaccgtggacagggtgttcggcatgatcatcgcgccaccgatgccctgcaacgcgcgagcggtgagcagcatgccagcgtcctgcgatgtggcggcgagcaatgaacttgccacgaaaatcacagttccaatttggaataccagtttgcgtcctttggcgtcgccaagcttgccgaagggaagcagcagcgcggcgagtacgatgttgtacagtgatgtgacccactgggcgtcggtcaggtcgatgccgatatcgtcgataatggtggggatggagacgttgacgattgagctgtccagcacaatcatggccagtcccaaagccaacacccatagcgcgccccatggcggagtttgttccggatgaggtgacgtggacatcgtggaagacgatggcatatcgggctgaagctgatgttggaacttagatggctgttccatgatgccgtttcctctcatagtcataatgcagggtctgtcatgtttgactgccgccatactacacgcatggcgttgcgcgctcactcatccaaacgattcagccttgatgtttagccatgggagtaatccatgacaggcagagacttaggtgacgtgcccgtcacggaaccaacggaacccggctatcgggattccatagtcccggttcttgcatcacaatctggaggcggcacctttgtcgataagccacagcagttcctcaccatcggcataagagcttggcgcatgcggattgttgcgttgcgcgaatgctgcagcaaccgcatccgccttgcgtacttcagatgtgaacacccacgtgtgcttcgatcgtgcgatcatcggcacggtcagcgtcaggcgcagtggcggcggcttcggtgaatcgcgcacaccggcgacaagcacatgcggatcgtcgatctccgactcgccatggtcggggaacagggatgcgaaatgcgcgtccggtcccataccgaacatggcgatgtccaaagctggattctcacccaactgttcaatgagttcacgctggtattgcgcggcggcttcagccagcaccgcatcagtctgttcgggtgaggctgccgcgacgccttccaagttacgctcatcggacggcatcgcatgaatgttgcctgccggcatacggccgtcggcaaccagtttgccataccatgcctcacgcgcctgcttggcgttgcgatcgtcgtcatcggcggccacgaatcgttcgtcgccccaccatacgtgcacgcggctccagtccacggcatcgttcaatgggctcgcgttcatggcgtcgaacactcgattgccgtcggttccaccggtcacggcaatgtcaacgcgggtgcgattcggttccgacagaagatcggtgatggtcaacagcgtacgtgcggccacggcttcagccagaatctgaggattgggatatacaacggtggtgcgttctgccatatgcttttcctgcattgttcctttattgtttcggagaatcgattcagtgcttcgaattgataagatcccagccttgagtcacgacttccgcatagatctcgtccggatagagtcgacccaattcctcactcaagcattcctcgatggttcgtgcgggaacgctcatggtttgcggggactgccctggaacgttcaatacggcgatgccatcgtcggtggatgggcgttccaaactcagcacgccatcggaacgggtcagatacacgccggtcacggcggttgcattcggatcgtcttccaccacaacaggcacgttcagacgaagacgaagccatgcggccagcagattcaacggcaggaagttctttggtccggtcacacgcacgccgcttactggaagatgcggcggctggtcaagcatcgaagcgagcattgcgcgccaaacagtcaagcgagtccacgacatgtccacattcttcgacgaccagttgcggcgcagatcatccatggtccgcatcggattcgaggaatgcatggcatcggtgatacggctgcgcgccatggaacccagcaaatcgttcgataggttcgcgggggcttcgtttggccaccaagccaccaccggagcgtccggcaccaatagcggaatcaccaatgtatcagggtggtgaaccagcccaccaatcggacgcaacacgatgatttcgcccgcgccagcgtcggaaccgaatcgcacttccgcgtcgagaaaggtgtgcggcttgccatcatcggcagcggcatccaccctacgtgaattcggcgcgattgcgatcacacggcagggatgctcacggctggcgttgttcgccacggcgagatcatgctccagcgacgtctcattcgtggagatcagcagtgtgagcacgcgacccagagccgcttcgccacgctcctcgtgcaattcatcgattttcgccgaaatctcacgggtttcggtgttcttcatggtaatgatcacggcatcctccaacggtgtccatcgcgggccagcatttcaacggcttcctgagggccccacgttccggaacgatacggttgcggctggccaagcgtggaccagaactcttcgatcggatcgaggatctgccagctcaattccacttcgcgtgtggttgggaacagtggcggatcgcccagcaatacgtcaagaatcagacgttcataggcttccggagacgattcggtgaacgaacggccgtaaccgaagtccatcgacacgtcacggacctccatcgacgtgccacccggcaccttcgcgccgaaccgcatggtcacaccctcatcgggctgcacgcggatcacgatcgcattcttgccgagctccttcgttgcggtcgactcgaacggcagatgcggggcacgcttgaacaccacggcaatctccgtgacacgcttgcccaaacgtttgcccgtacgcaggtagaacggcacgccggcccaacggcgcgtatcgacatccagtcggatcgctgcgtaagtctctgtggttgaagccggattaatgcccttctcatccaaatagccgacaacctcatgagaaccctgccatccggcggcatactgtccgcgggccgtatgcgccgccagatccttcggcaagcgcactgcggacagcaccttcgtcttttcagccgtcagatcagcggcggagaaggagaccggctcctccatggccgtcaatgccatgagctgcagcaggtggttctggatgatgtcgcgtgcggcaccgatgccgtcatagtatccggcacgaccggccacgccgatatcctcggcgtgggtaatctgcacatggtcgacgtaattattgttccaaatcggctcatacatggcgttcgcgaaacgaagcgccagaatattctgcaccgtctccttaccgagataatgatcgatacggaacacactcgatgggtcgaacacctcggaaaccacacgatccagctccttagcgctggccagatcatgcccgaacggtttctcgatgatcacacgacgccaagcaccttccgacgatttcgccagaccgcaatcggccaactgtcgggaaacctgcgggaacgcgcgcggcggcaccgacatgtagaacgcatggttgcctcgtgtgccacgatcacggtcaagctcggcaacagtgttcgacaatcgttcgaacgccttcggatcatcgaacgtgccctgcacaaaacgaatgccgtcggcgagctgcgtccaggtcgcctccttaaatggcgtgcggcagtgcgcctgcacgttctccttcacgaaatccttgaaatgatcctcggtccaatcacgacgtgcaaaacccgtcaaaccgaagcttggcggcaataggccacgattagccagatcataaatggcgggaagcagcttcttgcgtgacagatcgccggtcacgccgaaaatcacaatactgcacgggcctgcaatacgtggaagtcgaagatcgcgcggatcgcgcagcggattcgtccactcttcaggcgtgccaagtacggatgaaacagtttcagtcatgtgcttcatagtatcgccaacacgtcacggacggcagtgaccatccgaaaacgtcctttccatattttgtgaaaacccacaaaaccagccgttttttagcggctgtgagcaatatcacaatcgatgatcaatgtattactctgccgaaaaatcatgcaacccggcgaacagacgattgaatccttcttgcatggtgcttcgcgggcaagccacgttgatgcgaatgaaatcatgcccgttgccgccatactcggcaccttcggagaacatcacctgatgattgcgcttgagatgttcgcacaacagagcggtatcgtgcgtcagtttcgaacaatcgacccacaacaagtaggtggcatggctttcaatcagggcgatgcgtcgttccggtgccgcggcagcattgtattcgttgatcatggctcgtgcttcggctttgttgcctgtcaagtatgcgcgcaattcctcaagccaaggctcgctctcgttgaaggcagcgagcgtggccgtcatggcgaaggcgttcggttcggccacttcgtccgtgttgagcgcacgccataccttatgcctcagcacgggatttggaatcattacggcagccgtgttaagaccggcgatattgaacgttttggtcggtgccatgcaggtcacggagttcattgcgcactgctcattcaccgaggcaaagggcacgtaatcatatcccggatcggtaagatcacaatgaatttcgtcgctgattacggtcacatgatggttccagcaaagctcacctatgcgtgcgagggtgtcgcgatcccagattcggcctacgggattgtgtggattgcacaggatcatcagcgtggtttgcggatcggccaacttggattccagatcggcccagttgatggagtaatgtccggaaccgtcgtattccaacggtgattcaagcacgcggcatccattattgataatcgaattgaagaaaatgttgtagaccggagtttggataagcacgttttcgtttgctgtggtgagttttcgtaccatgctggagattgccggcaccacgccggtgctgaatacgagcgattccgggtcgatatcaagattatgcctacggtgccaccagtcaacgtatgcctgattccatgcaggagggacgatggaatatccgaaaataccgtggtcaagacgctgttgcagtgcggctcgaatctgtggagcggtttgaaattccatatccgccacccacatgggcaacgcatctcctgcctcttcccacttgagcgaatacgtgccggatcggtctacgggagtgtcgaaatcgtaagtcatgccatcaaacttaagaacttcaagtggacgaagtcaaatgcaagctgtgaatgatcccggtttcacgacatgcattgtaatgactttgtcggtcgggcagccctgttgtatgagttcaaaaacatggcctttcggacattccatactggttctttcacattcatgctgacgcacccattgtgaacgaaccaaaccaaaataactaatgtaaatgatgtattactttccatgcgagaagtgcatgaaaactgtcaatcagccagcccagtcgaaaagttccggaccattgcgttgcaaatggcgttattgcatgcgtattgactaccatgaacatcaatacttaagaaaggtggttttatggcatatgcgttgataacgggggcttcgagtggcattgggcgtgagatggcggcattgtttgcggccgacaggcatgatctcatcattacggcacgcagtcaaggcaaacttgatgacgtgaagcgcacgctggaacatcgctatggcgtgcatgtggagacggttgcgcttgatctaagcgagtctgacgcaccgcaacagttgcatgattacacagtttcgcaaggttttgaagtggatcatctcgtcaataacgccggttttgcggattggacgggttttctcgacgccgactggcatcgccagcatgagatgatgcagctcaacatggccgcgttggttgaacttacgtaccgttatggtcgtgatatgcgcgagcagggtcacggacgcatattgaacatctcttctgttgcttcaatgatggcaggcccatatatggcgatatatttcgcgtcgaaagcgttcgtacgatcgctttcggaagcggtgtcgtacgaattgcgagataccggtgtgagtgtgacctgcgtatgccccgggccgacatccacagggttcgccaaggccgcgaacatgcgtggcatgaatttcttcacgctgaccaaaccggccaccgcctaccagcttgccacctacgcgtatcggaagatgaagcaggggcgcacgcttgcctaccacggctacctcaccaaagccggagccgcagcggaacgactactcccccgcgctctgacgcgacgggtcgccgcaatcatgaatggcggcaacccacgcaaccagcatcgcgaataattcaggaggcaactcaacgagtttcccttgcggctgatcatatttgccgcaacacaaagagccgcacacttttcataaagcgtgaggctcttttcatctgttaatccgctagattcgttgcagaaatacgtctatcaggcttcgatttcctcgcggcccggctcggcccacagcgtgtggaatgcgcccggctgatccacacgctggtaggtgtgagcgccgaaatagtcgcgctgaccctggatcagggcggcgggcaggcgcttggaacgcagtccgtcgaagtacgacagcgaggaagcgaacgccggagtaggcaaaccgttgacggcggcctgagccaccacgttacgccaagacttttcggcggtttcgatggcgttcttgaagtacggagcgaacagcagcgacacgttggcttcacctgattcgaacgcttcggaaatacggttgaggaacttcgcacggatgatgcagccgccacgccagatgcgtgccacggcagccagatcgatatcccagccatattcttcggcagcagtggtaatctcgttgaagccctgggcgtaggcgacgatcttggaagcgtagagtgcctgacgaatgtcttcgatgaaggccttcttctcatcgtcggtgaggttcaggttgccgtcagggccattgaagccctgcttggcggcttcctcacgcagatcagcttcgaaggaaagaccacgggcgaacacggcttcggcgatgccggtgaccggtacggccagagacagtgcggtctgcacggtccacgtgccggtgcccttcatgccagcatggtcgacgatcacgtcaaccagcggcttaccggtcttcttgtcggcctgatgcagcacttcggcggtgatttcgatcagataggagtcgagttcggtcttgttccactcttcgaacacgtcaccgatctcagccggagtcatgccaaggccacgacgcatcagatcgtagctttcagcgatgagctgcatgtcggagtactcaataccgttgtgcaccatcttgacgaagtggccagcaccattgagaccgatatgggtgacgcacggttcgccttcggccttggccgcgatggattcaaaaatcggcttcagagtcttccaggattcttcggagccacccggcatcatggaaggtccaagcagagcgccttcctcaccgccggacacaccgcatccgacgaaatgcagtccgcgagcgctgatttccttctcgcggcgaatggtgtccgggaagtaggcgttgcctgcgtcgacgatgatgtcgcccggctccatcaggtcggcgagcgcgttgatcatggcgtcggtcggctctcccgccttgaccatgatgatggcggtacgcggcttgacgaggctgtccacgaactcttcgagggtttttgccgggaagaattcgccttcgttgccgtgttcgttcatgagcttttcggtacggccgtaagagcggttgaacactgccaccttgttgccgtggtgtgcgaggttacgtgcgaggctaccgcccattgcggcaagaccgactacgccgacgtttgcttcagctgacatgctggccccttccatcaggaaaagtagtactttatgaaccgttctttagtgtagacccgagctaccccagaaccatggaccgtctcaagtctgacatcatgtcaatcacgcggcgcaatcgtacgtacgaaacgcatggcttcggcaggtgtgagcgacggcacgtaggcttgcgccacagcaagcgatatttgcggcagtttggccgcgtcgggatagcagatatacactttctcttcgtcggggtggaatttcagtttgaaacggaacagtgagtggaatccgtatgctggttccatgatgtctgcgaccatttgcagtgcatgacgtaacacttcgctttcctcgtgttcgcctttgttggatcccataccggccagtggcgccgccgataggctcatgaattccgcattgccttcgtcgcgcagtcgttcagccatgcgtgcaatcaggaattccatgatgccgttgacgctgtcggtgcggtgcctcatgaagtcaagcgtccaaccgatgattgtgccgtcgcgataggtgggcagccagctggttacgccaaggactttgccgttgccgtcgaccgcgtagagcaggcgtacccgggagtcgatcagctcgtcgacgccacccaaggtgaatcccatttccggcagggcctttttgccggcccactgtgcggaaatctcacgaatctgcgtttgtacggagaagggtgcctccttgaaagtggtgagcacgtcggtgatgccgtctcgtttggctttgttgatggcggtgcgcacgtcctgccatttcttacctcgggtttgccattcgttgggattgacgatcatttccgtgccgacgtcaagtgagtcccatccggctttggcgagttcggctcgctgtggctcgtgtacgctgtaaaacacgggcgtccaggaatgttgtgtgcagaatgttgcgaaatcagtgagatcttccgtatattcgtttggatctccgaatggtcctgtcaccgtcaatgcgataccgtacgacactcgataggcgattgcggaacgtccggttgcagaaaaccaataatcattgccttcccaagttgccatgaatgacatggattcgccgccaagcggaataatcgcgtcaacacgatggcgcgaagcgtcattcaccatggaacgatcccgcaaacactcccaaacacacagcagagcgataatccaaaacgccggaccgacgcactgatataccagcaaggagatttgcccgacaggtacaaactcaggttcgataccactcagcaatccgatcggcaacaatcgttgcacataatcggcaagcaatgcaatcaattgcgggctttcgttgaaatcctcgggagaggcaagcccatacccgacatacatcaatcccaacaacagaaaagctgacaatgcacctgccacagcacgcaacataatctcacttctagtgcgaatcgtaaaacactgacggaacgcaatgacgataacgataaaaatcaacggcaatgccatagtggaaaacatcgcgtgaaaagcaccgtgacgagccaacgcaggcaacgtatcagcctgcgaatcgccaacatattgcagcggaagcaccacataaaacagcatcgcaagtaccaccgtgcacgcattgaacagcacacttaacacggcggcaatgcggcgtccgcgatacagaccccatgcgatcaacagcagcatcagcgtcggcatcaacgacaccagccagtttccgggcatggtgaatcgcatcatacgatattgcgcgaaacagttggcatgcgaggaaccgttgaggcaatccaacacttgttccgtgtcgaattccgtggaacctgtcagcaagccgaacatggagagcaatccgaatgattgtcttgaggaaacggcaaccagcgaaccgaccgcctgtacgccggcagccataccaatcagcctgcgcatctcatacaaggcaccatgcctatacacatcaccttgactctcggaagccatcaaatagccaagcacatggccaagcaacgccgacgccagcaaacagtaatcgccggcttcaccacgatacaggaacaggatcagcaccacgctatagccgatcacacgaatacgccgacgccacagcatggcggtgaacgcgctggcacacatcagcgtgcccaccacaacaaccagcggccccaaaatcgcaccatcatgcgaaatcgcatgccattgcggacttttgcctgcgaacagcgagcataatcccataccgagcgctatgccgccaagcgtggtgatcagcgacacccatgccgtcttcgcctttccaatcaccgtttcgcataagccgaatgcgatgagtatcagtggaatgtcgatcagcagacgacccaactgaggcaccgacagcagtgaaatcggcgcggtataccagcgcccatgcgcgagcgcgtcaaaactcacgcgcgacaattgcggcggaaattgcgtatgtctaatgccgcatacgagctgcatgccgacattgaacagcgtgatgaacagcacaaaccccaaggtcatgcgatgctcacgaatccagtcggcaagatcggccataagcgcacgaaagccaaataatggtttcactgttgattcctgcgattgcgtcataatacagtacttccgttcgatgattcagattgaaatgcgtttgagattcggatagtcgaccaatttcggcttggcatcgctcagtcccgtgttgtagccgaatacggcaagtccgtaccgcaacgtgtcttgcacggcatgccagtcatgcgcattgtcaagcgattcgactgccgtaacatgcatgcccgcctgttgagcaaccggtgcgatgcgttcgacattgcgcacggactcgcgatcacgctcccctgcgccgataacaagcgtctggttcgaaggtgcatggttgcgaatggcgttgatggggatctgcttctcgtatgcggtgcgatcgccgtggaagaaccggctgatcatactgctttcactgccattggtcggtttgagctcgctgccggtgggaatgatggtaccgaacaaatccggatggttcgcaccgatctgcagcgaacatgtggccccctgtgaaaaacctgcgatcgcccagtcctgcgcttgctgtgccgccggaagattggctttcacccagtcgaccacgtctttcgtcaagtaggtcaacgcattgccgtacaccggcgaatccacgcatagggtgttatgcgaatcgtctcccaactggtcggccgcaataacaatgggtgcgagtccgccatgatgctgcgcgtaatcgtccatcatggtttgaatgccgcccgcggcaaacacgcgacccggagagcccggctggccgctcatcatcagtatgaccggcaacgccggcttgtgtttggctgtggcaagcgctgcaggcggcagatataccagcgcctttcgcgcttcgaaatgcgatgctgtggctggaatatttactttcctgacttcgccatgtgcgggaatattgctgacgctaccgtctgctttttcctgcttccattgcgtgacgctaatcaaatcgctgcgtttcgccattcccgtcaggtcggcttcacgataggtgtcttggccgagcagtgatccgatggtggcatattctccatacgcctgatcgatgccggtggcggcggaaagcaccgcgaataccgtcaatacaacggcgacggcacgcaacactcccctatgcggcaccgcatagcaaatcgcgaatccaatgatcgcgcaaccgcaaccggcccatgcgaccacatgcggccccagctcaacaccgaacaccacaaacacgtccgacagcaaccaggcaatcaccaatccggcaatgcctgcaataatcgcaatcactaccggacacacgactacggcaaacgtgcgtttgccaccgtcacgacttccggcaaccgtctcccatattgcagtacccagcagtatcgccgccagcactgcggttactgaaaacaacgttgccggaaaccagccatccaccaaacttatgttcatcaaccatgcacgcatgctcacttcttgctttcatattcttcatgtccaatgtgccagttgtagtccatgaaacgttggcacgacctcatccttgaggctgattttccttggaatatcgacgaaaaatactgtgagcaagctgaatggatgatgctcttaggcagcgtcttacctttgccgatcatcgatcatgccttgaacgcacgttccaatacccgccatacgcatggaacggaccccacgtcgggatcgccttcgaccaacagcgcattgggaagcatcagtcatgccggatcggtttgatactctgactgcggcacggtttcctccgatcgcgcttccttgcgcatgttccctgtacatgttccttgtacagcagacgcaatattcccatgcaatgtgattccagctaagaagacactacgaaacgcgtccaatgcatccgaccgacagccaagcggtatggtgttgcattatgcagtatgttttttcggcgtcgaatgtttcctgtgtcgtgccagtcgacggtgaacaacgcacgattttcagcggattatccgttgatgtgaagcatggtgagattgtggatttggtcggcccttccggatcgggcaagagtagtctgcttaccgctttcgcacgattgaatccgaatgcgaacggcaattttcagcttgaagggcgccctgccagcgaattcacaccgcagcagtggcgtagtcaggtggcgtatttgccgcagaagccggtattgatcggttcgagtgtggccgaggcgattcgtttaccgttcacattggctatccgtgcgggcgaaggcaagcaagaattcggcaggaaatggtcggccggtaagtctctcaaacccacagatctactgccggatgctcgcattcgagccacgcttgacgccattggctgcgcggatattgatttggggcgtgctccgcatgacttgtctggaggccaggccgcccgtgtgagtttggcgcgcaccttgcttacttcgccgaaagtgctgcttgccgatgaggttgatgccggtttggatgatgagaacgccgataaggtggcatccatcatggctcaggccgcagagcggggcatggcggtgattcgtattcgccatcgcccgccggatgggcgtgccacgcgcattctcacactggccaatggcgtattgcagagtgcgaatgctccgcacaccgcagcaaccaatgattccaatgatttcgcggcacagtccgattcggcgcaaggagtgcaggcatgagtggcaattattattccattgatatttggggtctgcttatcgcattggttatggtcgccgtggccgcaggcatttccgaagcgatgcgcatgggcattggcaagacactgctatggtcggcgtgccgtgcgttgctgcaattgtgcgccatgggtttcattatggagttcgtcatcaagtcgaacaatccatggctggtgctgttgctggtgatgttcatgctgatcgcggccgtgcaaatcaccctgtctcgtgccaaaggtgtgccgaaaggcttggccggtcccgtgtttttgagcttggtcatcaccatgctcattatgatttcgttggtcaccgaattgatcattcgcccgcaaccatggtatgcgccgcaattggtggtaccgttgaccggcatgctgctcggcaataccgtgtccgctttggcggttgggttgagccggttcttcgaaagcatgaaggaacgccgtgacgaagtggatacgctgctggcgttgggcgcgaccgcttgggaggccgcacgcccgtccatcgtctcgtcgattcgtttgggtttgctgccgactaccgcctcgctggcttccagcggcattgtgacggtgcctggcatgatggccggtcagatcatcgccggcggcaatcctatcgacgcggcgaaataccagttcctgattctcgccgccatcgccgcgttaacgcttctggccgacagtctcattatggtgatggcataccgtaagtgcttcactgcagacgatcaatacaatccgatcgcaggctgaacaacttttcatatagccaagcaattaatagacaatcagatttaacagaaaacggcgttcgccaagtgttcatataccatggcggacaccgttttctattgtttaccagctacgcgagctttgattttgcttttcagcgatcaacgcgtgcggaatggcgctttcctgatgttcgcatggcgatggcgtgactgccctgtatgcttgtcgtgacgttcgccacggccgccacgcttgacttccgtatgacggtcatagcgtttcgcatccgaggaacgttcgtcatgcttcttgcctttggaccgacgattatcgtcatactgacgttcggcacgggcttcagacttgcgctgcttcttgcttggcgcaccctgctttttcgcaagctgtccggacttcttctttcccagtttcctgcgattgtcggtattgccgtaatcgccgtcgttcctacgcttgttcgtcgtttcgcgctgctcgttgtcgctgcgctgctgctcatgcaggcgcgcatacttttcacgacgcttgctgttgcgcttttcctcgtgctgttcgcggcgttcctcttgaatttcaggatgttcccaacgatgttcacgcgcttcgaattcacgattgtcacgaccttcgaacttggcggcacggcgttccgcacggttcttcttcggctcgaacttcttcgcgctgtcgttacgctcctcacgctggtcgcgatcgcgacgatccttacgttcggacttaaacggcttaccgcccttgtctttgccgcgatccttgttacgcccgccggaacggtttgatctgccggaacgttcgccgtcggcactccccttgccgttcttcctacggcgcggatttcctgccggctgcgactgctcaagcgtccagccgaacaccggctcggccacttcgcctacgagttccaacacttccggcgaatcaggggtcacatcgatcggttcgaccgtcagtccggcctcacgcatcatgcgacgggtcctgcggcgctggttcggcagaatgatggtcaccacgtcaccggaatggccggctcgcgcggttcgtccggaacgatgcaggaaggatttcggatcttccggcggttcgacctgcaccacgagttccacaccggaaacgtcgatgcctcgcgcggccacatcggtggccaccataacgttcacatcgccggagttgaaggcggccagattgcggtcacgctggttctggctcagattgccgtgcaattcggccgcaggaatgccgttctgcgttaaatccttggcaagcttctgcgtctggaatttggtacgggtgaacagaatgcgacggcccttgccggaagcgagggtgcgcaccagctcgtgacggttgccctgcgtggttttgaacacatggtgggtcatctcgtcaacggtcgccgtcgcggaatcgacgctatgcaccttcggatcagacaggaaggtttccaccacttcgtccacgccatggtcgagcgtggcggagaacagcatgatctgcgcgtcgaacgaaatctggccgagcagtcgcttgactggcgggaggaagcccatatcggccatttcgtcggcctcatcaataaccgctacctcaaccttgtccaaggtgagcgcgccctgttcgatcaaatcctcaagacgacccgggcaggccaccacaatatcggcaccggcctgaaggtcacggatctggcgggcataacgcacaccgccgtacacggtggtggtgttgatgccgtagatctgggcgagcggcatgagcacatcgttgatctggttggcgagctcacgggtcggagcaagcaccagaccacgtggatgcggcacgaaatcgtcggcacgacgttcctcggcatgggcctgcttcacacgattgacctcgtggcggaactggctcatgttctcatactcgccggcatccacttcgcccaagcgagcgaccagcggaatcgaaaatgccagcgtcttgccggatccagtgcgaccacggccaagaatgtctcgcccagccaacgaatcgggaagcgtgtcggcctgaatcgggaaagcggttttcttgtcatcggccgcaagcacgcggaccagcggaccaggaacgccaagttcggcgaacgtcaacggacgttcctcttcctcgcccatcgcttcggaagcggctgcgagggtatcttcatcaaaaacggtatcgggcacaatggcctttcatgtcaaatattacgcacgttgcgcaaacctgataactgtagcctatgcccaatacttttgcttacgttccttcaatccttcatatccgttatattcacgccggattgcggttgatttcgatatcggtgacggtcagattcgctttgttgaccagattgaacagaatcacttcggccagctgatccgcacgcatgaaggtatgctgcttttcttctgaaacgtagtcatggctgtcacggtagaacggggtgtcgatgccacccggatagacacccacgattttcacactggtccccttgtatgcggcctgcaaactcttggtgtagcccttctcgccccacttggtggcacagtacacggattcgttggggttgcctcgcgttgccgcggtagacatgatgttggcgattttgagatcccgctcgccgtccgccttcagggtttccacgctccacagcaccatgcctttcagacctttcaggcacttgtccacatcggccgcctcgtatgcggtcggcactttgaacgaaggctgcccggcattgttgatcagcaaatcgatatgaccgattttcgcgattgcggcaacagagttcttcacgaacgattcgtcggaaatatcgcccacaaaagctctgtattcgtcggcagcaaaagtcttcgacaactccgcctgacgtacgccattgaaatcaataccggcaacgaaccatcccttggcgatcagctgtcgagccagctcatatcccaatccaagcgcggaaccggtgacgatggcgattttctttccgtctgcggtactcatatgatgaactccttcattcaaaaatggacacaaccccttttgcatcatcatacccattcaaccccacatgaagtcaaacgattgacgtaacacattcaacaccgttttcagcgagtccacatatttcgtatccccatgagccatagacccgtacaaccaaatttcagagatgccctatcgatgaagactccgacgtatgctttcatcttgaaacttctcaataatcgtcatatcctcatcgcatctctaatgccttgcacacgcgaaagctacacaggcgtacgcaaaaggcccttccggaacagggaacgtttgggaagggccttcagagcgatgcaaacgattattgcatcacaggatgtcggggtcgttcttgtcgatcgtgccggtggccttgccgatggccttcagaccgtggtaggcgacgagaatcacgatggtgccgatggcgatgccgttgaaggaaatgccattgaaagcgaacgcgaactggccgatggcgatgatcatggtgattgcggcaaccatgatgttcagcggcttgtcgaagttgaccttgttctcaacccaaatacgaataccgaccatgccgatcatgccgtacagcagggtggtcacgccaccgagcacgccagccggaatcgtgttgatgatggcaccgaacttcgggcacaggctcaacagcagtgcgaagccagccgcgcaccagtaggctgcggtggaatacaccttggtggctgccatcacgccgatgttctcaccgtacgtggtggtgccggaaccgccgccgaaaccggcgatggtggtgccaagaccgtcggcgaacagggcggtgccgatctggtcatcgtagtcgcggccggtcatctgggaaacggacttgacgtggccgacgttttcggcgacgagcacgagcaccaccggaacgaacatcggcagaatcgtgaagtcaacctgcggcaggtggaaagtcggcagaccaacccaagcggcatcgccgatggcggagaagtcaacctgaccacgaatgcaagcgtatgcgtaaccgatgatcacaccgatgagaatgttgagtcgaccaagcagacctttgaacagcaccgcaaccagcagcacggcaactaaagtcacgatagcggtgtcgggagcgaccttgaagttgttccacacgctcggagccaagttgaaaccgatgatggccacaatggcaccgttgacaaccggcggcatgatgatgtcgatccacttggcacccgcgaagtgcacgagtacaccgatcagagccagcagcaaaccagtgacgagaatgccgaaggatgcgacggcgatgcccttgttcgccgtggtgacggcggtgatcggggcaatgaagccgaaggacgaacccaagtagctcggcagcacgttcttgttgatcagcaggaacagtgcggtcgacatggccgtaaagaacagggtggtggacgggtcgaaaccagtcagaatcggcaccaggaacgtggcaccgaacatggcgatgacgtgctgcgcaccgatttcggcggtgcgcggccacgtcaggcgctcgtcaggctcaacgacttcgcccggcttcagcgtcttgccgtcaccgtggacctgccacgtgaacagattggacatgcgattgtctccttaactctcttgcgcggcaagcaaaaacgcgccgcgtgtcatagccattgtagtggggcgtggacacgggcgcgtttcgtacgcaagatgggggcatcaatcgtcgatatcggccaatccgatcatgcagtcaacagaccgacacacatcacaggtgacggtcaaccgcatgaacaacgtccaccaaatcgccattcgacagcactggacgcttgaattcacgccaatcttcgaccttcaccacccaacgaccttccgcaccgtcgaacaccggacgggcggtctgttcccaacggaaccgcttatacgtacgcccggtggccggatcgcgacgcgaataatggaagcacgtacaattagtgatcttccattcgtcggacgccgcacggtgcatgaattcctcgtcggacaagtcctccaaagtgagcataagcgccagcatgaggtcgccgtgactgaccatcaccacggattccgcgtccgacttgcggttcagggacgtgagcagattatgcacacggttttcggccacatcggcgatcgattcgcccgccggcggacgccaatacagcggatcagtgttcttgaacatccagttgcgcgcgtaattggttttgaaatcatctttcgtgatggtattgatctcaccccaggagcgttcgcgcagcacgcgtgtctcctcccatttcgccttaggcagggccatcgtggcagccgtctcacgcgtgcgcacgtacggcgagacgaggtaacggtcgaacaacggctgctgtgagaccagccagcggccgatgcagtccgcctgcttgcggccggtggccgtaagcctccacgaacggtcgggcacggtgacgttatcctgcgtatacagcgagttgtcaccctgttcaccggcactgataatcacgtttgcttcggattcgccatgtcgaatcacatacaaatcaaggggcattcccatattcgcttattcctttgctttcatccacatcctgcgcgcgtttctcgttctgccgttcattcggccggcgcgcatcatcattgaatactttcaccgtagtcgattcgaacgtatgccacacgcgaaaccacatcgatttcacgattggcacacccgaagttcgcgatgtcgttacgtccggttcaccgcatcgcccgcgacacgccgaggcgctactactccggccaaatgccgttctgcgaatacttggcgcggtactcccccggtgtcatgccgctatgttttttgaacactttcgaaaagtggctttgcgaccggtatgcgaggatctgtgcgatctcattgaagctgtattccgaatatttcagcatgttttcggcggcttccatacgtttgtcggtaatgtattgcgacaatgacgttcccgtttcgcgtgcgaacagttccgacagatacgtgggattcaaatgcacgtgctgtgccagaatcgcgacagtgattttctcatgcagatggtagtggatgtagtccatgcactcgttgacggctttggaatgggtgtcggttttctgcatgtcggccatggcccaagtgaagaaagtcatcatgtcggtgtgcagtcggcgcacgtcttccggggtcttgcaattgtcaagatcttgaatgtacagatcggaggcgttgtatgcgtcttcctcgtccatgccaccttcaatggcgaaacgcgtggccaaggtaatggtggtgacgaaacggtatttcgcgtttttcagaggatcgtccgacagatggccgtatagtccggaatcccacagtttcgcgctttccgaaatggcattgatgtcgccggagcgcatcatgtcatactgtttcatttcctcaacgtagcgatggtggcgtacccgatcctcacgcgaaagaaagtccagatacctcagtttcgcctcatcgacaaccgccattgctcccctgccattttgtaactaccttctttcaaggatatctccattgctcacaaaaccgatctgttttgcctagaagtaggtgctccagccgagtttgacggcgaggatgatgccggtgagcacggcggcggcacgcatgatgttttcgggaatatgccgggttacgggaggtgcgatggcactgccgatgatacatccgatgcacattatgatggcgaacggccaatacacggatccacgaatgatgaacatgatcgcagcggaaatattcgcgccgaacccgaccaccgttttcaacgcattaatctgatggaacggaccgatcttacccaagtcgagaatcgccaaggcaagcgtgcctgctgcggcaccgaaatagccggaatagacgccgacgaaactcacgccgacccacagccaccacggatcgttgcgcaacgtgccgcttgcggttttgctggcgatccgcgcggctcgttcgccttgatgcgattgcggcagcgcctgcgccacggcgtcgcgcgcggccgccttcttccgtggattgagtgcgatgatgatcgcgctgaacaggatcagcggcggcaccgcgcattcgaacacttctgccggcagttccagcagcaacagcccgccgatgatgccaccgaccaatccgatgcaggcgtagacggccacgcgcacgccttggcctctaagctccctgcgggcggaaagcagtccgccgatgcccgtaccgcacacgcccaccgtgttcgtggtgttggacagcacaggcggaatgccgaacgccagcaacgccggataggatatcagcgaggatgcgccgaccgcgtatccaacgaatcccgccccgatgccggctgcgagcaccagcagcaatgtggtgatggacactcccgcgatcatgaccgtttctcccgatttcccgactgatatgacaacgggagccaagcgtaatggcttgactcccgaaaatatcggttttgttcagaacgtggctgactgccgcgtttgaactatcgttgttcagtgattgcgcttggcaatcagcgactcggtccagtaggcggcgagcgggatcagcgcccactgcaaagcaagaccgggcagtccagcggccaagtcactcgtccaagtggcggcgatgctgttgccggaaccgaatgcgaacaccgccactgcagtggctacggtcagtacgacacggccggcaagttgggcgataaccacctttactaggcttggcagcttgatctcacgcagcagacctgcaaccaaaccgtacgcgcacaattcaatcatcatgaacggcagaacagccagcatcggcatgccggaaagcaggaagctagccagtggagcagctgcgcctgcaatcgcaccaaccgctggacctgcgatcaaaccgacgaaaataatcggcaagtgcataggcagaaaggcaacgcccaacgcagttcctcgtccggaaaccgctccgatcacatggaacaactgcggcaacgccactgcggcgacaatggcaagcacggttgcggcggctttgacgctcacgctcaagcgtggcagatcagtgcgacgcaaggaaactgctgtagtggaagtcatgttcattctcctttttaaaagctttcttttcacaagctttcgttcattatgaaaaattcgttatgtatgattcgttattcgtttgatttggcagtatctacaaccatgttggcaattgcgcgtgttccagtttgctcgaaataccgattctccaaaggaatccactcgtcgatgaatcgctgcagcatacgcggattacgtgcctcgagtctgcgtaactgctcattggaatcaatcatcaggcagatcatcaaatcgtagtattcacgcaatgcgggatgcatgctataactgccttcgacaatcgtcaaacgagcaggttcgacactatgcgaagccgcaaaatcgccggtatggcaatcccaaggacgatactgcacgatatttccggcaacgagcggagccagcacctcttcttcgaatcgttcccgatcgacattgcctcccggttcggcgaaccgttccggagtgcgttgttccgggcgcaggaaaaaatcgtccatatgcagcacattgccgtcgaaacgacgctgcagcaaagccgccaacgtggttttgcccgacgcgcatggcccgtcgatcgccacaaacacatgctcgcgttccgtaaacacacgttcgatgcgttcgatcacggcccgcgcgtcttgaaccgcctgcgcctcctccacgttttccatggattccttagattccttggattccatcatcgccgactccgtgcacactactcgagcacggtcaaacggtatgcacgcgaaccaagcccaagcccttcggcgtattcgagcgtgtgctcgccatgcctggtggcgatacgctcggtcacggacgcgccgtccggcgccacatgaatcagatcgacacacgcttggtcaagtgccaccgggtcgaacgacgaaagcacgccaatgtcatgcatgtccggctcggacggcgtggcgaagcagtcgcaatccaccgacaaacggttcatgacgttcaaatacatcatcttgccgttcatgtggctgatcacagcctcatccgcttcggccatcgactcgagaaagtcatcctgctcagcttcgacccacttgtctttagccacgcctgcggaatgaatccaacgtttgccgttcgacgatgcgatgccgatggacacgttcttcaacgcgcctccgaaaccgcccattggatgccctttgaaatgcgaaagcacgaagatggaatcatagtcgtcgatatgcctgccgacgatgtcataggcgatatggcggtgcttggctaccggaatctcgatctcgccgcccatgtccatgatctggatcggagcgatgtcgtcgtatccacgttccttgaacacggcaaggcttttttcgggagtctctcgattgccgtcgtatgccgttgcgcattcgacgagcgtgccgccgatctcctgcacgagatccttgacgagcgccggattgaggttattggatttctccgattcgccggaatggattttaatggccacgttgccttgaggcttgcgtccgagcgcatgataggctctgatcaggctttccggcgtgatcacagatgtgaagaacacttcgggcgcggaggcatcatcagtgcgatgatccaattcgtccagcttccttgcttcgaaatcagccatgaattctccttattctgtttgattttgcttccagagccagattaccaacttcaagtcggcttgaagcaaaccgacgcagcgcaacggccgcatgccacaccgatagtcatatatcgaaacagtccacgcatcaaccatgccaatcgggttcactggtgcggtgtttcgcatggcacctatgaaggaaggacgtgtatccatggccgagctcatcacaatggcgttgttctgtggtgcgttgatcgcctgcattatcgccggcatttccattattccggcgttgttggccggcgtggtgatcttcctagctcatgggcgtcttaccgggcatacgttcaccgccatgatttccaaaggtttcgcgaccatgcgtgccgccagcatcgtggtagtaacgttcgttctgatcggcctgctgaccaccctgtggcgcgccgcaggcactgtgtcgttcattgtgacgaatacggcaggtctggtgcatcctcatgtggtggtcctactcacgttcctactcaactgtctgatgtctctgctgaccggatcatcgttcgcttcggccgcgacgatgggtgtgatcacgatgacgttgggcacttccatgcaggttccaccggtgttcctcggtggagcgatactgtccggcatctatttcggcgaccgctgctcccccgtatccaccagcgcccaattggtcaaaacgctgacgcgcacgaacattttcgacaatatccgactgatgttgaaaaccgccgcggtaccgttcgtgctgacgtgcgcagtgtatgcggcattggcgctgtgcacgcatccttccaacagctccattgacattgccggactgttttccaacgcgttcgatcttgattgggtcaccgtcctgcccgcagtggtgttggtcgcgctggcgatcgccagggttgacgtgcgcatcaccatgaccgccagcatactgactgcattgccgatttgcgttgcagtacaacatatggattggaccgcgattggccacgcactggtattcggattccactgtgctgacgcgcgcgtcgcaccgctgatcgatggtggcggaatcgtttcaatggtcaaagtgatgctgatcgtatgcatttcatcgtcatattccggcattttccaagagacggaactgctggatggcgcgcatcggatggtcgcatcgcttgcccggcatatcagcgtattcggcgccacgctggtaacgtctctcgtggcgagtgccgtcgcctgcaatcaaacgttgtcgatcatgctgacaaatcaactatgcgaccatctggagtccgacgagcatcgcaaggccatcaatctggaggataccgccgtagtggtggctccgctgattccatggtccatcgccggagcggtgccgctcgcttcggtgggagcgcccacgtccagtctgacattggcagtgttcctgtacctgctgccgatcgtgcattggatttcagtatcgttggcacgccgctgaagtcatcgctttccgcaccataccgatgtccgaaccggccggaacacttgagacacgtgattgatttttgcaaaacatggtgggctcgcatagccaccaaggaaatggttttcgtcggcatcgtcactttggccgcctcaatagtggcttcgtggcttaaacagtttccgggattcagtctgttcggcgcgctgatcatcgcattgctcatcggcatggcggcccagtttccgattcgcaaatggtattccagccgttccgtggaacacaggtccggcgtgaaggacgcagcaggacttatttccaataaactgttgcgtctgggaatcattctgctcggattcaagctcaatctgaccgtattgttcacccaaggcatcaagtgtctgcccatcgcggccgtggtcgtgacactcaccatcgtggtgtgctacgtcatcgcccgcaaatttggcgtcgacccgcaactcgccattctggtggcgggcggcaccggcatttgcggtgcggccgccgtcatgggattgtctggctccatcaaagtaccgccggaaaaagaggatgaaaaagccaacaacgaagtgatggccgtggccatcatcgccatcatgggcaccatcttcgcgttactggaaatcacccttggaccattgaccggtttgagtaagacacagctgggcattaccgccggagcttccttgcacgaaatcgcccatgccgtggcggccggagacgcgttcggcgcggtggacatcgcaaccatcatgaaactgtcgcgagtgctgatgctggtgttcgcagccatcgtcatcgccgtttggtgggataaaaaccattccgaaatgccagcggacggtaaacgcaaagtgtcgttcccatggttcatgctcggtttcatcggcgcttccatcatcggcacgttcgtgccgttcatcggtgccatcgcaccgaatctggtcgatttcgcgtacatcgtgctcggcatggccatggctgcgcttggcatcaacgtgaatttcagcgccatcgccaagaagggacagaaggcgttcctcgccagtttcatcacgtctgtgctgcttatgtgctttgcggccggagtctcagcgctgttcttctaatcggtcttgcgagcccgatcgcctaggatatggacgggcgaccgggctcgcaaacgcgatgtttcccgacggcccacaccccgatttcgccattcgcatcccctcttacgcttccatccgtcatggcgtcatattctctgatgtcataatcgtcgacgtttttccgggaaaccttagacgcgcgtatggaagcaacacgagggagaatcgtcattgcgctttggacgcctgtctgtccacccaattctcggccacatcgatggcctcatcgagcgtgactttggctgccttgtagtacttggaatccttgatattgctgttttcaatgagtttttgaccggaatccacagctttggacaatgcggacagcagtttacggccagtcaacgtcagtgtttcgtccttgccaagcttgttgaccaatttgtccgccttgtcgagcgactgctgcagtttcttcttcgattcatccaacgattccgtggcggaagaaccgttcgaaggaacgtcgagcaattgccccgatgacgtattggactgagtattggaggatggtccgttcgttgtcgtgccatccgaatcgttccgcgaatcctgcagcgcattcgtgccgttcttctcccggatgtccttcaggctgttattcagggaatccgtggcgctgtctagtgttttggcgacgagattgagctgcgtgatggtggcgtccgccttacagccttccgtatcgaccgtgttctctgcgctggtggccgcgtccgcgaacgcgtcgatgatgtcgttcacgccgagcgcaccacggatcaatttctgcagctcgctaccgttttcggatgtgtcgagcacggccttacgggccgagctgaattccgcaagcgattgccggcatgtgtccaacgcctcctgccgtttgttgtggtagacgtacactcctgcgccgcatgccacagtgagcgccacgaccacggaaaggacaatcggccaggttttgcggggattggaaggctgttcaacggcctgatactgataatccatatgcgtccaccccttgcgaatcgacggatgtcatcgttcttcgtcttgttaacctcacctattttacgagtccgaagatgggaaaaacctgaatggacatcccacgcacgccgacgcgcgtatgcgtgcacgactccagcaacgagccgtacccgccgttagatggcaggcttcagtatcgtgacgccatgcgttagcgtcaccatgcaacgataggaacacactattcaatagtgcatcatgaaggcgtgacgttgccgttgtagatgactttgttttagcttgtcgctagagcgaagtcatctgcatggcctcgttgccaaggccagctccaagcctcacgtgactctcgccgccgcttggttcgcgtttcgccggatgccgcgttgcccgacgcgatgcgttggcccgtcttccgcttcctccacgcgcgtttaacgtctccggggcactcccggcgacttggatgttgatggccgcgttcacatcacggtcaatggcaagcccgcactcctcgcaatggtaaacgcgctcggacaaggacagtttggttttcaccatcccacagtttgagcaggtcttcgagcttggataccagcggtcgatgacatggagtcttgcgccggtgcgtgcggccttataagttagttgacggcaaaattcatagaacgaggcgtcctgaaccgattgggcgagcctgtggtttcccaccatgcccgccacgttcaagtcctcgatgctgatgtccgcgtaggtatgggagagcatggtggtggtcttgccgagcgcgtccgaacgcaggttcgccacccgtgcgtatagtcgggcgacctgcgctctcgccttgcggcggcggttggagcccttctgcttgcggctcagattccgttgggcttgcttcagccgcctgaggttcgatttgagtgcgtgcgggttgtgtatcacggtgccgtccgacaatgtggcgagttccttcacgcccaagtcgatgccgacgctcccgcctttcggcggcgatggaatcggcaggtcggcgcgttcgacggtcaggctggcctgccagcgtccaccacgcttggatacgctcatgcgcagcaccttcgcgccgttcactcgcttggacacgttctccatgcagtgcacgcggcctatcttcgggagccgcagcgcatgagggccacagtcaatgagaccaaacgaacccgtcgtgtacgcgaatctgggaaccgccttgtccttggatttgaagcgcgggaagcccatcctgcggcctttccgctgccctttgcgggacttggagaagttcttcagggcgtcggccaatgattcgagaccgctgttgtatgcctccttgctgttctccggccaccatgtttctcccgtggtctcgtccacggcaagtgtgttcttggcttggttccaccacctgcgcagggcgtagtacgaccattcgggtttatcgccgcgttcgagcatgtccttgacatgagcgagtcccgcgttgtaggcgaaccgcgccgcaccagcatgggactccaagagtcgttcctgccgtggcgtcgggtcaagcgccaccttgaccgcttcaagcatcgcgtgccgccttcaacgccgcgtccgtcttgcgcttggctgcgcgacgcccgtacagccgggcgcagaacgaggtcagcacctcggtcacgtcgcgcaccagatcgtcgtccagctccgtgtcgtccaccacgatgattcggcgtccctgcgctttcaacgcgctctccaccagccccgcgttcatgcgggcgagcctgtccccgtgctccacgatcagcgtgcccacggtcgggtcggacaatagccggttgagcttgcgccgcttgtcgttcatgccggaacccgtctccgtgaccacctcgggcttctcgacgcccatgctaagagcgaacgccttcaaccggtcggcttgacgttgcaggtcgttcttttggtcgccgctggatactcgcgcatagcagacggtgcggggttccatgcttttcgatcgcggcatgatctcgtatttcgggtcgtggatgagccacatgccggtcggcgtctgttccacaggaacgggcatggtgccctgacggcaccatttccacacggtctgcggatgcaatccttccagtctggcccattcctttaccaacatgagatttattataacataggattacttaagaaaacaaacagttcggtaacgggcaacaacccttgcgcaggtgccgtaagactccgcggacaaagcaatgaggcttcccccgcgagaagggaagcctcatatttcattcattctattcagcgatgatgacgccgaatcaccgatcatcctttgggaacagcgcgtcgaaggcatgttccatcacggacttacggcggatcacaccgacgagtctgccatcaccatccaccaccggcagtttcttgaactgcttcttggcgaggattcgggccacctctccaacatgctggtcgggcgtggcggcaacgaccttacgcgtggcgatgtccatcaccttcttgccggagagcgcctgcaccttggaggccacggtttcgtcgtcgaacaccaccatcgtcgaaccggtgccggtgggaaccgtacgggattcataggtggcaatcgatttcaggacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgatcccgccgatggactgttcccgggcctgcttgaacagggaggcggcgggggccacgtatgcgccggcgtagtgatgctcggcgggctggccttcagtggtttcgaccgcgacctcggcggaagcttgcgcctcgtaggccttggcgttacgtgcggccttctccttggcacggctggcgacggtgaagatgcagatgatcagggcgaccagcgagatggcagcgcacagcaggtaggagaacgcgatgccgctggccgtggcggacttcacaccctgggacatgtgtgaggcggtcacggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgtaaggccgccgatacccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatatgaatgcgacgaaggccacaagaccaacaacgattgaggtaatgacgaccggactggcccatcccatcgtggaagcggacgagaagccatagagcaggccaccgaacgcaatggtcgaaaggatcacggacaggatgttgagctttgggttcttcaactcgccgacgttcttgagcatcatcgtgcctccgacaaggatgaccagtgtcacgactgcgatgccaacgaacattgggcgccatccgaaactgtcaatcaccagaccaccgataaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcctacgatgatgaatcgggtgtgcggatcaataggctttgcggaactggcggcggacccgaattccgcggttttctgtgaggtcacagcatttccttctgttggtaacggcatgtgtgggcgatccggccccatacttgtgtcaagacgcggggacactgatgagtccgggataaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccatttgtggattggcaaacagaacattgccgacgaacgacccacggcaggcgcgtgcgatgaacatcgcgtagcgatacaggttcatggcatctccttgatgggttttcgtacggcaggtatcgagaagcctatcatcattcaaatcgacggtgaaacccacgcatgctcaacaatacacaaaatcttcacaagaggattgggcttaccgcatacgctccgcctgaataacggtccggggatgaatcagaggcgagctaagggttgcgtctcgtgtttccgtcatgatgtctggcaaaatagtgaagctgaacatgcgaggcatcgaccggaatcggaaagggactaatcatgcgagttctcggcaatatcctgtggatcattcttggtggattggccatcgcaatcggatgggcagtggtggaactgattctgtgcatctccatcatcggcattccgctcggcattcaagcgttcaagatggccaagcttgcgctctggccgttcggcgcggaaatcgtcaacctgtagattccaaatactacaaagccgccaaagcaacccttgacgaggcgatcaccgacgtcaacaattggattgaccagcaagccgccaaggccgaataataaaacacacattatgttgctgcagcagccaatccttgcagaacaatgtcatgacaaaggcctgagaagacgacttctcaggccttatccgtgccgcttctcagtcgcttgtagcgacagctcccctcaaaagaggggagccagagaaacacttacttcgagacgttgaatttaaattcgacgatatcgccgtcctgcatcacgtagtcacggccttcctgacgcagcttgccttcctccttgatcttgaccatggagccttcggcagccacgaaatcgtcgtaggagacgatgtcggccttgatgaagcctttttcgaagtccgtgtgaatcacaccggcagcctgcggggcggtatagcccttgtggatctgccatgcacgcacttccttctcacctgcggtaaggaaggtggaaaggccgagcgtatcgtagccgactcgcgccaactgatccaggccggactcctcaagaccggcgtcggcgagcatttcacgcgcgtcggcctcatcgagttcggtcagatcggcttcgaactgcgcgttgaggaagatggcgggggccggagccacggatgcggcgagcttggcctgcatgtctttattctgcagttcggcatcgtccacgttgaacacgtagatgaacggcttggcgctcatcaagtgcagatcgtagacggaatccttgtcgaaacgaccttcgcgagtcgccttatcaatggtttcgccagcttcaagaatggtcttcgcctgcttgacggcttccatgtaagccggttcgatcttcttgccgcgcagatccttctccagcttcggcagcgcgttctcgatggtctgcagatcggcgaggatcagctcggtgttgatggtttcaatgtcgtcggacggatcgaccttgccgttgacgtgcacgatatcatcgtcttcgaaggcacgcacgacctcgcagatcgcgtcggcttcgcgaatattggcgaggaacttgttgcccagaccttcaccttccgaagcgcccttgacaatgcctgcgatgtcgacgaacgtgacggtggccggcacgatcttctccgtatgcacgagcttggcgagcaccggcagacggtcatccggcaacggcacaatgccggtgttcggttcgatggtggcgaacggatagttttccgccagcacgttgttgcgggtcaatgcgttgaacatggtggacttgccgacgttcggcagtccgacgattccgatagtaagagacatggttccctagcttagtattaggcttcgatggcgtcgactgctttgataacggcaccacggaacgcgctttcctccaacgatgcgacacccctgatggtggtgcctcccggagagcagacagcgtctttcatggcacccggatgcgtttcgttggccaaatagagcgcgcccacgccttccaccattttggcagccagacgatacgcggtagcacgctgcaatccatatttcacaccggcatcgcccaatgcttcgatgtacatgtcggtgaaggccggcgcgcagccggcgatgcacatgccgatgcccatgtgtgcggtgtccacgcgttcaatcaggctgattgacgaaaacaggctttcgaaggtttccgtctgttcctgcgtgagcgtgttgtcgatttccgtgaccagcacgcctttgccgacagccatcggcgtgttcggaatggtgcattggatgtgtgcctgctcgaaagacgttccgaacaggtcgcggaatttgttcagatcccagcctgccgcaatggacacgacgatggtgtttggctgcgccagctggtcagcaatcggtgaaatcaccgcttcaatctgatacggtttgatggcgatgacgaccatgtcagctgcttcggcgacttgcgcggcggtacgcaccgcttttgcgccgagtttggcggcgttgcgttccagcttgtcgtaatgcgcggcacaggccacgatgtcgccgccattgacgacgccagcgttgactaggccttcggcgatcgcctgtgccatattgccgtatccgatgaatccgatggttggattggccatgtttctttcctttgctatcgatactcgtcgttgccgaacaatcgtcagaacaactccgccaaatctccgcggttcaacgcctcggtaaacagatgtctgaacacggtggaaccatgcacgccgtcatgttcaaactcgttggtagtccaataatgtgaacgaccgacgcgagacagcgtgtcgagctgcaatccagaatcgacgtacatgtcgtcaaaatagacggcagcctgaagcggaacctcattacgagccaactggtcggcatcgtagatcgtgccgaaatgcgtgtcttccataagcacgtccatggccggcttgaacggacgcaacgcacgttcctgctcgaacatccacgggaacatggcctcgccggtgaaattaagcggacgaatgccgcccgcgaattccggatgctcgccgcgcacgcgctgggcggcccagcgaatcggcgttttcagctcgccgttggcgtagatgaactcctgcaacggccaatacagcggacgagacgaggtcgcatccatcacagaagacaggaactcgtcagacagttccgccgaggccgaggccgaaccgtcgccgtcaaggaacgcctggtcaagaatccaatgcacgcgttcaaaactcggcttcataccgaaatcggatcccaagcattggaagcgttccaccgtgagcggatcgccgttcggcaatgtgacctcgcgcgattgcagtatgtcggcaaccgctgcggcacgttcgatatcgatcgggtaacgctcgtagaactgcttcgtctttgccgccatgcgcgggaacgtatgacggtacacgtcggtcgcatcggcgggaacgtgaggaatgccgcccgtagtgaagctggcgataactccttgcgggaacagcgaaagatacgtcaacgtcaggaatccgccatagctttgaccaagcgtgacccaacgtgcgcccccgaattcggtgcgacgcagatgctcgaaatcacgaacgatcgaatcagcgaggaaacgcttcaaaaacgcggcaccggccttgccgtcgccgtccatgccctcaatcacatgcgtgtcgacacgagacgaacgccccgtaccacgttgatccggcaataccacgcggaaatgcttgatcgcttcctcgatccagccatcggaacttgggccgagcggacgtggaccggaaccgcctgggccgccctgcaggaacacgagtagcggcaggtcgtcatgcacatgttcgggagcggtgaccacacggtagaacaggctgatcgattcgccatcgaacccatgaccgggctcgtggcccgtccaatccaacggcaccttgatggaacgatcctcaatatgcaatccgggcacgtagtattcgctcagcaacgtcatgcattcacctttcctttggcgtcatcggcatattcaatgcgagtagtggcttcttgatggcttccatcccacccacacgcggagacaaccttacctcacaaaagcggctttatcttaccgccatttcattcctgcgcatgatggcgccacagcgtatctggcgctagggtggagcatatgtcgaatttcaagcagcgtctcttgtcgtggatgcatggtcatgtcttcgcaggcgatctcatcctcacgcttgttataggtgttctgctgttcggcgtgaccggcagcatcacctataatccgggattgctgtttgaccttaatccttccatacagatggcgtgggaagcggcaatgctgatcccgctgctgattcgtcgatggcggccacagaccggagcgttgctctgtgtggcattggccttgacgcatctcatattcggcccttgcatattgggcgccgatattctggcattggtcatgctgtattcggtgatcgtctacggcaatcccaaaaacacgaaagccttcattattttggcgttggccatcggtcttctggcttcggcgttgatggcatggaccatgaccaatgggccgctgctcaccggtggcaaagtgcatacgtggagcagttggaatggctcaaatccaaatggcgcaatggtcacggaagtcactctcggctccatctacacaggaacatccatgtcgggagtcgccgacatggtggcgcaatacatgctggtgctgacgccgattttcgaagtatgtatcatttccaccgtcattgtagcgttctggcagcgtgcccgtctggcaaccgttcgcatgatgcgggaacgcaatgaggcaatcgccgcgcgagaccaggacgaacgcgatatcgccgcgttggcggaacgagcacgcatcgcacgtgacatgcacgatgtggtggcgcacaccctatcaatcatcatcgtgcagtctgatggcggccgctatgcaggcacgcatgatcccgcggtggctagaaacaccatggagacgattcgacacgaatcggaacgcgcactgcatgacatgcaacgtcttctgggagtattcgggggttcaccgcacgccgattataacgatatcggcaatcttgtggaacaagcgcgaaacgtctcccccgacattcgaatccgacggaatatcaccggcaccgccagcccagaacaactcggtgaacaagcctcgatagcttcctaccatgtagtgcaggaggcgctgacgaatatccgcaagtatgcggggccgcacgtcgatgtgcatatcaaagagtcatggaacaacggtttgctcactttgagcgtcaccgacaatggtcgtggcgcggcggccaatatcgacgggcatacgccaggttacggcctgttgggcatgaaggaacgcatcgaatcggccggaggctcattgcaggctggccctcaactcggcggaggcttcgaagttatggccaccctgccttacggcggtaaagagccagcgacagacgaaaccggcgaacagtatgcctcggaacagtccgaatcttgcaacacaactgccatatccagcaaagcgaaattatccgacgaagcaatcgcacctcacacagccgtcaacatatcggcgcgaatcccagatcaaccatcggaacagacgcaggaaaccaacccaccaaccggtcgcgatcatcgttcgaacgccctgcaacacttgcgcattaccgcacccaatctgcatgatttgctcacatcgttgaaactgaaatccgtagaacttgccaatacatccaattcgcgagggctgaattgggtggaacgtgtttccgcgtggacgcagcaccattatgtactcatggattccgttggcgccgtgatattggtcatgctgctgaatcgcatgtcgattacgttcttttttgatagttcacgcgatgcgcagctctctcatgcgatcgccgcatgctgcttgctggcgctggctcttcgacgaaggctccccgagacttgcgcgcttattgtgttcgtattgtcggttgtgcaattggtgtttttggggttgattgaggttggacatatcgtagcgtcgctgtgtgcgctgtattcagccgtattgtatgggcgtgaacacgcatggcgctggaccggtcttgccgctgtcacctgttcagctctgatgggcttgaaaatcgcagccgaccagcacggatacactaccttgttcggcgccatcgccgcttccgcgggcttaacaaaaccggtttcagccacgtcaagtagtagtgcagcgttctttaccggtgccatgtatacggctgcagtgctgatgctgtgcgccggcatcatggcgtgggcacgttgggcgcgttccagcgattcaaacgcactggtattgcaggctcgcgaagaggcactggtggccgagcaggagaagcagcgtattctcgcggcgaatatggaacgtgaccgtatcagtgccagcattcaggctgaagtcaccgccacgttgaacagcgtgatcagccaggccgtcgatggtattcatatgttggacagcgccgaagcacaaggcaaggagcctaccgccgacgagatttccgcagcgttcaaagccattggcgagcaggggcgcgccgcgctcaagcgtatgcgcgaactgcttagcgtgcttcgtgagactggtttcagcgatgacgctcatgccggtagtgcgagcgaactgcagttgaggcccgcggcaccgttggaggagcagctgcagcgcgtgtctcgatagccgattcaagtttttcagggagatttaagggtttgtttcgcgctgtgagcggaacaatgccgataaggtggagagtatgagcgaggaacagaagattcgtgtggtcattgccgatgatcaggaattggtacgtgccggtttcgccatggtgatcggctcccaacctgatatggcggttgcggcgcaggctcgcgatggcgcggaagctgtggcgttggcggaaacgctgcatcctgacgtggtgttgatggacgtgcgcatgcccggcatggatggtatcgaggcgacccggcagatcagtgcgttgcggcatcgcttcgctgccgatggaacgcaatcagaagtcactcataccaaagtgatcattctgacgacattcgacttggatgaatatgttatggctgcgatcactgccggagcttccggttttctgctgaaagatacggaaccggaaacattgctgaattcgattcgcacggtttttcaaggtaatgcgattatcgcaccgtccgccacgaaacgtcttatcgagaaaatgatggaaggcgatttcatggctgcgaacgttggtaggcctgaaaattccgcaactacttctactacggattcaacatataccgatccggaattggatgacctgaccgaccgcgagcgcgaagtgcttattgagatcgcgcatggattgtcgaatcaggagattgccgacaagcttttcatcagcctgccgacggtgaaaacgcatgtggcgcatattctggcgaaaatcaatgcacgtgaccgcgtacaggcggtggtgttcgcttacgaaaaccatttggtctgattggtttgttgttttgcgtatgcatgatacgcaaaaaggactcctaccatgtttgtggtaggagtccttttcgttgtgtttgctatgaagctcaggcttcggcgagcgcctcaacaggaggcgtgctcactgccctgcgtgcggggaatacgctggcgagcagtgctgccacggctgccacggcgagtacgatgccgttaatgccccattcgaacgggaacaccactttgccgtacatgctgaacaccacgtatgcgcccagccagccgaacagtgtgccaagcagtacgcccgagatgccggataccagcgagatgagcagggcttccaccgcgagggagcgtcgcaactggcctcgcgtcatgccgatggcacgcagtgtggcggattctcgggtgcgttcgatcactgacagcgacagcgtgttggctacgccgacaagtgcgatgagcacggccacggcgatcaaccccaccagaagcatcatcatggagtcaatcatgttcgcccatacgatgcgttcggcgatcggtccggtcactgtcgcatcagtgctcttctccaatgcggcctgcatgtcgttgtagatgccgtcgacggaaactcccgacttgtcagtgtctgccttgaccagcaacacatgggtggcggcgtcaaggtcaccattggtgaaatggctttcatccacgaatccgacagctccatattgcgcggatacacgacggtagtcggcttggttggcttgcaatgtcagcgaacgcgtagcgtcgccgttctggttccattcagtggagaaatcagccgtgccattggcgaactgcagctccttgccggtttgcgcattgtatgttggcatgagcacgctatcactgtcgatggaggcgttacccaagttggcacgcatgacctgcttgacctgatcgatgtttttcacgccgaccagcaatgcggacgtaggctgggttccatccgctttctccaaggtcacggaaaccgccggcgcatacaacgtgtcggacacgccgttgatgtcagatacatccttgaccatttgctggctgatgtcatcgcccatggccacgatgtcgacgctataacgggtggcgagcgcaccattcatagtctctttggcgctagcggcaccggttgcgatggtggagaccaaggtgacaccgatgagcagagcggcaccggttgctgcgatgcgtcgcggattcttctgaatgttggcgtgtgcaactgttgcggaaggacctgtcagcgaggccaacgctccaacgcccttcatgagggtcggcatccagaataccgcggtgaccaccatgccgaggaacaccagtgcggcaccggcgatggctatgagcagaatcatcgtgaattgatcgccgctcgcatcctcgccgccgttggtggcctgcacctgccagatggagaatatggccatggcgataccgaccgccaccatcagaataccgattatggctcgcgtaaggctggaacgacggttgtcggtcagttcaatcggacgcaatgcctccaatggcgttaccgcggtggcggaacgtgcggatcccatggatgcaagcaccgtcaccacaatgccgaagagaatcggtacgacggcggcttgccaggagaagttgaaccgcatacccgcctgcatgatgtcgctgacgcacatgccccacatgagcaggcttccaagcaccacgccaagcacggatgcgacgaagccgagcaccaccgcttcgaacagcacggaaccatacagttggcctttctttgcgccgatggtgcgtagcaaggcgagtgtgcggcggcgttgcgccacgagcacttggaacgtgttggcgatcaccagagccgccacgaacatggcaagcacgccgaagcacataaggaatgtggtgacgatgttggtttggttgccgcttaaggatttgatgctttcgtcactgatttgctgtcgtgacatcagatcgaaatgctttggcagcaacgctttcacaccgttgatggtttttgcggatacgctgtttccatccaaggcaaggtcgagatacaccattgttgttccggtggcgttgaaatcgtccactccctgcattgcggcaagcagattgttggatcctacgatcgcaccaccatagtatgagtaggcgccgttcggatcggacgtgagtcctaccacgcgcacgttgtccgccttggctttgccatcgtcgcctaccgcatatcgggaggtcaggcttacagtgtctccaacgccgacgttcaactgtttcgccatgtcttccggcagcgcgacttcgttggaatccttcggctggtccccttccgtgatattcacggggagcatgttcttctgtgccgcggtggaaatgatctcgccgctgacggtgctgtctcccttggaaacgctgacgccggtttccaccgaggcacggacgccgccaaccccttcgatgccggcgatctggtcgagatgaaagtcgccgacagtgctggaatacgcctcgttgagttccttatcgctcaggtcggagctgttgacggtcaccgcatagttggcgtttccgaacatggcggtcagctgccgtgtcagggagtcgttcatggcattgccgaacaggaaggtgctggcgatgaacgccgtgccgatcatgatggcgatgcctgcgggtatgagcatgcgcttggtttttcgcatgagtttcaaagtgatggaccacatggtggattctgttcccttcttcgaatgcttctatagtgcgtttagcgggaatgtctcgcggaagccacattcattgtggcggcctcacgttccttcatcagcagttcactcatctggtctgctgtcggcttgtttacgtccgccacgatctggccgtcggcgaacacgagcgcacggtcggcgtaagacgcggcgaccgcatcatgcgtgaccatgatgatggtttggccaagttcgttgacggaacgtttcaggaagctcagcacttcggcgcttgatacggaatcaagattgccggtgggctcgtctgcgaacaccagtttcggtttggtgatcaatgctcgcgcaatggcaacacgctgctgctggcctcccgatagttcgttcggacgatggttgagacgttccttaaggccaagcgtttccaccagcagacgcaaccactgtcggtcgggtttcgctccagccaaggtcaatggcatgagaatgttctgttcggcggtgaacatcggcagcaggttgaagctttggaagatgaatccgatgtcgcggcggcgcagcaacgtaagctggttgtcgttcatgcgcgtcagatcgtcgccattgaatatgatgtgcccgccggttgcacaatccagtcctgccaacgtgtgcatcaacgtggatttgccggaaccggaaggtcccataatcgccgtgaattttcctttttcaaaagcgacgttgacgccacgcaacgcatgcaccgtgttatttccggaaccgtagtccttcacaagatccacggttgcaatggccgtattggtagctttgatggtgtccctgatatccatgctgtcattcctttctttggattacctccaaaattacggaaaaacagctgattcgaatatcatgcgttggtctgaattatcatctcatccttgagaatgagcaaagacgaggcgcctaataccattgattcatcaatcgtcgagaagtacaccatcctgcggaggttcgagccagtacgactctttttccacgctgacggtggaagcccaccatgtctggtccacgcctggcagcgaacggatggactcatccaccacacgccacaggtcctcgtcatctccggcgatgatttcgatgaggtagtcggcgccattcaaaccgactccgctcattgcatatgtcacctcgtcgattgctaacaactgttcgacgtcgaggcgatacggaggcttcacaccgatgccgagaaacgcttggcggaatccgcctaaacgcatggggcttaccgtggccataatgcgcatcacaccggaatcctccagttttttgacgcgcccacgaatcgcggtgtgcgtcacaccaagatgttcccccagcatggcgtagcttgccctgccgtctttctgcaattcgttgaacgtgtgcacgaatcgcgcgtccaaccgatgcacgggaatatcggtgccgacgctggcctcacgtttggtcatgaatccagtttcgccgcgttcggccagcagacggttgaccacgctgacattatggtcgtcaagcaccaatcgaccgcaggagaacacttgcagacgggtcaatccgggcagtgcgcgcaaatcgtacttcaggaaatggtccataccgtcggctgaatacaccacggcttcggcgatgatgtcggcatcgcccagcgtgcagaccacataggtgacctgaggcatggctttgagcatggcgagcgcctcgttgcgattgccgttgatgcgcagtcccacaagcacctgactgtaattgccgagactcaacggattgcatacgggcacaatggtcatgatgcccgcatcggtgagccgtttgtagctttccgtcgccgcatatacggaaatgccgattttatcggcaagcgcctgcatggtcatgcgtccgttgcattgcagtgccgataccaccttcaaatcacgtgcggtgattgtggtacgcccttcatcctgtgtcattgcaccccctatgacagccatgtcatcaaccacacgctgcctgcggcggcggcgatggcaatcacgagaataatccagtcggcaatgctcatcgtgagattgacccgatatgtgcgtttcacaccgttccgattcaggttgagtccgcgcgattccatggcccagcccacgctttggctcattttgtaggcgcggatcaatacggcgatgatgatcggcagatacgatttgaaccggtctacgagacgtacgaatatgttgcgttttttacctgccgcattgactttgccgctcagatcaagccctcgcgcacgctgcgcttcggacacggattggaagatggaaaagaacacgggaatataccgtaatgcggttgccagggtaagcccggccttgtagggcataccaagcgaggtaaggccacgaaccagtttggtctggctggtggtgaacagcgtgatgaaacatgcaaagccgagcgctggaatgcgcagacccatcaccgccgccatgagcaggttctcctgcgtgagacgcaaccatccccactgccagagcacgtgcgttccactctggtcaaagaccggccaaagcaccacgatgaacacgatgagcacggcgaggatcttccacacccatccaatgcgttcggcgggcacacggtcggtggcgagcatcacatgttcgagaatgaggatgccgaggatgaacgcccagttacgccatacgaggcaaagggccagcatgacgatggagatgaggaatttgacgcgcggatcggtgcgatgcaaccatccgtcgcctggcacatacaggtcggcatccatcagcgttcctccttgtcgcattcatccttggcgattttcaacaatacgtgggtcgccgataccggaccgcgcgacttgtacggctgccgcgcctgtcgcgcgggcgattgttgcgcttcctgcgatttgttgatcggtccatattgcacgatatgaccgtcttccaattcgagcacgtgcgtgcaataccgatatacggcacgcatgtcatggctgatcatgatgacggtgacgccatgccggttgagtttttccacggttccaaggaatcgtgatgcgagacgatggtcgagacccgccgtaggttcgtcgaggacgagtattggcgtacgcatggcgatcaccgaagacaatgccaccgcacgtcgttcgccgtagccgagcgtggccggcgaaacatcctcataccggtgcaggtcgaacaatgtcatcatttcgtcgacacgtttgaacacggtggccgcgtcaagtccgagcgcggtcgggccgaacgcgatctcctctttggtgctggagcagaaaatctgatggtcgggattttggaatacgaatccgacgtgcgcggccatttcgcccacgctatgcttcgacacgtcgagcccatccacattcacgattccttgcgtgggttgaatcagcccgttcagatgcttggcgagcgtggttttgcctgacccgttgcgcccaataagccctacgaaggcgccctgttcgatatccaagctgacgtcgtccagtgcgggagacgcattgccgccctgcccatagcggtgcgtcacatggtccagactgatgatcgcatgcttcggcttggcgtcgttccctaccggcaacgccttgatgactggagatggtccgtcactcacccgcacgccggaggattccaacagtctacgttcccgggtaaataggctggcgtctccattgcgcaccacttcaccgttgaccatgaagagcacctgatcggcccagtaggcgatgtgttcggtatcctgctcggccatgatcaccgtcatggaacgggtctggcgaatgcggtcgagcacgtcgaacacttcctgcttgccttcggggtcgagggccgcggtgggttcgtcaagaataagcacatcgggttccgccgcgagcgcggcggcgatggccacgcgctgcatctggcctcccgacaggctggtcggcacacgcttgcggtatccggccatgccgactaagtcgagcatgatgtcgatctgcttgtcgatgatgcttggggctactccgcggttttccagcgggaaagcgatctcatcctcgacactcgagcagaacagctgcgcttccggatcctgttgcacgtagccgacgcgctccgacagtgccgagacggagtgcctgctcgtattcatgccgttaacttccacgacgccgctcatggtgccgtcggccaggttcggaatgatgccggccaatgccatgcatagcgtggacttgcccgctccggtcggtccgatgatgccgacgaaggatccggaccggatgtcgaagctgacgcgcttgagactttccaccggcttgcccccgtcggtcagtggcgcgtacttccatcctaagtcgcgaaccgtaatcatgacgctcaccccgtgctttcacgcattttttccgcagccggtaaccgcatttcacaataaaacccgtggaatcgcctttcatcggcaaatccacgggcctgccttcacatgatattaatgtatcactcccccgccttaataccgaggttgcccaaacgtaccagcggcggataggcctgacgaacggcggtgaacagcgcgaagcccacaatcagacccaccgccatctggaaggagttgcccgcgatctcacccaacgccgggccaaatccggaaaggattccgcctgcgatgaaatagccgaacaccttccatacgcctgcgatcaccgaaccgatgatgatgttcgccggattgaacttcttgacgagcaggcccacgagcacggcctgcaggccatcgatgacgaacgtgaagatggcccactgcggataaccggaaatcagatcgctcaacgccgggccaagaccgccgataatgccgcccacccatggtccgaacgcatacgcgctgaaatagatcatggtgtcggacaggttgaggtagccacggatcggggtcgggatcttcacgagcatggtcagcaccgtggtgaccgcggtcataatggcgatcagcggaatggtgttgacctgcaacgcctttttgatatcgttcttgacttcttgagccataatcgcctctctcttctctctttacgtaatccgcaatatcattaccactatttatccttttgaaagaaatctgaacttctttctttcaaaagatagaatttagatattacttttcgtaacaatcgcagattctataccatctgcgctacattacgatgacaacgtccgcgaatatggcgaaacggtttgtggcaccaaccttctcttcggtgccacaaaccgtttcatttgctcaggatggcgttattccgccgatccgatacgcctcacttggcgagaccggattcgcgcagagccgcgaaaccgcccttgagatcgtcgaggatgtcttcgatgttctcggtgccgatggacagacggatcgtgccctggtggatgccctggtcctcaagctcctccggcgtctcctgagagtgcgtggtggaggccgggtggatcacgaggctcttggcgtcggccacgttggccaacaggctgaacaggtgcaggttgtcgatgaacacgcgtgccgcgtccttgccgcccttgatgtcgaaggtgaagatggagccgccgccgttcgggaagtacttcttgtacagctcgttgtccttgcggccttcgatggacgggtgggagatggattcgacttccggaacggtcttcaggtagtcgatgaccttcagcgcgttctcgacatggcgctcgacgcgaagcgacagggtttcggtgccctgcagcagcaggaaggccgagaacggagacagggttgcgccggtgtcgcgcagcaggatggcgcggatgcgggtcacgaacgcggaaccgcccagagcctcgtagaagttcagaccgtggtacgacggatccggctcggtcagggtcgggaacttgcccggcacttcggcccagttgaagttgccgccttccacgatcacgccgccgagggtggtgccgtggccaccgatgaacttggtggcggattcgaccacgacgtcagcaccgtgctccagcgggcggaacaggtacggggtggcgaaagtgttgtcgacgatcaccggcagatgatgcttgtgtgcgatggcggtgatggcttcgaaatccggcaggtcggcgttcgggttgccgaaggtctcgaagtagacgagcttggtgttctcctggatggcatcctcgaactcctgcgggttctcagcggagacgaaggtggtggtgatgccgtcacgcggcagggtgtggcgcagcaggttgaaggtgccgccgtagatgttcttggcagccacgatgtggtcgccggactgggtgatgttgcgcacggcgtattcgaccgcggcggcgccggaagcgactgccaaaccagcagcgccaccttcaagggctgcgatgcggtcttcgaacacgccctgggtggaattggtcaggcggccgtagatgttgcccggatcggccagaccaaaacgcgcctcggcgtgatcaaagttatggaacacatagctggtggtctggtagatcggcaccgcgcgggaatcggttgccgggtcggcctgctcttggccgacgtgaagctgcagggtttcgaagcggtagttcttggaatctgccatggtttctgctccttgtggggaagtggttcgttgcttgtcttgctgaccacccgccttgccgtgtgtggcggttggtcaggtgttggtagcgacaataatccggccgcgctccgcaatgcaagccaaacgttatcgcacttgcctatatccccttataaaccgttgcaatcattgccatccaggctttgcaaaactactctggtagccatcaaaaaacttgcgacacgccagcaaacggcatcatggtgactcgccgtacgaggcgatggggcggtgaagtcaggcaagcggctaaagtcatggtcaggcaatcgcaagagagggttcccatgaatgatgtgattctgttcgaccgtgacccacggtacattccacgtgtggccgcggtgcacgacatgtgcggttacggcaagtgctcgctgacggcggccattccgattctgtcggcggccggatgcgacgtatgccccgtaccgacggcgctgttttcggcgcatacgcgctacagcgtgttcacgttccacgatacgaccgaaattttggacggctatctggatgcgtggcgcaaggagaacgtcgatttggacggcgtgtattccggtttcctcggttccgccgaacaagtcacgattatcaaacgtctgtatgcggattacccgcacgccttgcgtttggtggatccggtgatgggagacggcggcgaaatctacgccacatacacgccggaattatgcgaggcgatgggcacgctggtggatggcgccgacgtgctgatgccgaatctgacggaagcgtccatgctgacgggacgcacctacccggggcagaacatcgacaacgcggaagtgaacggcattattgacgcgctgcttgccttgggagcgaaaaacgtggtgctcaaaggcgttgaccgtcaggatggcatcattcgcaactatgtggcatcggccacttccggagcatccggcaagcaagagcttgcgcacgacaagctgccgttcatgacacatggcaccggcgacgccttcgcatccgcattatgcggtgcggtgatggccggcagacctctggctgaatcggcgcatatcgccggtgaattcgtacgccatgccatggaaagcacgcaattccagccgaaccacactgagcgcggtgtgagcttcgagctgaaccttgacgagttgacgcgtctggttcgccgctgaacattccaaccatatgcggtttcgggcgctccatggccgctcgccttgtggagcaatgtggataacggcaagttatccaccaactatcccaaacacgcccgaaaccgcatcctctatccacattcgccgttcgcccttgcttcgcgccggtcctttctgctggacttgaatcatgaacggcaacacaacacataacgttccgaacgcaacgcagcgctcggaacagcttcttgattccatcgcacggcgactgcatgatggcacactgtgcgcacgacaggtcggcgaactcggcgaacagtatgcggccgcatggctggaaagccaaggctggcagacgctcgaccgcaactggcactgccgatatggcgaactcgatatcgtttcacgcgacgatacgggaatcatcgtcttcgtcgaagtcaaaaccaggcggacgctccgctatggcactccgcaggaagccgtgacgtcatccaagcagatcaacctgcgccacgcggccgtgcaatggctgtcggacagcgaccatcgcacgccgcataacggcgtgcgcttcgacgtcgtcaccgtcatcgtccgtgatggcaaaccgcttgtccaccatatcgaaggagcgttctgatggctatcggcagcgcgctttccgtgggtctcatcggcctgaaagccttcatcatccaaatccaggcgttcgtatctccgggactcccctacttttccatcatcggacttcccgacacctcgctctccgaagcgagggaacgtgtcaaatccgcatgtcaggccagcggtgccaaatggccggaaacacgggttacggtcaatctttcgccggcgtccatgcccaaacgcggatcctcacacgatctggcgatcgcagcgagcgtgcttagcgcatccggaacgataccgcatgactgcttgaacgacaccgtcgtgctcggagaggtgaatctcgatggcacggtactgcccatcaacggtctgctgccgattctgctgcatgcacgcgatcaaggcgtatgcaaggtgatcgtaccgcatgccaatttggacgaggcggcccttgtgcccgacgtcgacgccattggaatacgtcacgtcggcgaactgatcgaactgatgggaggcaccgcgaactatacgatacccgatatgatccgagacgtggatgccaacgacggcgccatgtcggtatgtcctcctcccggagatatgaacgaagtcatggggcaggaaacggccaaatgggcgttggaagtggcggctgccggcggccatcatctgatgatgaccggtcctcccggcaccggaaaaaccatgctcgcctcgcgcattcccggcattatgagtccgctcagcgaatcggaacaactggaagtcgcctcgatccgctccctatgcggcacattgcccagctatggcatcagcgatgttccgccattcgaagcgccgcaccataccgcatccaccgcatccttggtcggcggcggcgcgggattggctcaaccaggcgcgatcacgcgggcgcatcggggcatcctattcatggacgaggcgcccgaattctcggcacgcaccctgcaaaccttgcgcgaaccattggaatccgggtatgtggcgatatcccgcgcgaaaggcaccacctactatccggcacgattccaactgatcatggcggccaatccttgcccctgcggctacgcatacggcaacggcgagcgctgcacgtgcagggaaaaagaccgtatcaagtacttcagccgcctgtcggggccgatcctcgaccgcatcgacattcagatcgaagtgcctcctgtggaacgcatcaacccaggcacggttccttccggcgaatccagccacgccatccgcctgcgggtcatggtggcaaggcaaacggcacaggaacgtttccgggaattcggatgggtctgcaatgcgcaagccaccggaacatggcttcgcgccaacacgtccacaaaagccatcgagctcgtgaaccatgcgttggccagcgaacggctcagcctcagaggggcggaccgagccatgcgactcgcatggacgctatccgacctgtcaggcaaaacctctcccggaccggaagagatgatgcaaggaatctccatgagaacgaggttgacatgaacgagaacacaaccgccgatacgagcgtcaacgcaaccgccatcgacgatgagaccctgtcacgcgcggtgctcacctattgtctggacagcgccgatgcgatgatgtacgcgctggtcaaaggcatcggatcagccacgcataccttgcaactgcttgccgacagcggtccgggcaatcatgaaagcgtggccacggcagcctataaaaccttggacgcggcgctcatcaacggcattacacgttggggacgcaccatcaatgctcgaggtatggcctccttccacggcgcaatggtctcgtggcagcatcgcctgaccacattgcccagcaccgaccccgaggagctcaaaacgtggttcaccgcaaacggcacgcagtggatcgtcgcgccgcatcacccctactggccttcgcagcttgccgacctcaccatacacacggactgggccgcgccattatgcctatgggggaaaggtgacccccaagcgttggtgtcatgctccgaaccggtcggtgtcgtcggatcacgcggcgtaagcgagtacggaaggcaaagcgcacacgagctcgccaaacaagcggcccgagcaggccatctcatagtgtcaggaggcgctctgggcaccgatgcggccgcccactggggagccatccaagccatggacgagatcggaacgcccctcgcaggacgcaccgtcgcggtattcgccggaggactcaactatatcggtccgaaaagcaacgagcgcctcttcgaaaccatcatcaaccattccggcgcgctcatctcggaactctgccccggaaccgttccggaagccagacgattccttatcaggaaccgcctgatagcggcgctatcatccaccctcatcgtagcccaggcacgcgcacgctccggcgcgcttaacaccgcaggatgggccaacgaactcaaccgccgtgtattcgccgtgccaggagatgtaaccatgcctcacaacacaggatgcaaccgactcatacaagaaggccaagcctccatcatctgctcgctgaccgatatcgacgaattctgccacgcagcgcatcgcccgcaatcagccgacgcggcagacaacgacgacgaaccgtcggaagagtcaaccgacaccagtctgtcgcaaccaaccaacgccactgcagccatactcaaagccatacgaacatgcagcgcgaaatacggccacgtctccactgacggtctactcgccatcctggccgaaagcaatcccggagaatactcaatctcacgaatcagcatggagctgggattaatggaactcaacggacttatctgcacacagcatggcaacatcaccatcaccgacgcaagcgccacatgacatcacgcccaacaacgccaccgccaagcctgcacagatcaacggaatccatcgaaaacatacgcatcagacacgcataatcacgcatgcagcggcaaacccgccaaccggcaaaccgcaatgaggtcacaccttgtgcgaaaatcgttgctatgagtccgaagcatgttgaagatatgtatgatgcagtaatcgtcggcgcaggcgcggcaggcctgtccgcagcattgggaatgctgcgaagcgaacaaatgcaagccctgaaggaagccggcatcgagccgaacatcctggtgatctccaaactccagccgttgcgctcgcacaccggttccgcggaaggcggcattgcggccagcctcggcaacgtcgaaaaagacgactggcactggcactacttcgacacggtcaaaggcggcgattggctcgtcgaccaggacgcggccgagctgctcgccaaagaggcgtcggaaaccgtaatcgatctggaacatgacggtgtggcgttctcccgtactgaggacggccatatcgcacaacgacgttttggcggacataccaaggatttcggcaaggaaccggttcgccgcgccgcctatgcggccgaccgcatcggccatcagatcctcttctccttgtggcagcaatgcgtggccgaaggcgtggaattcgccgaggaatggtacgtgaccgatctggtaatcaccgaagacggatccaaagtcgaaggcgtagtggcatttgacacgcataagggccaaacgcacgctatccacgcacgcaacgtgcttctggccaccggaggcgcaggccgcctattccacaccacctccaattcatgggatctgaccggcgacggcatggctctcgcactgcaagcgggactacagcttgaagacagcgaattcgtgcaattccacccgactggtctggcgcataccggcattctgctgtctgaagcggcacgagcggaaggcggcgtgcttcgcaatgccgatggcgaggcattcatggaaaagtatgctcccggccatgccgatttggctgcacgagatgtggtgagccgttccattatggctgaaatcgatgccggccacggcgtggcggatccgaaggaccccgaagggccaaaggattgcgtgtggcttgatatgaccggtattgatgccgaccatatgcatgaggtactgccgcaggtggtggaaaccatcgaaaaatatgcggatcttgatccgacacacgatttcgtgccggttaagcctaccgcgcattacaccatgggtggcattccgatcaccaccgacggcgaagtctaccgttggcagaacgacgaacgaaatgtcgtcgaaggcctgttcgctgccggcgaatgcgcatgcgtgtccgtgcacggcgcaaaccgtctcggcggcaattccctgctggatgcatgcctgttcggcacccgctccggcaaggcgctggcggaacgcatttccagcgctccagtgaacgatcccatggctgaatccgacgccgacaatggttcggatgcggtccagcaggccgctgacacccgttccaacgaactcaaggatctgctggtgcagcttccggaagacgaggagcatgcagccgacaatccttaccagctgatggccgatctgggtaccgtcatggaacgcgctgtcgccgtgcgttgcgacgagcagggtatcgaacaggcgctaacggcattgcatgatgagtttgcgccccgtgccgaagccctgcacgcgcattccgactcccccacgttcaaccaggagatcaccgccatttgggaggtccgccaccttctggaactcggcaaggccgtactcacctcatccgatgcgcgtcacgaatcccgtggctcgctgaagcgtcttgattttccggaacgcgacgatgagcatttcctggcccattccatggtgaatgcctccggccagatttcctggcagccggtgcacattgtgaatatgccgccaaaagcccgcgaatactgattccgctgggcacggcgtatggcagactagttgacggttttattggaaaggcgggtacatgagcggtatgggaaacggcgtgaatacggtgacattgcgggtgaataggtttgccccgcgcgccgagcgtgcccgcgaccgcgaacgtggcggctctccgttcgccagaaaaagctctccgtttggggattccggcacgtcggcgcgccgccgcccgcgcggcaagcagtggttgcaggattacacgttgaacgtgcgtccggaagacacggtgcttgattgcctgttgaagatcaaacgcaccatcgatccgacgctggcattccgctattcgtgcggacatggcatgtgcggttccgatgcggtgtccatcaacggcacccccaccctgctgtgcaccgcgtccgtcaaggattgggccaaaccgtcgaatccgacattggtcgacgatgaaggattccgacacaccggagatgtttccgacattcaggaaaatgcggtcggcgcaggggatcttggcgtcatcgagctcgctcccctgccgggtttcccggtgcagcgcgatttgattgccgatatcgatcagatgctcaaccaaatcagaaaactcaagccctatctgcaggcgcgtggagaactcgccaccactgcggacggcaagatcaacgctttcgaatatctgcagaatccccagcagcttgccaagtatgagcttctcagcaactgcatcgcctgtggcacttgcgaaggcagctgccctgtgtatgcgggcggcgaagcgttcatcggacctgcagcccttatcgcggcgtctcgtttcatcaacgattcccgcgacggtcaggcgaacgcacgcatggatgccattgattccgccgatggcatcgccgcatgccagtcggtccgcgcatgtacccgcgaatgcccgcgtggcattgacgtcggcgaggaaatctggcagctgatcgcccaagtcaaggaacgctgaacccatggatagaacgtcatataccaatctcgccaagtcatgggaatacgttgaggaccatgcgttctcccgccagtcaaccgacttgaatgctattcgcacccatgctgaagaagcaggcattccgcagggttcagcagcccaagccgagctgttgcgcatgctcgtgcatatggtgaatgcgacatcggtgatcgccgtcggcaccggttccgtggtggaaacgttgcagctggtcaacggtttggataattccggtcagcttacggcggttgattcctcttcccagggcattgcgctgattcgtacgttgtttaatcggctttccgacgagacacagaccacgcttcgcgccgtcaacgctcccgtcgacgtgtttttgccacgtctgaatgcagaaaactacgatttgattgtagttgccggcgacgcggaaaattacggcgcttccttcgagcaggctccccgcctgttgaagaagcatggcgtaatcgtgttcaccgatattcttgcttttgattcagccacgtccgcaggcggcgttttgaatcccgccaatcgtgacgccaaatccattgccatgcgtggtttgctggaaaccgtggaatccgatgagcgtttcgtcactgccctcaccccgaccggtacgggcctgctcgtagcagtcaaacgctagtatggccgttcccagcggcctaccgtttcctcatacaaaaagccgacactcacggataagtgatgagtgtcggcttttgttgtgtctggcgtatggcgcggaatgccatacgccggaacgtcgttatttgacctttggatgtgtgtcgatcatctggctgaccacaacggtgccgtcttcgagaacagattccacttccccagcagcatcctcgtcagcagtatgatgcttatgcttcgaggatgcggcagcggcaagctcaaacttcttggattggcggctcagcagaatgccggaaatcaccgccgcgactatggaaccgaccaacacaccgaaacgtgcttcagcagacagttcggcatcctgatatgcaagcgaggaaatcaggaaagatacggtaaagccgatgccacatgcgcaggccgcggggaacatgtcgcgcacacgcaatcccttagccattttcaatccggccacatgcgtggaaagccatgccgtgatcataatgcccaacggcttgccgaccaccagagccaccataacggcaacgacgaccggcgaaatgaacagggccaacgtcaacgattcaaaatgcacaccagtggcgaacaaggcgaaaatcggcagagccagcaacgcggaaaacggctgcagcttgtccgcatagcgttcggcgcgtggggttttctctccgaaacgctcatgagccggcgtgagcaatccaacaagcacgccagccaaagtaggatgcacaccagcttcgaacatcatcacccaagccagaatgccgacaatggccacggcaagccatggcactttgcgcatacgcaccaggaaataccatacgacagcgcatacggcgatgccgacgaaccagtaccatgcgttcaccgaagagaagaacaccgcgatcagaataatggccagcagatcgtccactgtggcaagcgtcatcaggaacgcgcgaatagagcccggcagcgctttggcgaacaaagcaagcacagccaaagagaacgcgatatcagtggccgtaggaaccgcccaaccatgagacatctcaccaaaggtgaaactcgttcccgaagcgatggccaacggatcggatccgaaaccggagaacaggaacaataccagcaggaacaacaccggaggagccatcataccgcccacagcgcacagcatcggcactgcagcagccttggggttcgacagcgaacctgtggcgagttcctgtttcaattccagtccgacagtcaggaagaacaccgtcagcagaccatcctgcacccagtgtcccaatcccatatcgatattggtgtagggaatggcgatgcggaaattctccaactcttcgaacgcatgcgccgtgaacggcagattggcaagcaacagacctgcgagggcgaagccaagcataatcagaccagatatgcggtcggaagcggctatgtatcgtattttcgcccagagtccctgcttacgttcggtcattgctctcccgtctgttgccgcgagtatccacggcccgccattcacttaagaaaagcgtctgcggtattggcatgcgcagacgcttcaatagcggttccagtgtaccgagaggtgtcggcgtttatgttttcaaaccgtctttttcactggtgtttacggttttattcggcatggcggcttttcttgtaccacaccgttcgctcggagagaaaccgaacgtatctcgacaacagccgctttacataagcattctggtaggtttgcgaatcgcattgactcgaacactattcacggcagcgccgccgttacttccagaaaaaaagaaagcctcctccgcatttcgcgaaggaggttcatgtgcgcgagacaggattcgaacctgcgacctgctgatccgtagtcagctgctctaatccgctgggctactcgcgcaacgttgcttgttttcggcaactcgaataagatacacccaaatggccgcgcagcaaaatctcggcgtgtcgcgcctgttttcgtggatttcgcaccggcatccatacttgcttcaaccctacgaaatctgaactctcgcacatacgacgcgcaacacgccgaatgcactacgcggcacgtctgcgaggaatctcctccgtggaaaccttcaatagtttcggagtgccggaaccattgacggacgcctcatccaccaccacctccgatacgccagtcacgcttggtagctggaacatcgtgtcctccaaggttttttcgataatcgatcgaaggcctcgggcgcccgtgcccctgcgaatcgaagtggccgcgatctgccgcaccgccccctcagtgaacgtcaacgtcaccccgtcaatcgcaaacaacttctgatactgcttgaccagtgcgttctccggtgcgaccagaatgcgcgccaaatcatcctccgtaagctcctcaagcacgctcaccaccggcaatctaccgatgaattcaggcaataaaccgaaatcggcaagatcgtcggccgaagcctgggcaagcagctcacgattcggcacctcatgatcatgccacgcggcaccaaatccgctttcacgagcgcccaaacgctgcgccacaatatcggcaagcccgacaaacgcgccgccgcagataaacagaatgtcacgagtgtcgatctgcaccgtctccatctcacgatgcttacgcgaaccctccaccggcacggatgccacagtaccttccaaaatcttcagcagagcctgctgcacgccctcaccggacacatctcgcgtaatagacgtgttctcgccgctcttacgcgctatcttgtcgatttcgtcaatatagacgatgccctgctgcgctcgcgccacatcgccgtcagcggcctgtataagccgttgcagtacggtttccacatcgtcgcccacataccccgcttcagtgagtgtggtggcgtcggcgatgacgaacggcacattcatgaccttcgccagcgtctgcgcaagatacgttttgcccacgccggtcggccccagcagcaggatattcgatttggacacctgcacgccggccagtggatcgtcgctcgcatgcgccgcacgatcgcgcaatgccgcggattcgcgcatttccatattgacgcgcttgtaatggttgtatacggccacggaaagcgttcttttagcggattcctgcccgaccacgtagttgtcgagataggcgctgatctgtgcgggtttcggcagctgcaatgtgttcagctgggcgtctttgacacgttcttcggaaatgatgtcgacgcacagttcgatgcattcgtcgcaaatggccgcacctgatccggtaacgagcttacgtacctgattttcggttttgccgcagaacgtgcatcgtgacacttcatcgttgtagctgaccactcgtcccattcgcacccctttgtttgccgtacctgccattgagcaatcgccatcatgcaatcatcattgaagaacagcatacccctgccaacgcccggcaggggtattgatttgtgaagatgcgacttcagatggaacctcgcatatgcgccgttcagctacggtgttccagcacttcgtcgacaatgccgtattccttggcctcaggtgcggtcaggaaggtgtcgacctcgatgtctttgcgaatcttctccacatcgcgaccggtatgcttggccagcgtgttctcaagccattcacgcatacgcagcatttccttggcttggatttcgatttccgtcgccttgccgaagccctgatcgatggccggctgatggatgagcacgcgcgcgttcggcagcatcagacgcttgcccttggctccggcggccagcagaatggcggctgcggaagcggcctgtccaaggcatacggtctgcacatccggcttgatgtactgcatggtgtcgtagatggcggtcatagccgtcatggaaccgcccggagagttgatgtacatcatcacatcacggttcggatcctggctttcgagcaccaggagctgagccataatgtcatcggcggaagtgtcgtcgacctgcacgcccatgaagatgatgcggtcttcgaacaagcgggtgtacggatcctgccttttgaaaccgtacggggtcttctcttcgaactgcggcagaacataacggttctgcggcgcgaaagcggcttcgcgggctgctgcagcctggaaaccaaccactccggtcggtcctgcgagacgctctgcgcgggctacgaatcgggattcttcgcttgccatgttcactctcccttggtggcgttcatcgtgtcgtgcgtggaaacgagcttatccacaaaaccgtattccagcgcttcctgcgcggtgaaccagtggtcgtactcgttgtcgcggtagatttcctcaacggtatggccggtctgttcggcagtcagctcgctcatggtcttcttcatgtccatgatcagttcagcgttgatgcgcacgtcggtggcggtgccgccgatgccgccggacggctggtgcatcagcacacgggcatgcgaggtcaggaatcgcttgcccttggtgccggagctcagcaggaactggcccatggatgcgcacatgcccaagccgacggtcgccacgtcaggctcgataagctgcatggtgtcgtaaatggccatgcctgcggtgatggaaccacccggggaattgatgtacagccaaatatccttcttcggatcttcagctgccagcatcagcatctgtgcgcagatgcgattggccatttcgtccttgacttcctcgcccatccaaatgatgcggtctttcagcagacggttgaaaatcggatcggcgggtccggccggcatatcttcgccggccatgacgggcaggggtgcactgaggttgctcaccttgtctccttttcctatgttctctatagtttcacagcctaccgcttcgaagcgacgggtggtgaaattgcgctcacagtggagtcttcacgctagaacaaaccttacttgacgatggtgttgtattcgggaacgcccatatagttgtagctcacttccacgtttttggccgatgccgcggtcacgttggtataccacaaaggaatcaccggcaaatccttcagcaacacacgttcgctctgccgatacaggctcacggccttgtccaaatcggtctccgcagcagcctggtcaatcagcgcatcaaattcgtcgctcttgtaatcaccattgttcaaacccttgccgtccgctgccgatgagtcgtatgcctgcaccagatagccttccggatgcggataatcggattgcatgcccgatttgaatgccgcgtcgatggtgcgctcctgaatggcgctgcgcagttccttggacgtggcgaacggatagctttccgcatcgatgccaagcgcgttgcgaatggaattggccgcagcctccacccactccttatcggtgccatcggcgctgtatgcgatgcggaacgttccgctccatggcgaaatcgcatccgccttcgcccacaattcctcggctttcgtctcatcatatgcgagcacgccatccgtgtcgagatcggtgtcatatcccttgatcaccggcgcaaggaaatcggtggcggtcgttaccgtgccaccgaaaatcgcattggcgatattctcacggtcaatggcatgcgcgatggcttgacgccgatacttgccttcctcaccttggaaatgcttgagattctgcgaaatcgtaaatgctgagaacgacggaccgggcttgctgacggcggtgatgttcttttcattctgataggttttcaacgcggaagtcggaatggcatcaagcacgtcaagattgtctgccagcagatccgaataggccgcgtcaagactttgatacaccttgaaatcgatgcctgcgttcttgacttcgcgcggccccttgtaggagtcgtctttttcaagaatgatttcttcgccgcttttgtacgccttcagcttgtacggaccgttgccaatcggcttttgcccgtattccttgggattcttaatgacttcggatggcatcggcagaaacgcgatatctccgattttgtacaggaacgccgaattcgacgctttgagcttgaccttcagcgtagtgtcgtcgaccacggtaaggcctgacaattgcgcggttttggaaccacttgcatcctgcagctcatcatagccctgaatatcttcgaaaatggaggctccgacctgtccattggcagcattggccgcgaacgaccagcttttcgcgtacgtgtcggcggtgatcttctcaccattggagaacgccagattcggtttaagtgcgatggtgtattcggaagcgtcgtcattcggcgtgatcgattcggcctcgaccaacgtctcattaccttccgcatcgaaagtgaccaggccgtcatacagctggctgacgattttccaaccggccatatcgctggtgtcacttggcagcaagccattcgatggttccgtgatattgacgctgaccaccttatcggcactggtgacttcctgctgggaatccttcgcctccacggatccacagcccgcaagcagcgcaactatggaaagcgccgccgtaatcggcttgagcagaccggtagtgatgccgctatacgggtgttgtagtctcattgctgtcctctcaataacacggtagagacagcatagcaagccgatattccttgacggaacgctttcctcactttacgctacaggctttttctatagcctgctattacgtttcgcaccaatacggaacgccgcaatcaagcaacagatggcaatggccacgataccaatcatggtagcgaacgtccagctgccaccgacagccgtagcgtgacggaacgtggcacccccctcttcgcctgcgccagcctgagccaccgacagaatcgtggagaacagcgcggtgcctgccgcgccgccgaactgcaggcaggtgttgaacacggcattgccgtccggcatgaactgaggtgcgatgttacgcaacgcattggtcatgatattggaaaaaccaagcgaataaccaaatccgaaaatgaagtagaaaccggcaagcgtgacgggtgtcagtcgcatggaaaataccagcagcagaatcggcccacaaatcgcggcgaaaaacgcgccgagaatcggacgcaccggtccgaaacggtcgtacagcatacctcccaccggtgcgaaaaacgcgccgatcagcgcacccggcagcaccaacgcgccggacaggaacgcgctggttcccaacgaaagctgcgccacattggtgatcacataaccgaaaccgatgccgacgatcggcagcagcatgtaggcgatcaaatgcaacaacaccatcgggtcacgcagccagcccaaacggatcagcggcgagaacgaacgcttcgacgaccagccgaaaaacagcaatgcccccaatccaacgatcagactcaccacggcgaacactgccgacaccgtggcgctgccgccggaaaccgcggcgctgacggccactccagcttggttcaggaacatcaccaatccgcacaatgcaagcacaatcgacacgaactgcaacgaattgagacgcgcctcttccgtcgggcgatgctgttcgacgcattttaaaccgaccggcaacgagaccagcagaatgatcggaatgacaatcacgaaaatcgcacgccatggcagaatgctcgacaccgcgccaccaacggtcggaccaattgccggagcgacggtgatgaccagcgaaccgacgcccatcaaacgaccgactttgctctttggcgactgttcaagaatgatgttgatcatcaacggcgtggccacaccggaacccatgccttgaatcacacgggcaatgagaatgaccgggaacgcatgaccgacaatcataatgagcgagccgagcacggcaagcgccaccgcggcaaggaacaacgtgcggtgcttgaaacgacggttaagatacgacgacaacggcatggtggccgcgaccaccagcaggtagatggtggtgatccactgcacggttgcggtgtcgacgttgaattcccgcatgagttgcgggaaaagcaccgtcatcacggtttcggtgagaatgccgatgaaggcgagggagccgaccgccacaatcgctccgatgagtttgccggggatgcgttcgtctgaaatcgccgcttcctgagttccggcgtttgtcgtaatcgcctgcgattcagtggctgcagttgttgtagtaatgttccgttcttccataattccttatccgcgcactttttcctacggccctgtgcgatgccgtctatgattcattcgtatgaaaaccactgtgtagtgtaatggaagccctgacctagatgggaacggcatgcgtaaggctggacgtaccatttcggcacgtccagccttacgcaaagggaatcagaaacaaatggtatgaactggagccgttcctcctattctttcttgttgaaggcggtgaccgcacgctgcagcaccacgaagatcaggatcatcaggccgaccacgatggtggtccattcggccggcacgccgaagtcggaggtcagcgggtcgatggtggaacgaaccagagcgccgatgacggaaccgagcacgtagccgaagccgccggtgacgatggtgccgccgatgaccacggaggccacagcatcaagttcccagccgacgccgaccgtgttgatggaagagcggatgttggccgtgtacacgatggaggcgatggaggccagtgtggcggaggtcaggtagatgacgtactgcgtgcgcttgaccggcaagcccatgagttccgcggaggagcgcgagccgccgatggcgtagatggtgcgtccggtgcgtgtatggtgcagcaggatgtacccgaagataaccacgagcgccgcaatgatcacaccgacattgatgtacagatcttgggagatcttcggattgtcgatgatggtgatcttctgcgaaatgaaatcgaagttgttattttcggggaaggtctgcgccttggtcgaaatgatggatgcgatgcctcgcgccaggaacatcgaagccagcgacgcgatgaacggctgcatgttgaattcttcgatcagggtgccggtcaataggccgaacgccacgccgatgagaatcatgacgaccatggcgagcggagccgcgacgcctgcgttggtgagtttcacaccgacgaccgcggtgatggcgacgatggcgccaaccgacagatcgatgccgccggtcaataccggaagcgtcatagccacggccagaataatcaggtaggcatggtcgatgaacagggacgacacgaatccaagacgcaggtaggtgccgaacagcgcctgacccatgatgatcatcagaatgaagatcaccactgctgcgatggttggaatcatctgagcgtcaagacgacgccgagtcggtttcacggtcttcttgacctgagtagctgttgcagaagtcatgctgccaccgccttagtttgcgtcttcagcgcgcacttacgttttatttccgcgccaaggttatgaatcttcggagcctgcatcacgcagatcacgatcaccacgacggcgaagaatgccggtgttgcggcggaatcgataccgagggtgatgatggtcttgcggatcatggcgatgatcaccgcgccaagcgcgctgccagccagggagaacttgccgccaagcagcgaggttccgccgataacgactgcgaggatggcatacatttcaagatcctgcccggtcttgaccacgtcgacgcgcatcacggatgctgtggcgaacaggcctgccacggctgccagaagaccggaaatcgcgtatacgaggaagaggatcttcttcggcttgatgccggtcatgcgggaggcttccggattgatgccgacggattcgaccatcatgcccatggccgttttgcggcacagcaggccaatcagcgcgacaatgaccaatgcgatgacgaaattggcgggaatgcccagaatgaagccgttggccatccatttcagcggcgcgccgcctgcaacggagctggcatcagtgttctggccggaagtgatgaccttggccaatcctcgacctgcgagcatcatgatcagcgtggtgatgaacggctgcagtcccagaatggaaaccaatgcgccgttgatgcagccgacaccgaggccgatgagcagtgcgaggaaaatcgccagccacacgttaacgccggaagtcagcatctgcatggccgccgcaccggcaaccgccataacggaacctacggaaaggtcgatgcctgcagtggagatcaccaatgtcatgccggtggcgatcatgagataacgcgccgattcctgcagcatggtgatcagcggtcccgaaagacctccggtgttcttattccagctcaacgagaggaattggtgatcggagatggtgcagatgacgatcagcacaatcagtgcgaccacagaccatgtgaggtttgacgacagcagcttcttgacgagggaatcgccgtcctgctttgttttcttgtcgctcatcatgcctcctttcctgtattgacgttcgtgttcgcgatggtttggacgatggtttcctgggaaaccgtgttgtcattgacgagttcggcgatcttgtggcgatccttcagcacttcgatgtcgtcagaaagcctgaccacctcttccatttcggacgagatgaacaccacacccatgccctgagcggcaagatcaagcaccacctgctggatttccgccttggcgccgatatcgatgcctcgcgtcggctcgtccagaatgagcaggtcgggatgcgtggccagccaacgtgcgatcagcaccttctgctggttgccgccggacaggttcttgatgagcttgttcggatcgttcggacgaacgttcagctccttcatgtacttgtcgacgatctcgtcggcttccttcttcggaatcggcttgaacatgcctctcgtcgcctgcaaggcgatcagaatgttctcgcggaccgtcagatcgccaataatgccttcgtctcgacggttctccgtggagtatgcgatcttgttgcgcaatgccgtgtacggatcggagatactggtcttcttgcctttgagctcgtacgtaccggaatccggcttgtccgcaccgtacagcagtcggccgagttcggttcgtccggatcccaacaggcctgcgaagccgacaacctggcctgggtagatatctaggtccgtaggattgatggtgcctttcagaccaagctgcttgacggagacgatgggctgttcaccttcagtcacgtcacgatgcgccttcttggcgccgatctggctcagctcgtccgcgctcttgccgatcatcatgccgatgagctcgtcacgcggagtgtccttggtcatgacttctttgatgaacttaccgttgcggagcacggtcaggcgatcggtgatctcgtaaatctggtcaaggaagtgggacacgaacaggatcgccacacccgaatcacgaatcttgcgcatgatcttgaacagatcctgcacttcgttggcgtcaagcgatgacgtcggttcgtcaagaatcagcaccttggcatcgatcaccatggctcgggcgatggcgaccagctgctgcatggcgatggaaatggagctcaacggtgctctcggatcaagatgatccagacccatctgggcgaggaatttcttcgattcctcataggttttcttccagttgatgcccagcgtccctcgcacctcatgaccaagcatgacgttttcgccgatgctgagattggtgcacaggttaacttcctgatacacggtggcgatgcccgcgttctgcgcatcaccggtaccggtgaaggtttgcggcttgccttccacttcaatggaacccgcgttgatcctgtacacgccggtaagcgctttgatcatcgtcgattttccagcgccgttctcgcccatgagagcgtggacttcacctggatacagacgcaggtcgacgccgtccagggccttgacgcccgggaactcgatcgtgatacctttcatcacgacgattggttgcttatctaccatgtcttcgccttacgaaaattgttatcgttttgtgatatttgcccaagatggaacgaacggtgcatcgcgctatgcggtgcaccgttcttgggctatgtgaaaaggagagatgctattcggaaagttatctgatcggatcagtacgcacgggtaccggcatccaaggcttccttggcgctgtctgcatcgaaggtcttggattcgatctcgatatcggattcaacagacttgccatccagataatccttgacggcgttggcggtttccttaccgaagatcgggttgtactcgatgacgtaggaaagatcgccgtcgaccagagactgcagagcggccttggtgccatcgatggtgatgatcttgaccttgcccttcagaccagcggcatcaacggcctgtgccgcgccgagacccatctcatcgttctgggcgaagatgaactgcggattgtcggacttgtacttgtcgagcagacctgctgtcacggtctttgcctcatcggtggaccagttggcggactgggactcaagcaccttgatattgcttgctgccttgttatcccaaccggtgccacgatcggtcaccacggacaggcctgccggtccttccagaatgaagccgttggcgccatctgggaagctcttgttgacgaattcagcggccttctcgccggcccagacattggacgggccgatgtgcgagacgactgccttctttgccgcatcgctcttgatatcgatgttgcggtcgacggtgaagaccgggatttcagcttccgccgcgttctccaagcagtcatcccaaccggaatcgttggttgcggatagcacgatcgcgtcgacttcgtcgttgacgaacttgttgaatgcctgaatctgcttctgctgatcgttgttctgcgtcggggagtacaccagatcgaatccggcatcctcgaatgccttcttcagatcgttctcgttggccgtacggaagccgccttccggaccgactgccacgaaaccgatggtcttcttatcgctcttgctggagctggaatcgccatcggagctgccgccaccgcaggccgccatgctggccatagctgccgccgaagcacaaatcgcaatagctttcttccaattcttcatgaaaactcctcctcgagtatttctattgatgggcttccttgccatcagtgttttcagtatcgttcgaacaatccaaggtctcaatccatagcaataacgtttcgataacaagtcaataacgaaacgataacaatggcggaattacaactttttcactattgcacagataacgacgtaacttgggaatcagcaatcgtccatgcaccatccaacgatccgtcgaccgttctcgccactccgagatggtcgagtacgacaagcctgcgatatgtgccgacttctcctgtggccatatcgaccgcaccattgtcgggtagcgcctgactcgtttcaggaccaggcaccatctgacgtcgtccgatctgcgcacgcccccgctcgtattgcgtggcatagagaaaagtgacgtcgttatagaacgtcatcatcgacacattggactgtgtggaaaccaaagcgaacgcttgggacagcccagccacggagccatcatggtcccggcatatcccgatgatggccacacccgactgcgctcccccatccgattcgatggagaatgcgatacggtccccctcaggggaaagcctcatggaatggagcgtttgtgctgatacgaggccgggaacgtcaagggtgagaaccgtgccggcatcatcgaccatgatgtgcttgccagatgtgtcgatgccccaaatctcggagtcgtttcctttgcagatggttttcatcatgcgtcctgaaaacatcaatgcatgggtggaaccgtcctctgcgagccttttcacatatccgtcacgaccaagcacggctccgccctgtgctgagaaaacgaagcttcgcacgtccgaaagatccgtttgcgccacacgaatggcgctgtaggatttcaacgacacgatattgccgacgctcaacgtatacatgggattcagcggagtctgcgcatcaagagacgacgaatcatcggcatgcgaatagtcatggtttccagacatcaccttgatttccgtctcggcgctgccgtcccccaacgataggcgaatctgcctgaccaaaatgccacgttcggcatccgtcattcgttccatcgccgatgagagactcatttccatcaccgaatcgcgcatctgcacaccgtcgggctgcaacacgatccgcttggtattggtgtcgcttaccgcgccttccagccatgccgcatttccggcaagcagttcctgcacggcgcgcgtccgccaatccctccagcaaagccaacgaacatcggggatcagttctttttcggaagagcccaactgatatagcgaaacctgacggtacacctgctcgaaatcgtaggagctgatcatcacgcctgtcggcagtttgctgatccgccattggccacgcactttggagagggagaaatcgtaggtttttgcccctccgctcgccaccgccgtatacacgccatgcgcatccagttccccttgtatctggaggctgacgctcaccacggttttctgcccgccttgccctgactccaccgtgctggccttacgcacgaatttcggcacgtcggcatataccgtagtccggttatcggcattccaccttgatgcggcgccatcggtaaggaactgcttgcccgtggcgaacccgtcactctgcactcccgcaggcatgacgtcgaaaaatcctttgacgatggcttccggctgcgcgtcatcggccggcccgtcgggagacgtgaacactcttcttgtgctttgttcctccggggtcatggtctgcaccggaccatcttcaggaagtcccaatatgctcgagcatccggccagatgcatcatggagcatcccagcaataccactaatgagaccgcggcaatcacacgacgaatgtttttcgcagtcatcacagcccctccaccatgggtttattggtcagatagtccacgaatccgttatcggcaacgccaaagcctccgaccacccgcatatcgtcgccatcggtcgcgaatcgaatcggagcgttgttcataccgcaatcgacatcgtccggattgcgaggcaacgtcaccaaaaaccatgttccttcacccagccgcgatcgcaccgcaacatcaccatgatgcagtttcgtgtcagccagtacgatggacatgcccaaaccggttcctccggtagtgcgcgctctggaaggatccgccctccagaaccggtcgaacattctggaacactgttccgaggtcatgccaacgccgtaatcgcgcacgctgattactaccattcgctgattggcggcaagacggacctcaaccggcttgccctccgcgaaatcgatggcattagcgagaagattgcgtacgacacggcttatacgacgcgtatcgattctcacaagcacttccacgttgggcatatgcacatccagtggcacatgtttggtctgggcgatggcggaaatcgcttcaaccgactgttcgatgggctcgcgtatatcggcctccaccaaatcaagcgccgcatacccggcgtcgaaacgcgaaatctccaacaaatcggcgagcatttcctgaaatctgcggatctggccatccagcaattccaccgttctctttgtggtggcatcgtattcgtctttgtgcatcgacagcatgtcggcggccatacgcatggtcgtcaccggtgttctcaattcatggctgacgtccgaaacgaagctgcgttgcatatccccggctttttccagctcttcgatctgattctccaacgattcggccatttcattgaacgatttctgcagcacgcctatctcatcggccctgtccaccgccacgcgggcgtcgaaagttcccgatgccatgatttccgtagccaaggcgacccgccgtaccggagtgataaccgaacgcatgaccagaaaaatgatcatcccgatcaacacgctcaacgccacgcacaccatcagcatgttgatctggatctgactcagcgcctgctgctgcgattggtaggagtacagtgcgaacacttccaatgagcccatgttattcgacgaaatcaccgatcccaaaaccgcgccgggcgtacctccggaagttctcggaatacgtaccggctgatagtagatcaatccggacgtatcggcacgcatgcggttgcgcatagatgacgacaccagatttgaatattccggctccgtcgataccggcacgaatccacgctccgcagaatccgctgcatcacgttccatcaggtacacgccgaccagattgctcgaaccattgctttgcaattcggacgccagattgctcactaactgctggtattggtccgttccagttagattcgaggcattcagatgcttctggacgcgcacaatctgcgatgagaaatcgctgcgcgagtcatccgtcgcctgcttcagcacggatcccctgatgacgtacatggaaaacaaagacagcaacgcggccgtcagcaacaccaccagcatcgacacggccaccgttctcgcctgcaatgatcggcgcacctgctgtctgtcacgatgccagatacaccacactcgatgggttctcatcagcatggttcgcttataccgtcggggctacgaacttgtatccgatcccgcgcacggtctgcacgatccgcggattctccggatcggtctccaccttcatgcgcagccgttgcacatgcacgttgaccaatctggtatctccgccactttcgtatccccaaacacgtttcagcaagttcgcacggctcagggcttcacccgcgtgagccgccagcacgtacagcaattcaaactccgtcggcgtcagctgcagatccacaccatctttggcggcggtatgctcagccctatccattacgagcgtgccgcattgcaatcgttcagtcaggtcgccctcatccttgcctgcaggcgcgtttaccttgggcatgcgcagccgagccctgattctggccataagctccaccacctcgaacggtttggacacataatcatccgcccccgcttccaggcctttcaccacatcggtggtgtcggatttggcggtaagcatgatgatcggcgtattcgagttctgccgtatgcgttgcgccacctggacgccatccaaaccggggagcatcacatcaagcaacatcaaatccggctgcaatatcgggaacatttccaccgcacgccacccatccaagcaggtcacggttttaaatccttcgctctccaatacgatggatagcatctcgcccaaagcctgatcgtcgtcgacgatcatgatcaatcgttgattagactcatcctgcatatttcgcattgcttcgtcattcccttcaacactgcgtccaagtttgcccagactcgccctccacgttgagcacgaacgtatgttaacgttcactaggtcagcattgtacacggatatgggtgaactcgtcagcggcgggaagaaacgatcagcccctatcaccgttcttctcatgcaggattttgcgaattttctccagtctcggtttgatctcatgctcgtagccgcgatcgttcggatggtagtattcccgccctgccagctcgtccggcatgtattgctgcggagccacggctcccggccaatcatgagcgtaccgatacccctcatgattgccccaacttttcatcagggcggtcggcgcattccttaggtgcaagggtacctgaccgatcaatcccgcgtccacatcggcgagcgcgctgttgatggcgttgtaactggcgttcgacttcggagcggtggcaacggcgagcgcggcttccgcgagaatgatgcgcgcctcgggcatgccgatcatggacacggcttgtgccgccgcgacggtgacctgcagtatctgcggagccgccataccgacttcctcggaagctgcgatcataatgcgccgtgcgatgaatcgcggatcctcgccggcgcgcaacatccgtgccaagtagtgcatggtggcgtccgggtcggatccacgcatggatttgatgaatgcggaaatcacatcgtaatggtcgtcgccgtctttgtcatagcgcacggtggccacgtccatgacctgcgataccacgtcgggagtgatgattggccgtttcgtaccttttttgcgtgctttgtctccggtaagcgcccccgcggcggcttcaaggatcgtcagtgtttttcgcgcgtcgcctccggccatacgcacgatttcgtcaacggcttcgtcgttgattttgacttcgtttttaagcccacgctcgctttcgatggccctcttgatgagcgttttcaggtcgtcgggttccagcgattcgagtttgacgaccacggatcggcttaacaacggtttgatgatggaaaagcttggattttccgtggtggccgcaatgaaagtgacgtcacggttttccacgcttggcagcaatgcatcctgctgcgatttggagaatcggtgcacttcgtcgatgaacagtaccgtttccttgccctccgcgacaagacgatcatgggcgcgtctgagtacatcccgcacgtccttgacgccggaggtgactgcggaaagctcttcgaagactcgaccggactgtttggccacaatataggcgagcgtggttttgccgactccgggaggtccaaacagaataatggaactcggcgcggtcagcgagcctttggacgccggattggcgagtctgcgcagaggagagccctgtcctagcacccgcgattggcccaccacttcgtccacgctcgacggacgcatgcgcacggccagcgggcgtgtcatatcttcgggagcgtccatcgcaccaaacaaatcctcagtcataatttctactgtaccgcaacatacgcaataattcgaacacacgttcgacatttgagttcatgccagccgctagactggcaatcatggctgacgatacgaattacggttctttgggcgccttggcgccgaattggagcgatggcgagcgcaacatcgacacggacgagatctacgaacgctttttcgagtgggtggcggacgtcaaaggtgttgagccgtggccccatcaggaagaggccatcatggacctgctcgcgggcgatcatgtcattttgaacacgcccaccggctccggcaaatcactggtggcgttgggtatgcatttcgctgcgttgtgcacgggccgtcgctcgtattacacggctccgatcaaggcgttggtgtctgagaaattctttgatttggtggaggtgttcggtcgtgagaacgtcggcatgatcaccggagacacgcacatcaacgccgatgcgccgatcatctgctgcactgcggagattcttgcgaaccaggcattgcgtgagggccgtcatgccgatgtcggctgtgtggcgatggacgaattccattattatggcgattcggagcgtggttgggcttggcaggttccgctgctgacattgccgaacacgcagtttttgctgatgagcgccacattgggcaacgtcgatgcaatcgccgacaagttggaggacatgacggacacggacgtcgacatcatcgccgatgcgccgcgtccggtaccgttgacgtacgagtacacgcttgacccgttggagaaaaccgtcgaactggcgttcggcagaggggaaacgccgatctatgtggtgcatttctcccaagacgccgcattggagacggcgaacgccctggcgagcacgggagtgtccagcaaggagcaacgtgcggccattgcggaggcgatcaagggcacgaagttcaccacggcgttcggtaagattctgcagcgtctgctgcgtaccggcgtgggtattcaccatgcgggcatgcttccccgctatcgccgtctggtcgagcaactcgcccagcagggtcttcttccggtgatctgcggcactgacacgttgggtgtcggcatcaacgtgcccattcattccgtggtgttgaccgcattgaccaagttcgatggcacgaagatgcgcaagctgcgtgcccgcgaattccatcagatcgcggggcgtgcgggacgtatgggcttcgacacggagggcttggtcatcgccgagggtccggaattcgaaatcgagaacgccaaggccctcgccaaagcgggcaacgacccgaagaagctcaagaaagtcaagcgcaagaaggcgcctgagggcttcgtcacgtggaatgagagcacgttcgataagctgatcgacgcggaccctgaaactttggtgccgcatatgaaggtcacgcattccatggtgttgaacgaagtggcgcagggcggcgacgcacgctaccgcatcgatcgcctgatcgacgattctgcgcagactccggaacagaaggagcgtcttcatgatcgtgccgacgagatcttccagaccttgttcgacacgaatgtgatcgaaacgaaagaccgcgatgatggtggcaaggactatttcatgaccgtcgacatgccggatgatttcgcgcttgaccagccgttgagcccgttcctgctggctgcgttggaactgcttgatccggaatcggaaagttacgcgcttgacgtgatttccatggtggaagccacgttggaggatccgaagcaggtgttgcgcgcgcaggaacgtcaagcccgcgacgcggcgatgatccgcatgaaggaagacggtcttgactatgacgaacgtatggaccgcttgcaggagatcacgtatccgaaaccattggaagacatgcttcaggctgcgttcgacgaataccgtcacgatgtgccttgggccaatgattattggttgagcccgaaatcggtgatccgggacatggtcgaaacggcctccgatttcaccggttacatcgcgcgctacaatatcgcccgctccgaaggcacgctgctgcgctatctgtctgacgcatatcgcgcgttggcgcgtaccgttcctttggagaagcgcaacgaacagttacgggacatcatctcctggctgcgcgttgtggttcgttccatcgactcctcgctggtcgacgaatgggagaacgcgggagccggcaccgacgcttccgaagccgccgcgaacctggccgcgcccggcgcgaagcaggccgtggtggaggatcgtcgaggcctcaccgtgctcgtgcgcaacgccatgttccgccgcgtgcagctcatggatctcgacaaacccgacgagctcggcgcgcttgacaaagactggggttatggcgtgcacgaatgggaggatgcgctcgacgacttctacgatgagcacgaatacgtcaacacggatgcgaaggcccgtagccgcgaactgttcatcctcgacgattccaaggagaacagcgagcacagttggaaggtacgtcagatcatcgacgattccgatggcgaccatgattgggccatcaccggaaccgtcgatttggacaccacacagtcgagcggcgaagtcgtgttcttcgactacagcgtttccaactgacgtcgcatctcgtcggcgtcgacttccaggggcggccagatcatgttcatgttcttcaatacgttacggagcagttcagacacaaccgcccttgaataccaacgattgtcggcaggcaccaggtaccagggcgcctgctcggtgctcgtacgcgcgaacacgtcctgccatgcggccatgtagtcgttccaacgggcacgcgcttcaaggtcgctggggtcgaacttccaatatttggtcggatcctccagcctgccgaggaaatgctccttctgctcttctttgctcaccacaaggaatattttgatgatggagcatccgtccgcaaccaattgcgattcgaatcggttgatttcgtcatatcgcgcctgccatacctcttccggataggttttgtaaatgcgcggcatgacgatatcttcatagtgcgatctatcgaaaatggagatccaaccattctgcggcagttcccgtttgatgcgccacaaataatcgtggtccttttcctcgcctttgggagcaccgaaaccgtgataatgcatgcccatcggatcgccctggctgaatacgtgacgcacgatgccgcctttgccggaagcatccatgccctgcagaataatcaacagacgacggcgggaacctttcactccattggcgtacataagccgctgatatcgtgcgatttcagaagaactgatcgcaatgaatcgttccgcatcatctttgttgccgtcgaaacccggcgtggaatcgccatcgattgcagcgaccctcgtatcatgatggaatcgcaataactgactgggcggaagcgtccacacggaactgagcaactcgctggccttggcaacattcgcaagcccttcggcaacggaactgcagttctcccccttctcaagcctgtcctcaaccttgttcaacgtcttcgcaatggacgacgtcttcgcatccttgtctttgtctgacatgtcaagcctcctcgcttgtcccctatgatagacgatgcggcgattgaaccgtggcatcgccgcacccaatcgccgcatcccgcttttctgacgttttgtctgacttctttcacgcaatagggcgctgattcctcgctctttgcaagaaaccagcgccctatcggtcttctcagatcaaatgacgtcactgcttgggcttatcaccctttgatttgtctgacttcggcttgtcgaatctcagcttgtcctgcttggacgtatctttgatcggcctgccgttcttatcgaactcgacttggctttccggatgcgtctcatcgaatccctgaacatagcgggtctgacgccaatggcgaatcgacgcgttggaaccacgatggtgcacatggtacaggcgctgggcaccgccaagtggcacaccttccctagccacggcgatctggttcacgttcgacggatccataatggcgatcggagcgaccggttccggttcggcaggtgccgcagtgtgcttctgcatgcgttccggcagccattccgcaagacggctcagcagccagcatgcgatgaagtagatgacggcagccacaaccaatgtctgcagaatattgaagtacatcgaaccaagtcgacgcgattcctgcagcaaatcggtgtacatgatgatcgagccgagagcggtatccttcagtaccaccaccaactgcgtcacggcggcaggaagcatggcgtagatggcctgtggcacttcgatttccatcagcgactgcgtgcgggtcaagcccaaggcgagcgacgcctcacgctggccgttcggcaggttgccgacaccggaacgaaccagctcggccaccacggaaccgttgtagatcaccaatgcgagcaccacagcccagtatgcggggcttgacatgcctgcgaaagcgaaccaacgccagaagaagatcatgagcagcagcacagggaccgcacgtgcgaactcaacgatggcgccggaaaccgcacgaatcacgatattcggcagcagacggccgataccgaaaatcagaccgaacagcactgcgccgatcactgccaacacggaagctcgaatcgtggcccacaatccgggcagatagaaatcggtccatgcttcagcgtcaagcgccggcttccacaactcccagctcagctggttctcgccatccggcggattgtgaagcctcatgagaatgagcacaactacgattgcaaagacaatgccggcaatccagttgacgatacgaatggttttacgggtcttaggaccgggctggtcgaacagcaccgcgctttcatcgcttgccatggtgcgtcacctcctcaccgcgagcttgttggacagatacgtggtcagcatgccgatcggaatgatcagaatcacataaccgaatgcgaagatcaggaagatcggaacaatcacgtcggaacggtattcgatcatttcgctcatcaacgacgaggtttcggtggcgacggaagccgcggccgcaaccgtggaattcttcagcaatgcgatcaacgtgttgcccagcggtgccacggagccacggaacgcctgaggcagaatgatctgggtggcggactgcatgaagttcaatcccagcgcacggcaggcttcagcctggccaagcggcacggtgttgatgccggatcgcagcgattcgcacacgaaggccgccgtatacaggctcaaaccggtgacggcaagccagaagaagttggtggcgaacgtgtcggagaagctgagcttcagctgcgcgtaggcacccagcaccatgaacaccatgatgatggtcaacggcaggttcttgaacagctcgacgtaagcacccgagaccatacgcagcgacgcgaccggcgagatgcgcatcatcacgaggatgacgccaagaatcgtggagaacaacgccgaccacagggtcagttcaatgttcaccaagaacgcagccggcacattgtactggctgaacaatgagatgaacgcttccattatctctccccctcagtcggctccggcggattgtacttcgcgttcggcgtgtatgcggtgcccttcgtgttgtcggaaatggcacgctgccaagaaccatcctggatcatatcggcgatggcgttgttgatctgggtggccagcttcgtatcgcccttcttgatgccgacgccgtaatactcctgggtgaacggcttgccgaccacgcgcagacggccgcgggacgcggaggcaagaccagccaaaataatgtcgtcggtggtcaccgcatcaacaatgccagagaacagtgcggtagcgcactccgcgtaaccaggctgctccatgagctgcacttcgttggcgaacttctccttgacggtgaccgcggaagtggaaccggttacggagcacagacgcttgccattaagatcctccggaccattgatggaggtttcatccttacgcacgagcagatcctgacccgcaacgaagtacggtccagcgaaggagacgaccttcttacgttcgtcggtgatggaatacgtggcgacgatgaaatcgacatcgccattctgcagcatggcctcacgctgcttcgacggtgcctccttccatacgatctggtcttcggaatagccgagtttcttggcgatgtacttggccacatccacatcgaagccgacataggtgccggacttcttgaatcccaaaccaggctggtcgaacttgataccgacgcgaatcttgccatcggcgtcgtccgcgccacaggcggacactgcgaacacgcatgcgcatgcgcagaaggtcgctataaccctgcgtagcatacgcttcgccctcatagaaagtctcatatcgaaaatccttcttctgtcttattcccgtcagtcatttcagtgggtgagaatcttcgacaggaagtccttggcacgatcggtcttcggattttcaaagaagtcctccggcgtgctctgctcaagaatctggccgtcggacatgaacacgaccttgtcggccaccttgcgcgcgaagcccatttcgtgggtcacgcacagcatggtcatgccttcgtgagccagctccaccatgacgtcaagcacttcattgaccatttccggatcaagcgcggacgtcggttcgtcgaacaacatgaccttcggctgcatggcaagcgctcgggcgatggcgacacgctgctgctgaccgccggaaagctgcgatggcatcttggaagcctgcgaagccactcccactcgggagagcaggtccatggcgagatcctcggccgccttcttatccatgtggcgcaccttgatcggcgcaagcgtcacattctcaagaattgtcttgttggcgaacaggttgaacgactggaacaccatgccgacctcggcacgcaggctggcgagctccttgccttcctggggcaatggcttgccatcaatgcgaatatcaccggaatcaatggtttccaaacggttgatggtgcggcacatcgtggacttgccggaaccggatggaccgacgatgaccagcacctcgcccttcttgacggtgaggttgatgtccttgagcacatgcaagtcaccgtagtgcttttcaacgtgggtcaattcgaccagcgggcggtcgctgtcttccgtacccggcatgatcgggcgcgtctcttgcgtttctttgatatctgtcatacggatagtatatgaaagccatgtttccgcggccgtcaccaccccctgacgtgctcgaaatatgagacaacgttgtcccaaaatgcatcatagcgcgttatcgaccgcaataccgatatcttgagcgccgtacgtggcagctaccaccatcgtggcaattcgatagccagcaccgctattacgaacaatacaaccaccgcaccgaacaccactcgttcgggcaccttggatttgaaaccatccacaacgcgacgccacgtatcaccaatgctcatgcataccaacgtaggaacgccaagcaacgagaaagagccgaacaggcgaacgcaagatgaatttcaccctacattcgcctgtcttttacatgcagattcgtatgaccatccgtcacacgatcgcagcatttcatccgcgatcagcgattaagcaatcgccggggccaagagagcactcagagcactttggaaaggaacgtcttcaatcgttcgctctttggatggttgaagatctcgtccggagtgccttcctcctcgatcacgccggcgtcggtgaagatcacgcgggtggccacttcgcgggcgaaacccatctcgtgggtcaccagcaccatggtcatgccgtcttcggccagctcacgaatgacttcgagcacatcaccgaccatctccgggtcaagcgccgacgtggcctcgtcgaacagcatgaccttcggacgcatggccaaggatcgtgcgatggcaacacgctgcttttgaccgccagacaacgagcgaggcatgacatcggccttttcggccaatcccacggttttcagcaatgccatcgcatgttcacgcgcctgctcgtcggtttccttgtgcaccagtttcggcgcaagcgtgatgttgtcaatcacgctcatgttgttgaacaggttgaaatgctggaacaccatgccaacctgctctcgaacctggtcgatgttcacatgcggatcacccagatcatgaccgttgaccacgatctggccgctggatgcctgttcaagtccgttcaggcaacgcaacatggtggatttgccggcaccagacggtccgatgatacagatcacctcgcccttgcgtaccgtaagatcgacgcctttgatgacttccatatgaccatagtttttatgcagattcttgacgtcgatgatcacttcgccatcattgttgccgtgattgcagttctcgctcatcgattcaccttcctgtcaacgatattggccagccatgtgaggatggtgatggccacgaagtacatcacaccgacgatcagcaacgtttcggtgacgcggaagttcgccgcatacaattgctgcgcctgatacagcaattcaccaaagccgatggccagcagcagcgaggaatctttgatcataatgaccagctggttgatgatcgacggcatggcgattgcagtggcctgaggcatgatcacgcgcgccatggcctgatgatggttgaggccaagcgatcgtgctccctccatctgaccagagtcaacggactgcacggcgccacgcacgatctccgccagatatgcgccggaattgagcgacaacgtcaacgcacctgcaacccaaatgttcacactgtgtccgataagctgcggcacaccgaaatagaagaagaacgcccacaccagaatcggagtgccgcggaacactgcgatataaaccttggacacgcctctcagaatcttgttctccgatactttcatcaagccgaaagcaacacccaacgccagtgcgatcacaaacgacagcaacgtgatcaacagcgtgttcttcagaccagtcagcaaagccggcatcgactgtttgaccagaccaaagaaaccgaccttcttctgcgcctcaccgtcggcaccgttgtcggtgaccttgccggaaatcgcctcgacctgttccttcgcgccatcggcacccaaatactgtgcgacaatcgtctcatactcgcccgaagcgatgagcttgttcagaccatcgtcgatggcggccagcagatcggcgttcttgcctttgttcacggccatgccgtattcaccatgcggcaccttcggagtcacgatcttcaaaccgttgttttgggaaacaccgtaggcaagcaccggatagtcgtcgaacacggcatccgcattgccggatttgaccatctcatacatggttgatgactggtccacggaagtcacggtatagccgtattcgcttgcatgctgtttggcgtaggattcgccttccgatccggttttcgcgacaacggtcttaccgtcaagatccttgtagctggtaatactatcgttgttttcagcgatggccatctggataccggactggaagtaaggattggaaaaatcgtaggtcgccttgcgttcgtcggtgattgacatgcctgcgatcaccacatccacctgattggagctcaaagcctgcaatgctgcattgaaacccaatgattggatggtgacttcgaatccttcttcttgggcgatggcacggatcagttccatatcgataccggtcatcttgccgttctcgcgatattcgaacggtgcgaatgtggtatcggtgccgaccgcgtaggttttgcccttgactgcggagggatctccgacttcggcggcgttagcactaactggggatgcgatgagtgcactcactgccacaatcagtatcatcgccaacgcgagaagtcgcatccagacaccatgaaaatcatgtttttccaacgattgcttcaaattcatactacagattcagttctttctcataatatttcagatactcatctttactccaccataccggcagcaagagaaaatagacagcgtaaacaataaaaacaggctgtccttgcacggtctctcatgcaaagacagcctgttatctcaaagcgaaaacactatcagtcttcgtcttcttccggatcataatcaacgccggtttccgcacgctgttcgtcggaaatcggagccggggcgccggtcagcggatcacgaccgccgccagccttcgggaaggcgatgacgtcgcggatggagtcggcgccagccaggatggcggcggtacgatcccaaccgagagcgatgccagcgtgcggcggagcgccgtacttgaaggcttcaagcaggaagccgaacttgtcggcagcctcttcaggagtgatgccgagcacatcgagcacacgatcctgaatgtcatcacggtggatacgcacggaaccgccgcccatttcgttaccgttgcacacgatgtcgtaggaatcagacatggcgtgttccggatccttgtcgaaggtgtcgatccaatccttggacggcatggtgaacggatggtgcatggaggtccacttggagtggccgactgccacatcgtcgtcatccggatcgtcggtgggcttgaacagcgggaagtccacaacccaagtgaaagcgaagtcgtccggcttgagcagaccggcgcgatcggccagttccacacgcacggcacccagcagctcctgagcggaggtgcgacggcctgctgcgaagaacacggcatcgccgtcttctgcgccaacggcttccttcaggccagcgcgctcctcttcagacaggttcttggcaacaggtcccttgagctcgccgttctcagcgaacaccacgtaggcgaggcccttggcgccgcgctgcttggcccaatcctgccaagcgtcgaactggcgacgaggcgtggccgcgccacccttgaagagcaccgcaccaacgtacggagcctggaacacgcggaacggagtgttcttgaagtagtcggtcagctcgatcagcgggttgccgaaacgcagatccggcttgtcggagccgtacttatccatggcttcctgccaagtgatgcgctgaatcggcagctggatctcatagcctgcggacttccagatggcggcgatgaccttttcggccatggccatcacgtcttcctgatccacgaacgccatttccatatcgagctgggtgaactccggctgacgatctgcacggaaatcctcgtcacggtagcagcgggccagctggtagtagcgttccacgccggaaaccatcagcagctgcttgagaagctgcggggactgcggcaacgcgtaccaagaacctggcaccaagcgggccggcaccacaaaatcgcgagcgccttccggagtggacttgatcatggtcggggtttcgacctcttcgaagcccatctcttccagagcgtggcgagcagccttcgacatctgggaacgcagcttcagattgcgctgcatggacgggcggcgcaggtcgagataacggtacttgaggcgaacttcctcgcccggcagcttgttctcggactcgttttccaacgcggtggacacctggaacggcagcgcgtcagacttggcgagcacctcgatgttttccgccacaacctcgatcttgccggtggccagatgatcattctcgttaccgtccggacgcaggcggacctcgcccaccacctgaatcacaaactcggagcgcagcggacgtgccatgtcttcgtcgtagataactacctgcacaagaccggtgttgtcacgaagatcgatgaaggccacgccaccgtggtcacgacgacgatcgacccaaccggagagcgtcaccttctgaccgacgagttcctcggtcacttcggttgcatgatgtgttctataagccgtctggctcatgcttcccctattccttgttctctaatgattgaagtcttgcgatttcaggcttctacggtaacggtttgctgggcatacacagtatccggctcccaagactgtgcgttggccggctgctggtcgcccgtgatgatgttcttgacttcgtccgaagcgtcctgcgcggacttgtccgcggggaaccacacgtatgggatgccgagcttgtcggcatacttgatctgcttgccaagcttggctgcggtcggagccacatctgccgcgacgccacgggcgcgcagctggttggcgatttggttggaagcggaacggtcctcctcgttccacacggccacgagcacggaagccggggacacgcgattcgcgtgggcaccggcggtgtgcagcatgtatgaaacgagacgggacaggccaatggacaggcccacgcccggatacttcctgttgccctgcgatgcgagattgtcgtaacgaccgccggaacagatggaaccaagagccgcagcaccgtcaaggaacgtctcatacacggaaccggtgtagtaatccagaccacgcgcgatcttcaaatcagcgatcacggagcccgggcgaatacgagcggcctcgtcaacaatcatcgccaacgtgtcaagaccctgacgtgcgagcacgtacgcctcggaatcattggcaatgccatgcttctcgcacagcgtgtcgaacttgccggacagttcagcgccgtcagctgcggtcagttcagccagctcaaggcacgcacgtgcctgattctcgtcggctccacagccttcgaccagcaacttggccacttcgtcggcaccgatcttgtcgagcttatcgatctcacggagcacgccctcgacatcggtcaagccaagaccacggtagaaaccttcagaaagcttacggttgttcgcatgcacggtggccttcggcaaaccgaactcacgcagacgttccaatgccgataccatgaccagcggcagctcgacctcgtaatgatcgggcagatcaccgttgccgatcacatcgatatcggcctgcacgaactcgcggaaacgaccttcctgcgggcgttcgccacgccagaccttctgaatctgccaacgcttgaaagggaatgccaaatcgccggaatgttcgaccacataacggctcagcggaacagtcaaatcgaagtgcagaccaaggcggtcctcaatcggagtgtcggactcatgaccgacctcctgaaggcggctcagcaggtaaatttccttgctggtttcgcccttcttgagcagactcgaaccctgctcaacagcacgagtttcaatgccaatgaagccattgagctcgaaaacttcacggagcgtgtcgataacacgctgctccacaacacgttcagaggggagccactctggaaatcctgaaatagatgcgccttttgccacgattccctataataaatgaggttgcggaaaatgcagcgcgtttttcaggctttgaaagcacgttcgcacgatccgcatcccctgcactacatgaagcttacttaaaggagctggccatggccgacgagaatgtcaccgcgtccgagaacaccaatgaaaccaccgagcaggcaacgacgcccgcagtcaaggccagcaaaccggccgttccgagcccggcttcgatgaagccccatgctccgagccccgcggccttcgccaagaaagctccacagcacaccgctccggctgccgcatccaccggcttctccgatgccgatgtgaagaccgccgaagcattcggccgtgtcgccgacgatggtactgtgttcgtcaaggacggcgaaggagaacgtgaggtcggtcagttccctgatgcctccaaggaagaggcgctggctctgtatgcccgccgttaccttgatttgaaggccaagttggacctgttcgcgaacaagctcaagtccaacaatgtgaagtcccgcgaaatcgacgagaccatcaagacgctgtccgcggaaaccgaacagccggcagtggtgggtgatctggccgctctcaaggcccagttcgaggcgctgaaggaggaaggcgcagccaagaaaaccgcgttgaccgaggcacgcaaggccgctatcgccaaggccgtcgaggagcgcaccgccattgtggagaaggccgaggcgctggctgattccctcgacgagaacaccaactggcgttccaccgcagacaagttccgttcgctcttccagcagtggcaggagcatcagcgcaacaacgtccgcatcgacaaggaagatgcggacgccctgtgggctcgtttctccgcggcccgcaccaagttcaatttcgcccgccgcaagtgggtgcagaaccgtgacgaagagcgtaattccgccaagtccaccaaggaagccatcatcgccgaggccgaggcgctgcaggattccaccgcttgggttgaaacctcccgcaagttcaccgagctgatggatcgttggaagaaggccggtcgtgccggtcgtcgtgacgatgatgccatgtgggagcgtttccgcgccgccgcagacaccttcttcaacgcacgtcaggccgatcgtgaccagatcagctcctccgagaaggaaaatcttgccaagaaggaagagctgctggtcaaggccgaggcgctggttcccgtcaaaagcgaagaagaggccaagcaggcccgtcaggctctcgccgccattcaggaggagtgggaccagatcggttacgtgccgcgtgacgaagtgcgccgcatcgaaggccgtctcgatgctgtagacaagcagatcaaggccattgaggatgccgcttggaagcagtccgatccggaagccgacgcccgcaagtcctccttcgaagaacagctcaacgctcagctcgctgagcttgatcagaagatcgccgcggaatccgatccgaagaagaaggccaagctcgaatccgagaaggccaccaaggaacagtggctgaacgccatcaagtaagtcgcacatcctgatatttggttgcgccacagagatgcggtcaaatatcagctggacttcactcaggcataatcaagaaggctggtacgtaacgacatccgtcacataccagccttcttcgtataatcgcacgtgttctcacatgcgcaatcaccatacagaatattcaactatcattcgccgaattcggtagcacaaatatcggccaccgcatcaatgcaggcatcgacgatgagcttacctcgttcggcgctggaacctgcaggagtggccagtcctccgtaatccggaacgtcgcccttgcgcaccgggtagcgcacgtaagccttcggtgtgacattgccttcgtcaatcacacggtccatatgcaccaattccggctcgtaatgcatcatcaatgaggtttccgtcactgcggcatgttccaacgcccaaccggggaacacgagtccgtcgaacacctgctcgaccacgttctccggcagcggatcccaccagttggtttcgacgatggtggccactcccctggtttcgcgggtgatcagatcgattgcctcgataatgaatgcctcgttttcgaaatgcgcgttcatcaccacgattttggtgaaaccgtccgcgatcagctcgccaagcacatcatgcatttgattgatcaccgtcacaccgttcatgtcgatggtgccggggaacaatgggccgcctccggaaagcggcttcgacttgtacccgtagttcatggtcggtgccacgatgccgtcgatgcgttcggcgaggtcttcagacacatggctggcgatcatggcgtccacaccaaggggaagatgctggctatgctgttcggtggagccgattggcacaataaccggctttgatttcgatgcttcgatttccggccaggtcatatggtccatccgacggctgctgctcatgattgctcctttatgtgctgttgttggtttgcgtttcaacaattgataatgattgcgatgatgccgtccccgcgaatcgatgttgcaatcgatgtttcagggacggcgtttattgtttcgaggaattgtttcgtaaaaaccgtttcttctcagatgcggctcagatccttatccgtgttttcgtgagagaggatcatggcgaccagtgccacggcggccaccgccaccatgtaccaggccggagcgatgctcgaaccggtggtgtagatcagccaggttgcgatgaacggcgcggttccaccgaagatggcgttggcaaggttgaagctgaatgcgaagccggtgaaacgaaccgatgtcgggaaggtttcagtcaggtagctcgaaagcgtaccgtcgttggcggtcagggtggcgcacatggcgagctcaacgatcagcaccggccagaactgtgcggtgttcagcgccatgaaggccggaacggtgagcacgatgaaggccacgcatgcaccaatcagcaccttcttgcgtccgaacatgtcggagatgtgacccatgccgaacaccaaagccacatacagtaccaggcagatggtggtgatggtggacgactgtgcggcagccatgccaaccgtgtcgctcagataggtcggcaggtaggtgagcaccgtgtagaagccgaccgcgttgagcacgcaggcaccgaagctgatgaccaaagtcttgaagtggttctggaacagctcgcgcagcggggagacgctcttagtggtggaagcgaactgctgcttgtcgtccaaagcttcggtcatggaagcatacaccggcgaatcagcgagcttggtacggatgaaatgcacgatcagaccaagcgggccggccatgaggaacggaatacgccatccccaagaggtcagtgcatcagagctcagcgaagcggtcatcacggtggcgagcgtggagcctgcgagcagaccgatggcggtggatgccggaatcagcgagcagtagatgccacgcttcttggtcggcgcgtattcgccaaggaaggttgcggcgccggcatattcaccggaagcggagaagccctgcaccatgcgaagcagcagcaacagtgccggagcgaaaatgccgatcgcagcatatgacggcaggcagccaatcaggaacgatgcacccgacatgaacatgatggaaatcgcaagagcgcccttgcgtcccttcttatcgccgaagttaccccaaaacagtgcaccgatcggacgaagcacgaatgacagtgcaaacacgccgaacgtctgcagcatggcgaccgtgtgattgccggacgggaaaaacaccaaagcgatggtggtcgcgaagtaggaataggaagcgtagtcgaaccattcaatgaagttgccgaggaaagacgagacggccactttcttgaccatcttctgctcttcggactgttcagacacggaagccctgttggcggttgcgattgttgcactggcactcatcatgtcacctgctttcttctgctgaatctgtctgtacgttcgcgttttcttcatacccggcgaacgttgtgactctgactatcgcccgaagtatttgcgccaaagtgaactgattgttaaaccgcaaccgtttgtttttgacgttttgccaagttccccttgcttacagcgccgaagtggaagatatggtgtgattatgttgcgatttcgccattttcgcacctaaaagcagcattgaccagctgattttatcggtaggcgctatgcccacgatctgtgtcactttgtccaatcggttgtacaacgtctgccgttgtatacctaattgctcgcatgcgccggtcttgttgtcgagattgtcgaaacaggcgcacaacgtgtcgatcagcatggcgttatgcataagctcatgcccaaccgtctgcgtgatcaccatgcgcacggcctcatcggtacgttccattcccaacatgcgttccagcaacgaggaatccacacattcgagggttccatacgggcattccgcatcgttcgaaatgcatgttcgaatcacactgcgcaacgcaccgaacgcgtccatcaatgaaatcgtgtccaacgctgcgcgtccatgcacggtatatacgtattcgtttgcagcgacttgcgtcaacgcatgcaaacaccgatctgaaaataccgacacatcgccgccgctgtcttgcgccgcgagaaaaccgatcattaaatcgccttccaacaaacagatcgattcgcaaccgccgttggattcgaaatcgtcgatcatcgacacgattgccggcatggcgttggccaccgacttgagtttcatggcaaatggcatatacacgcccgaagcggcgaatcccaacgcatcaagcatggcatggccctcacgcgcttccatcgacgaaacatgcacgccatcttccggccccgcaatcagatgcgccaccatgccgacgcgcgctcccccatcgagatacagtgtcaaaaccggagcggcaatctgttcgatccttctgcacatcgcttcatcgaacaccgtattgcgctggctgatctccaaagcacccaaaggccgtttctgttcctccagtgcaagtacaatgccgcaatctgtagcggtattgatgttctgtccggctcgggcgacttcaagaccgtccacgtcgaatatgaccacatcctcgccgaacaggttcgcaatgccatcggcaacggctttgggattggacgcttgagcaagctcagaacgcaacgaagttgacataacgtccacttgcatctgcatacgcatctgatcacgcacaatcatggtattgacgctctggcagatatcgacgaaaggaatgcgacggcgcaatccaataatcgtaagtccttcatgcttggctgccttcaccaacattttcggcagttgggtgacttcttcaaccaattcgaccatcaatgccgcaatatcagcattcacgaggcttttcacatattcgtccgcacgtttttcacgaccgtccgcaactaaagatcgcccctccaccaccagaagctcacctcctgccagaaatgaggcgacgtcctcgcgttcgttggtgaacacccaacgcaccggattatccaagctatcgccagcaacttcaacctgtggttccgccgtcgcaaccaaggcatcatcgagcacttccctcaccgtaacagtcatacaaaccgtccaatccgaagtaatacacatgtcacatcaagtaacgtgaccgcaaagcaatacgccgacaataaccatcaacgattacgtcaaaggttcccttccgtaacccaatggacatatgacaaaacgtctgccggaacccgaaaactcgcatgaaaactcgtattggaaggagtgattatgagcacgcaactgttcatcaacgcacacatcgccaccggcatgccgggcagcaccgcagccgaaacagcggcaatccaagatattctcgtcgaagacggcaagttcatcagcattgcacccaatctcaaagcaacactcgaagcacaaggcaaagatatggcgagcgtggaagtcgtcgatttgggcggaaagctggtctgtccaccattctgcgacacccatctacatcttgattacgtctttaccgcacgcaagcccggcgcggtgaacgagtcaggcaccctgttcgaaggcattcagcgttggagtgaaaccaaggcagatctcgctgtcgacgagatcaaggaacgcgcgaaaatcggcatcgccaaggaaatgcgtcatggcgtgcagttcattcgttcgcacgccgatgtgaccgacccgaatcttacctcgctcaaagctctgctggagcttaaggaggaactgaaagatactgtcacgctgcagatcgtctccttcccgcaggagggcatgtactcctatgaaggtcctcatggcgaatccgtcgcggatttggttgaggaaggcctgaaaatgggtgctgattgcgtcggtggcattccgcatttcgagcagtgccgtgagttcggcgaacgttccatgcacaccgtggtcgaactggcttcgaagtacgacaagctcatcgacgtgcattgcgacgaaaccgacgatccaaactcacgttatcttgaactgctgtccgcactcgcctatcgcgccggtatcggttcgaagaccacggcaagccacacttgctccttgggatcggccgacaatgcctatttcttccatctgaccaagctgttgaaggccgcacatatcaatttcgcctgcgcacctacggaaaatctgtatctgcaggggcgtcaagacacgttcccgaagcgtcgtggcatcacgcgagtcaaggagctcaccgaagctggggtgaatgtgtcgcttggtcaggattccatgcaagatccctggtatccggtcggtaacggcaatatgatgctgattctcgattatgtgctgcatttggcgcagatgatgagttttgaagagatcgatgatgcgttgaagttcctgacagtcaacggcgcaaccacgctcggcatgcgcgattcgtatggtcttgaggcaggcaagcccgcaaacttcattgtgcttgatgcttccagcgtgttcgacgccgtatacgagcgttgcgaagtgcttcgctcggtacgagagggtcgcacactgttcacccgtaacacgtcaatcactgccgatctcgatctgctgacactgtaattcgtcaagtttcgaaatactttcggcatacgaaaggccttgaaatcattacatacgatttcaaggcctttcgtgtgtcgcgttacttacgcaccgattgcttattcaacagattctgcggattccgtaagttctgtcgattccgtcgattcggcaggtgcctcggtttcagctgcgacttcaccttcagcaggctccgtatttggctcttcgaacgcctcaccggtaaaggtgaactcgcccaggatgccttcgccttccgcatcgaccttcacgcgctggccatcttcgagttcgcccatcaggatcttctccgaaatggcgtcttcgacgtcgcgctgaatcacgcgacgcaacggacgcgcgcccagcagcgggtcgaagcccttctgcgcgagcagatccttggcagcgtcggtaagctcgagggacatgtggcgatcgaacaagcgatcattgagctgcttgacgtcaagatcgacgatctgacgcacttgcggctcggtgagctgcttgaacacgatgatgtcgtccagacggttcaggaattccggacggaactgctgcttcagctccgcggaaacctgatccttcatgcgctggtagctcgactcggtgttggcacccaagttgaagccggtgttggcggccttggcgatgtctcgcgtaccaagattggtggtcagaatgatgatggtgttcttgaagtccaccttgcggccctggccatcagtcagatgaccgtcatcaagcacctgcagcagcgtgttgaagatatccggatgggccttttcgatctcatcgaacagcaccacggagaacggcttgcgacgaaccttctcggtgagttcgccgccctcttcgtaaccgacgtatcccggaggagcaccaaacaggcgcgaagccgcatatttctcggagaattcagacatgtcgacacgaatcagtgcgtcctcgtcgtcaaacaggaattcggcgagcgtcttggccagctcggtcttaccgacgccggtggggccagcgaagataaacgaaccggacggacgcttcggatccttcaaaccaacacgagcacgacggatggaacggctcaacgcggacacggcctcgtcctggccgatgatgcgcttgtgcaactcactttccatggtcatgagcttcttggactcggcctgggtgagcttgaacaccggaatgccggtggtctgggaaatcacttcggcgatgacatcctcatccacaaccatcttcacatcggattcgccctcacgccacgaagattccttctgcttgcgttcggcttccagcttctcctgcttatcacgcagctcagcggccttttcgaagtcctggcccttgatggcctggtccttctcttcggcaagcttggcgatcttcgtgtcaagttccttaagctccggcggagcggtcagacgacggatgcgcagacgcgcaccggcctcatcgatcagatcgatggccttgtctggcagatgacggtcctgaatgtaacggctcgacagatcggccgcggcctgcaacgcaccatcggtgatcgtcacatggtgatggttctcgtaacgcgaacgcaagcccttaaggatctcgatggtttcggcaatgctcggctcatgcacctggatgggctggaaacgacgttccaaagcggcatccttctcgatgtacttacgatactcgtcggtggtggtggcgccaatggtctgcagctcacctcgcgcgagcattggcttcaacatgtcggaagcgccaagagcgccatccgcggaaccagcgcccacaatggtatggatctcatcgatgaacagcacgatgtcgccgcgggtcttgatctccttgagcaccttcttcagacgctcctcgaaatcgccacggtagcgcgaaccagccaccatggatcccagatccaacgaatagacctgcttgcccttcagcgtctccggaacgtcgccggcattgatcttctgcgccaagccttcgaccacggccgtcttgccgacacccggctcgccgattagcaccggattgttcttggtacggcggctcagtaccaccatcacacgctcgatctcactcgaacgcccaatcaccggatcaagcttgccggcggcagcttcagcggtcagattgcggccgaactggtcaagaatcgcggaaccggtctggttgcgacgatcctgcacgccaccggcattggccaaatcgcccttgccatcacccttgccatcaccggaattgccacggatcaggtcgatggtggcgctgcgcagctcgccaagattgacgtccatcttgatcagcacctgggtgccgacgccttcgccttcatgaatcagaccgagcaggatatgctcggtgccgatatagctgtgccccagctgcaacgcctcacgcagcgacagctccaacacctgcctggcatgcggggtgaagggaatgtggccgttcggcgtggcattccccttaccgatcatctcttcgacctgtttgcgggtgtcatccaaggtcacaccctttgaggccagcgccttggctgcgacgccgtcaccctcacgaatcaggccaagcagcagatgctcggtaccgatgtagttgtgctggagggtacgagcctcttcctgcgccagcacgatcacgcgccgcgcacggtcggtaaaccgttcgaacatgcttgtccttccactcttgttagtccatcaacactctaccgattcgcgatgacgtttgttttcatccgcgcgtaaattgcgctctcgacgcaacgcaacggatatgcttgacatatagcaacgaccaaggaggtcaccaagatgagcgacaccaccctaaatgcaaccgaatccgggatgctcgcagatatccgcttgcacgacatcgtcgtcggcgtcgacggttccgacgaatccttcgccgcattacgctgggcgctgaacgaggcatcgcttaccggccagcaggtcaatgcggtgttcgcatggtcccattcctgggatatgggctcggaaccggaagatgaagagcagtgggccgaagtccgccatgagatcgcgcaacggcttcgcgactgggtttccaaagcttcgcagggcatgaccatcaatgaggatcatgtcaaactcacgtcggtcaaggccacaggaacgtccgcattgctggagatcggcaaggatgcgcagcagatcgtagtcggacgccgttcactcggcagagtggcacgctggttcctcggctcgctttcggaatcgcttgccgaagccgcacaggttcccgttaccatagttcgcattctcgacgacgaggaatccagcgtgcaggatgccatcgccaacgcgcttacgccttcggagaacacggtgacgtacgatttgcccggctcccctctgcctaagaaccagcggccgatcgtggttggcgtcgatggttcggaaacctcgcgacacgccttgcgattcgctatcgacctggcggctttgcatcacgctcccctgcaggtgatgttctgctggcagctcaaggatcttggcgtcatcgagggatatgagaacgccatagcgccgattgccgtcggtcaggaacgggcggaacgcattcttgacgagctgctcgattcggttgagattcccactgccggcattcccgacgatttccagatcgaatcgcacgccttccatatttccgctgcgaaggggctgatcgcggcatcccgttacgcacgccatctagtggtcggttcccgtggattgtccggcttggacgcgcatttccttggttccgtctccaagcaaatcgtcaatttcgccgactgcaccgtcactgtcgtgcactaaacctttgaggatatgaaagaagtccgcttccttacatagggaacggacttctttcatatcctcgataagacaggattactcagcttccggagcgttttcctctgcagtgtccgtttcctcggcttcggtgggttccgcatccgtcgcttcatcctcttcggattcgacgataaccggctcttcgtcatcgctcaaatcaacggtggattccacctccggctcatcctgctgggccgtatgttcgagcacttcctcctgattcgcatcatcatccacggtattggcttcgatatcggcttcggaggcttcttcctcatcgttcggattgccgtcttcattcgccgacagctgctcgatcagttcgacggaaccgcgttcatcacgcggcgcctgcgcgatgatatcgatatgcaggtcgtcaaatgcaggtttcgactgcacccacaagtgagacggttccggcggctcgatttcggaatgttcgccacagccatggtcgatggatacaacacgaccgtcatcaggactccacttgttagcgcacacgccgaacagaagattcagttcgcctttcagaggaatgaagaatccgcacgtcgagcatggattgccatccgatgttttggtggacaacgatttcggtccgcgcggtccctcataccagcgtttcgcggtctgggaacggcccaaaggcgtgagcacgtgcctgcgggacagatcgaattcctcaaccgcctcgtcgatgtcctcttcggaggtcaccgatgctacggcattctcgtcttgcgaaccgtcaaccacgtcagcgtccgctccggcattgtcgccgccgtccgccgcttcgacggtctgcacatcgtcggaaacgctttcggcagactcaacgggctcagttctgcggaacccctcttccatacgtggatcatcgggatcggtgccgatcgaatcggtcaccgccaaatcggtcggttcaagacgatccttccatggaatccattccggtgggcgcaacgccttgtcggtaggcaccagcgatgactcattgaccgtccaatggtccaactcagcatcgcgatacaacgtcaccgaccactgccatccctcatacccacgtatgcaggtttcaaaacgaaaatcagtaacgttgtctcccaagtcgatggcttcgacgaagtcaccgacttggccatcctcatcggcgacttcgatggccaccgcctgggcgatcgccttgggatccattgtggtatcggacatgaattattcctgtacgtcgaagttatcggccacggcacgcatcagcgtggccagtttcttgctttcagccggagacggataatggtggcggcgcaactggttccccgcggaatccagcagcttgataagatcctccacaatggcggccatatcatccggcttcggtcgagttgctttgaccagagacggcgcggatgccacaagggtgaggcccattgcctgcggaccacggcggccctccaccacggaatactcgacttttgcacccttacgcaacgtcttcacgccctccggcagggcggctgcaggcaggaacacatcggcaccctgctcgttctgaataaaaccatagcctttgttcgcatcgaaccaacgaacgcgtccgctaggcattgtcacctcactcttacgtaatccacataccttcaggcgaacgaaagaacaatcgtccgccgattacaaatcaaagatacagtttagcgcaagaggtgggatatgtaaccatctcttgcgccaacaatcgtcagatcatgcctttttgcatgtttgcatcattgttttttcggcctgcgcccacgcttgtcgaccttgcgttcgtcactggtctgcgccaacggacgtggttccacaggagccaccggaagcactaccgtcagtgtcaatccagtcccgtcactgccggaagcgcagatgaaaccatggtgtgccttgaccacggactgggcgatcgccatgccgagacccgtaccgcccttctgtcgtgctctggacggatccgccgtgtagaaccgttcgaagatcttcgagcgtgcatctgcgggaacgccgggaccatgatcgctgaatcgcacaattgcgtaattcatgccgacttgcatggattgccccacctcgatggcctcgataaagtgatgcaacgactgctcgttggatggcatgcgagacaatgattccgggctgatggacgccggaagcacgcccatggacacttcaaccggggaatcggccggcgtgtaccgatggatgttgcccacaatgttcgtgaccacctgacgcaagcgtgatgcatcgccggtcaacgtgatgtccggcatggttcccggctggaaggcgagacgcgaaggatgttccatatccgatcccgcctgcaataccacctggccgcaggtgatgccacgatccgggtcgagcgcgtgcagatcatcagccgcatcattgaccacggaagtcagcttcacctgctgggtgatatcgatgccacgtccttcatccaaccgcgccaatgacagcaaatcctcgacaagcaccgtcatacgcgcactggacgcttctatatgttcaatggactcatcggcacgttccaatgctccgggcatgtcacgctgcattttgtacaactccgcatatccgtgaatcgcggcaagcggagtacgcagctcatggctagcatcggaaacgaaccgtttcatcttctcggtcgtttcctcctgcgcgtggaagctttcctcaatacgcgtcagcatggtgttcagcgacatggacagcgatccgacttccgtattttccggcaaatcgggaacacgttggctcaaatcccctgccgcaatcttcgcagcggtcttctcgatacgtttcagcggagcaagcgtgctttgcacgacgatggtgccaagaatggcgccgatcaacaccaccgcgatgccgaccatggcacagaaccgcgtcaacgtgttggacgtgtcgatctggtcactcagcgacaatccgatgaacacgacgccgctgtctttgacctgccccgttttggttttctcgctccaaggcagcgccacaacacgccacggcgactgtgcggcctgcatgatggcatgatccggcaccctgctggtggtaacgtgcaccaccgcctgtgtggtgaacggctctccgagcgtgaccccgtcgatactgccgtcggaaggcagactcggctcggacaccacgccctcacggagcataggcaccgacccagcgccggtacgcttgtattcgctgtcccgcacctcgacataatacgtgttcaccaagctccgtccatcctcgctcgtggtgctgtccagcgaatccatgctattgaaaatcatctgcgcctgattcaccaactgcgtgtcggttttctgtagcagataattgcccacaagcgtgcgaatggaaaaggaaatgccgatagtgccaatggtcaacaacacaatgatgcaagtgaccagcttggtgcttaacggaatggcctgcaccttcctgccgatccgccgatgccaaggcacacgttgcagacgcggctggccgccgttcttctgcgtgttctgcgggtcagccgacggctgacgggtatcctgactcatcgcgggaccgtttagttcttcggcgcacgaatcatgtagccgatgccacgcttcgtttcgataagcggagccaccttgcgcttctcgccgttctcatcctccaccgtaagtccgtcgaccttcttgcgcagatatgaaatgtacgattcaacaatcgcggcgtccccgccccaatcgtactgccacacatgatccaaaatctgcgccttcgagagcacacgcccctcgttatccatcaaataacgcagcaacttgtattcggtggggctcaaatcgatcggctgtccggcacgggacacatcatgcgaatcctcattgatctccagatccgcgacgcggataatcggatcatcctcaacctgctcctgggtacggcgcagaatggcacggattcgcgcaacgacctcctcaagactgaacggcttggtcacatagtcgtcaccccccacggtcaaacccatgaccttgtcttgagtatcatcgcgagccgtcaaatacagcaccggcgtagtgatgccttcctgacggatacgacgggtcaccgtgaaaccgtcgatatccggaagcatcacatcaagcacaatcaaatcaggctgtattttctcgatgacttcgatggcttcagatcccgaagccgcggtattcacttcaaaacccgcaaaatgcaaggatgccaccaacagctcacggatggacggttcgtcgtcaacaacgacaatggatgcttcaataggcttgctcatgctttaagcatcactctgttcactggatgtttcctgaacggattctgagtcttcctttgacgtctgccctccatcatgcgcttcaacggacagctcaccatcgacactccatgccttcaccggctcggaacgcacagtaatcgcggcatgccttcccgcatgcttgcgcaccttgcgcttgatgatgccacgcttgcgcagaatatggaacaccaccataatcacaatcagcagcaccagcacggctatcatgccgccaacacccaacagcacggtctgcgacgacgtcgaggtcttcttctgcaccgcgatctgatccatcatatcggttgcggatttcgaccaatccggagtgctttccatcaaaggtttctgcgcagcatcggaaagcgcatcgaccgtcgacttcttcttcaaccattcgtcggaattcgacgaaacggcaaccacgagattgccatcgttcgaagcgaccgccagcaaaaccgtattcggtttcggatcaagcgattccaacagcgcgctcgcccattttgcaggtttttcttcggtgttgaaacttgccaggtacagcaaatgcacggtgacgcccgtttcctgctttgtcgcgctgatggcatccgtgatctcggcgacgtttgatccgagcagattctcagtgtcggtgatattttccgtggccgtgattccggtgcccgtattgtcttccgcgctgccgacgggagttatccacaacatcatcgcacaacacaacagcatagaaagaagcatgcaagccgctacattccaacgatttctgaagttttgccgttgtcgcgacacaccgattgggcacattttcgcacatcctccgaccacaaccctggttttttcattcatcgcgttcactgttgccatacagtccacattaccgttcagatacgtcaagtgcgagcgaacggtaccaaccgagcacacaaaagtacctggcaacgaaaggatcatcatggcacagtttcaggtggacagcgagcagattcaatcctcgagcgcggcggtaaacgcctccatccaagcgatacgtcagtcggtgcagggcatgtacgccaatctcaacaatctgcagagcgtctggaggggcggagcggccacacagttcaatgcggtggcggaacaatggcgtgccgcccaacagcagatggagcagtcgctcgaatcgattcagcatgcgctgacgcaggcatccgcactgtatgcggaaaccgaaatgcaggcatcgcgtctgtttgcgcagtagcggcaggtacttccgacgcaatcaaagcaatagctggcgcaaacaaaaagtggagcccgcgtccactatgggaaacggactccacttatagctttttgcttatgccgtcaggctttgccaaaccgttggatcagtagcccatgtcagcgccagcggccggagcggctgccggcggttccggcttgttggccacaacagcctcggtggtcaggaacagaccagcgatggaagctgcgttctgcagtgcggaacgggtgaccttgaccgggtcggtgacgccggcggccagcaggtcctcatactcgttggtggctgcgttcaggccctggccgtcaggcagggaacgaaccttgtcgatcaccacgtcgccggacagtccagcgttttcggcgatctgcttgatcggggcttcgatggcgcggaacacgatcgcggcaccggttgcctcgtcgccttcgagcttgacatcgctctcggccttggctgcagcctggaccagagcgacaccgccgcccggcagcaggccttcttcgatggcggccttggcgttgcgcacggcatcttcgatgcggtgcttgcgttccttggcctcgacttcggtggcagcgccaaccttgatgacggcaacgccgccagccagcttagccagacgctcctgcagcttctcacgatcgtagtctgaatcggtgttggcgatttcggcacggatctgagccacgcgggcagccacgtcttccttggagccgccgccggccacgatggtggtctcgtccttggagacgatgaccttcttggcggtgccgagcacggacatgtcgacggagtcgagcttgaggccgagttcgtcggacacaacctgggcgccggtcaggatggccatatcctgcagcatggccttacggcgatcgccgaagcccggagccttgacggcgcaggacttgaaggtgccgcggatgttgttcagaatcaaggtcggcagagcctcgccatcaacgtcttcagcgatgatcagcagcggcttgccggtcttcatgaccagctcggcgatgtgcacgacgtcctgctgagagctcaccttgccggaggtcagcaggatgtacggctcttcgagcactgcggtctgatcttcggcgttggtcacgaagtacggagcgatatagcccttgtcgaaacgcatgccttcggtgaagtccagatccaggccgaagcggttgttgtcctcaacggtcacgacgccgtcctggccaaccttgtcaagagcttcggcgatcttctcgccgacttccggatcggcggcggaaatcgttgcggtagcagcgatctgatccttggtctcaacgtccttggcagctgcgataagctccttgacgatggcttcggaagccttctcgataccacgacgcaaagcgatcgggttggagccggcggtgacgttcttcaggccttcgtgcaccagggactgggcgagcacggttgcggtggtggtgccgtcgccagcgacgtcatcggtcttcttggcgacttccttgaccagttcggcgccgatgcgctcgtacgggtcgtccaggtcgatttccttggcgatggagacaccatcgttggtgatggtcggagcgccgtaggtcttgtcgaggaccacgttgcggcccttcggaccgagggtgaccttgacggtatcagcgagcttgtcgaggcccgcgagcattccttgacgagcttcgtcgtcgtatgcaatgatctttgccattgttcctccacatatggctacacggtattattcccaccttcgaagcgaagaacgcaccagccgtcagctgccagttatcactctcgctcctcgagtgctaattggcagattagcactctcaggccgagagtgccaaactccatgtcgccagttgcgctgtaagcaagaagaattgttcgtctaaataagccatcaacgttggaattccaaggaaaacaaaaaagccttgttcttggggaaaagaacaaggcttttttgtttcgctcacggcgtttttcagtcaagcaacaccacaacgattggcgtgacgagtccatcgctttgctgcacattcgaaattcccagcgtctgtgcgacgttttcggcggtcgccttatcggtctcgttctgataccagaccacggtctgcgaaggaacgtttcccgtcggattgctggcagaaacactggtatacccggcttgggtcagcacgtcggccttgctttgcgcataaccggtgatattcgtcgcgttcacgacgcgaacctcagtacccgtgttcacagcctgctgcgcagtggcgttatccgtctgctcggcattctggccggcattctggtcggcgttctgatcattttgctgcgagtcggtcggcgaatcggcattggatgcgtctgtcttattgccggaagcggagtcggattgggacttggacttgctcttgccgctcttgctcttttcggcacttgaagtagtcgaactctcctgcgacgaccacggcatcttcagattgttgatctcacctgaataaatgctccagaacagcaaaccagcaagcagcgccacaatgatgacaatgacgtacggcatggcccgggacgccgcggaacgcgcgccacggtgaacacccataggtcccgccggaggattgtcgtacacatccttctcgtaggaatcgtaggtctccttgtcctgcttagccatattgcaaacctcgtttctcacacacttatctgccaagtgtaccgaccacctcagtcagaacacaatcgagccgcattcccacccctattccgaacgttcgtgaaaccatcccgtgaaaaccaaaccacccctgtcatcaggaccgcaacacgtcgtacagtaaggtgcatgacacaatcgaacatcaagccgttgaaagatctcgtggagcccggatgggcgaatgccctcgccgaggtcgagccacaggtgcaccgcatgggcgatttccttcgaggcgaaatcgcagccggacgccggtatcttcccgccagcgcgaacattctgcgcgccttcaccatcccattcgacagcatcaaggtgcttatcgtgggccaagacccctacccaacccccggtcatccggtgggactgagcttctgcgtggcgcccgatgtccagcccattcctcgtagtctgaccaatatatacaaggagctgacggatgacctcggcgtacccatgcccacgaacggcgatctgacgccttggacgaatcaaggcgttatgctgctcaacagatgcctgaccgtcgaagcgggcaagcccggcagccatcaggacaaggggtgggagatcgttaccgacgcggcgatcaaagcgcttaacaaccgccgcaatcccgatggcagcatcaaacccttggtcgccatcctgtgggggcgcaaggcgcagacgctgggaccgctgctcaccaacgcatatattatcgcctcacctcatccgagtcctatgtccgcgcgatacggattcttcggttcaaaaccgttttcccgcgccaaccaagcgctcatcgccgcaggcgagaagcctgtggactggtccctcccgtcagcttgacccgttacagtagcaactatggctttattccctccgaagaatccggtaccgacaccaacccccgttccaatgccggccgtcaccaaaccgagcacgttgcccccagaggacatcaaccgggcgaaacagctcggcacgtgcatccgcgcacgcttcgcgcagaccctagttggacaggacaacctgcgtgaatcgctgatcaccacgctggtggcaggcggacatattctcatcgaatccgtaccgggtctggccaagaccacggccgcgcagacgctggcgacttccgtgtccggatcgttcaagcgagtgcaatgcacgcctgatctgatgccatccgatctggtgggcacccaggtcttcgatttcgcgacgcagaagttctccacgcagatcggcccgatccacgccaacttcgtgctgctcgacgaaatcaaccgttcaaacgcaaaaacccaatcggccatgcttgaagccatggccgaaggagccaccaccatcggcggccagtgcatcgcactgccgaaaccgttcatggtcatcgctacacagaatccaatcgaggaggaaggcacgttcaaccttcctgaggcgcaaatggaccgtttcatgatgaaagccgtcatgacgtatccgaccgcgcaggaggaacagcgcatgctcaccatgctcacccaccgcggctccgacacttttgattcacgaacgctcactggtgacgtcgtgtccatcagcgatgtcgaattcctgcgcgccgcggcccgtcgcgtgcatgtgtccgacgcaatcatgaaatacgcggtcgatatcactgccacatcccgaggagccggcaccaagccggtgcagggattgtccacactagtgcgtctcggagcctcgccacgcgcgtccatcgcgctgactcgcatcggacaggccaacgcgttgatgcaaggccgcgactatgtgattccagaagacgtcaaagccttcacacatgaagtgcttcgccaccgcatcctgctcacgttcgaggcccttgccgacggcgtcaccagcgatcaggtcgtggactcgatcgttcaggcggttcccgttccatgatcgacgcaattcgttccgaagatccgatccgcagtaagatcgaagccctcggaaccacgttgagcctgccgactgttcgcaaggcgctcggtattcttgagggtgcgcacgcatcagacaagcgtttcggcgccgacgatgtcatggatatccgcatctatgagcctggagacgaggcaaaacggattgattggaagaccagcgcccgtgtgggccgccccatggtggtgcagcgcgaacgcccatccacttcacgcgcctggcttttgctcgatgtcggacaggaaatgaccggtacctgcgtttccggcgaacaggttcatcaggtcgcagccaacgccctatgcatgttcgcggcgctcagcctgcgtcgtggtgacgaagtgtccatagtattcggcgattcaggctcgatcacccgtgtgccattcaatggcggacttacgcaattcgaacagacgttggacaatgcgctgcagcgtgattggaacaaacctcgcaatatcgacgctttgctggagtacgcccgtcgcattcgcgacagggatgcgttggtggtgatcgccaccgatgagcacgcacttaaggaacgtcatgtggagtccattcgcaggatcgcaaggacccatccgatggtgctcatcgatgtcgcaaccattaatccgttcgacaatagccatgcgcgcgacgtattcgacgcgggcagcgaccgccgcattccggcattcctgcgcaccggcaaaacggcgcaggaagttcgcacgcatcgcgaatatctgtccgcgtccatcagacatgagctgaatcgttgcggttccacagtgatccgtgccgattcaagcgaacgtatgttccgggaattcgtacagatggtatccgcatccctatctcgctccacacgcaatcagctcaaagcaccgtcctcactcaccttgggaggcaaagcatgaatcacatcgccttgtctcgcaacgatttcgacacactggacccgattcatatcgaaacggggctgggcatcgttgtcgcggtatgcctcatccttgccgtggcacttgtcgtcttggtggtatggctgtcgaaaccaactctcaagccaacgaagaaaaccaatcgcggacgtcacgacgcatcgacgggcacgtcgatatggcatgaacgcatcaacgatgtggtggaccgtcatgccaacggcgatctcggaagagaggaagcgttcgctctgctcgcatcgatcgccagagatttcgtctccacggccaccggcagcgacgtgcgcaatcagacgctcaccgatattgaagcgacacctcgcacgaccggcaaccagcatgggctcaccctgctcaggcagaccatcgaggcattgtatccgccggaattcgcggatgccgaacgcaatcacacggccagagaggccacggttgaacaggctggagagtgggttgccaatcttgtggaaaggtggcgatgaatggaattgtcatggcactggccgtgggtaggccttgcaggcctgattgcgtcattggccgtcatcgccatcatggtattggcgtccgcaaaacgcaggcataacgactcaggatccgtgcggacgttcagtttggatgacgatctcaacaccgaaaccgcatcgagattatttcggcagtggcgcaccatgtcacgtgccgccgtcgttctgttggtgatggcactggtgctggcgatagcgctggtggcacgccccagcaccgtggatgagggagaggagcgtgcgagcagccgcgatatcgtgctgtgcttggacgtatctggttcgacgttgccatacgaccgcgaagtgatcgatacctaccgcacattggtggacaatttcaagggcgagcgcatcggattgagcattttcaattccacgtcacgtaccgtgtttccgttgaccgacgattacgaattggtgtccgaacagctcgacaagaccagcacgatactgaaaggcgtcgaatcgcaggatgatatcgacaagatgaaagacagcgattaccaagcgatttccgactggctggaaggtacgcagaatcgtaaagaggccacttccctgatcggcgacggcgtggtgagttgcgcagccatgctgccaggtttcgcctacggcagttccaacgccgagaccgcatcccgtcaacgtgccgcttccattgtgctcgccaccgacaatgtcgtttccggagatccgacatacacgcttcaggaggctcttgacctgaccaaacaggcggaaatcaccgtggacggactgttctccggaccgcagcaaagcgaatcggaacagacgaccaaacagttcgaatccgaaatcgaatcgcatggcggcgtgtttctcacgcaatcgaacggcgcttccgtggctgagctggtcaagcaaatcgaatcgcggcgcaaccatgacagcgcggcaagcagcaaggccgcaatatcggacgcaccgggatggtggacgctggcattggcagtggcgatagtgatttggctgctcttggcttggaggttgaggcgatgaccaatctgacgctctcccctgctttgggatggcctttaggcacggcgatctgcgtgatcatgctggtttgcgcagtcgcgcagattgtgcttcatatccgtagacgcagccaaagcgatgaaaccgtctgggcttgcgcaagacgatcgatgatttgtgcgctggtggccatcatggcattgacgccaagcatcgtctcgtccacgaacagccgtgcgattaacaccaccgatgtggtggtggcggtggatgtgaccggttccatggcggtcgcggacgcgcagtatggttccgacgaacagctcagccgcttggatgttgccaagcaggcggtgaaggatattgccgccatgtatccgaattccagtttcgcggcattgcgattcggcgcttcgggaacgttggatgttccgttgacgcctgattcgaaggcgatcgataattgggcggacacgcttgcaccggaatcgacttccatttcggccggttcgaccttggatgtgccgattgaccagttgttgctcacatgcaagtcgattcacgatcagcatcccgatgatgcgatcgtgctgtacctgatttcggatggcgagcagacctcgtcgaaaacacgccgaacgttctcatcgttgcgacgctacctttccgatgcgttcaccgtcgccgtgggcagcgagcagggaggcaatatccccgtgaccggcgatggcgtggaggaaggcgacacgcaatgggttaccgatccggaaaccggcgagcctggcgtgtcccgtatgaatgccgacgaaatgaacgccatcgccgacgagctcagtggaaccgccatccagctcaatgccacgacgaccatgagtggcggggattccaaagagacatccagcaaatggcgtgtcacgcagacatccaagcaacgcacaagaaccgtcgccatggtctggccgttcgccattgccgtagcgctgctgctgacgttcgaggccggggcatggatcacgcaatcaaggaggctgctgtgagcacaaccgttacagcgcgtgcatcgctgcccgttcgcatcgccatcgccgtcatcgcagccatatcggttattgtgggcgtgcttggcatagtgaatctcgcatccgtcagcaactacaaccaggccacggacagtctgaatgcgaatatcaaagccagccaacagcaagacgccgatttcgacaaattgcagacccaacagcagcagaccgacgcgcaattccgtgaagctggcgcggccggcatgttgctgctgccaaacgtacgcacatccatcgagcataatgccgaagtttcggcaaaactgaccgaatccatacgcaagaaaatcggagagatgcagcatgccgacggcaccgaggccgacacagtcatcgaaggtgggcaatccgtcaccgatggaggccaaggcaacggaggaaccttgactgacgagcagcgtcagaaggtggaggagcttctggcccagaacgcacagtccgcccaatccgattccgatgattccggttcggcggccaagcaggattccaaccaaacatcttcgcccgcaaaaccctggtaagggggcttatttcaggaagttatccacaggcatgtcggcgtgtttttgttgatttttcaacgatgacacgccgacatcgtgcttttcgcccgtcctccgaccacaagccttgttcgccggcttgggcaaccgcccgatgtgctccaatatagctatgaacgcatcaatcacctatccgtttattcccggactggggttcaacctcatcaacaccttggcctcaacgccaggcatgccatgccattgccgtgctggcgtgcgaaccacccaactgctcgtcaatgccaagctcacgtccatatcgaaacatcttgacgatcttgacgccacgctcgcatccagttcattgcccgattggacaggaaccgccgccgaatcataccgcgcgcggcttgatgagttacgcaagcaatccctgacgctacgggattcgatcaacgccaccttgcgtctcctatgggcagtaggtgcggcatgagctgggaagtgaccgccaaagtcagcggcggatgcaaatactccacggaggaaaccgaggcatatatgcgcgcggcaaaagccctcagccatcaagccgacgctctgaaccgcgcccatgattcagtccgggcattgagccttcagctttcctcctacccctatgcgtcgtcggccatcgcctcgctgtccggatcaagcccctattgcaatgccacggatcacatcgaactgccatacgaccagctcgtcgaacaatgtgacgcccatgcaagcgcgctgggagccatggcggcaagattgtcggagctatcggcgctgatcattcgcgcgcaatcgttatattcccaggtcgacgacgctggcagaagaacactgaacgaactgctgcaagtggcgatcacatcgttcccgaaggaatcgatactcgccggcgcagccatgtccgccttgggatatgtgatgggatccaccaatgagggcaaatccaatcccatatatctgctggactcgttggattgggcgcaggaaggcatcatgagcgcggccggcgccgcggtcagcggatacggcaaggtcaaaggcctgctgcgtaccgatgaggtcaaccatgcagccggcaccatctccaaggcatcgtcgcgcggttacaacttgatccagggcaacaatcttaccgtcacccaagtccatccgaaaaccgaagtggtgcgtgaatcgcataatgtcggagaggccatggaggatcttcgacgtcttgccgaggaacgtctcggcaagaccgatctcgacagcggacttgactacggcaccatcgccatctccaaataccgtaaatccgacggaaccaactcatggctcgtcaccattccaggcacagacggcaagcacgattctccatttgggtggccgcaaaacgtcgaactcatgagttcggacagcaagcaacgcatggaagcggacagtgcgcgaatggtgcaggaagccatgaaacaggccggcatcaaatccaatgagcccgtcgcattgatcggacattcgcaaggtggcatcgttgccgccaccatcgcctcggacctgaaagacgattatgacatcgaacatgtggttaccgccgggtcgcccgtcgccaatcatccgattccggaaaaaacatgggtgaccagcgtggaaatggacgacgagctcgtggcggccctcgatggcgccgccaaccccagttccgaccattggctgaccgtacgcggcaccgcaagcaaatccagcagcaaccaggaatcaacgttcgcaggcactcccgtcacagacgctccagacaacaaggaaatcacgcattggctcaaatatcaccaagccgcataccagaacgcaacggacatgggatccaccgcagtgaacacccacgaacggcatttcgatgagatcatcgacggcgatctgcaggaagtcatgtatttcgaagggcgcatgagcaaatgagaaaacactgcagccacggcgcaacaagaacggtatcacggcatacatcatgaaagccatccaccgagcggacagatacgcaactttcgtttacggctgaacgtatgctgtagtctatgaagcttactgatatctcccctgcaatcgcattgacccctcttgacggccgctaccatcagcagaccgctccgcttgtcgaatatttgagcgaacctgcgttgaaccgcgagcgcatgcgcgtcgaagtcgaatggatgattctgctggccaacggtttcgagggcaacggcaaccagaccatcgttcccggcgtcaagccgctcaccgatgaggaacaggcgttcctgcgcgccattcctgaggagttcggcgccgagggtatcgcgcaacacgccgcccatgaggcaaagacccatcatgatgtgaaggccgtggaatactacatcgacgaccagctcgacaaggccgccgacgtgcttggccacgacacccagctgaccggcctgaagactttggtacatttcgcatgcacgtccgaagacatcaacaacctgtccatcgcccgctgcgtgaaaaacggcatcgagaatgtgtggctgccgggcgctcaggccatcgtcgaccatttggctcagaaggctgaggaataccgtgacaaggccatgctgtcgttaacgcacggccagcctgctacaccgaccacgcttggcaaggaactcgcagtgtacgtgtaccgtctgaaccgccagctgaacaaggtcagggctcaggaatatctcggcaagatcaatggcgctaccggcacgttcggcgcgcatttggccgcatgcccggatgtcgattgggtggccgtctcccgcgaattcgtcaccaaccgcatgggtctgacgtggaatccgctcaccactcagatcgaatcgcatgattggcaggccgaactgtatggcaccatcagccacaccaaccgcattctgcacaacctgtgcgtggatgtgtggatgtacatctcccgtggcgtgttcgcccaggttccagtcaagggtgctaccggatcctccaccatgccgcacaaggtcaatccgattcgtttcgaaaacgcggaagccaatctggagatctcctgctcgctgctcgacacgctgtccgcaacgctggtcgaatcccgttggcagcgcgatctgaccgattccaccacgcaacgcaacatcggctccgcgttgggctactccgtgctcgcgctcaacaatctgatgggcggtctgaactccatccatccgaacgacatcgccatcgaagccgagctggactccaactgggaggtgcttggcgagccgatccagaccgccatgcgcgcctgcgaacttgccggcctgccgggcatggacaagccgtacgagaaggtcaaggagcttatgcgcggccatgagatctccaaggaagccgtcgagcagttcatcgatcagcaggcgttcgatgacgctaccacggctcgtctgaaggcgctgactccggcaacatataccggcgtcgccagcaaactggtagatttcgaccgctgaaccgaagctgtcaaataagtaccaaaaccatacgccctgagggtgaccgcgtatttcgtagccaccctcagggcgtattatcgaatgcagtggggcgatatgacccacctgaagccaatctcacgtatggagcaagtcaacagtgtctcactcccctgcagtcaataagcccgccccgcatatcgacgatgtgccgccgaagcgcagtcgtgattttgccgatctgacgcacgcattcttcgccttggtgctcggcataggcgtgattctgttctccgtgtacttgcatggcaccgcgtccggcgtggaatccgacgttcattccgccggccgcgtggtcagctggctgatggatgttccctcggcattattgcagcagcttgccatcgtatgcatcaccgtcagcgtgctcatccagctgcttacttccaaagagtggctgcaaagcgtgatttccgtggtttccctcatattcggattctttgcggtgtggggcatatccgcgctgatcagcaactccggcaataccatgctgatcattccactgcaatccaacagcacatccgtaggcactggactgctccccgatttttatgccgccatggcatcgttcctcaccgtctccggccctcggcgtatccgctcatgcaccaaatggggctggaacgtgctgtatgcagtggcagtgctgatggtcgtgctttcatggaattcactggctggcgtcatcgcatcctacgccataggccgtgttatcggcatgctgatccgtttcgccataggcacgcagaacaatggcgcgtggggatcacaaatcgcgcaatcattgcgttccatcggtattgacacatcattgctcacccgccgagtcgccccctacgtcgattcgggagtattgaaggccacgctggatgacgatctgaccgaaaattcccgtatttacgatgttgtcgactatgacggcaagcaatacaccgtttccttactcgacaatcaagtgcatgcggccggatatctcaaccaagtatggcagtggcttcgcctgaccggtgtttccatgcgtcgcgaccgttcctcggttgacgccatgcaccatcattacgccatgattctcggcctgtccaatgccggtttggaaactccgcgcgtgtatggtgtggccgattatggagaatcctccattctggtgttccaccgcaaccgcatgccattggaatgcaaccaaaacaccatgtccgaccatgatatggaagcgttcatggaatatctcaccacagcacaccatcatggcttcacccatcgtcgcatcactccggaaaccctgtcccgcatggaaaacgggcatccggtaatcgcaggttggcataatggcgattatggcagttccgctccgaacttcgcactcgacaaagtacagttgctggttcttcttgccacactcaatggcaatgatcgtgcgatcgcctgcgctcgcaggacttggggagacgagcagctgatcgatttggcacccttcatacagaaggctgccattcccgcttccacgcgcgcattgcctggctgggacaagcatgtgcttaccgatttacgtacgcgtatttcggcgctcgctccgcaggatgtcgcggattccatggaaaaagtcacgctttcccggttcagtcttcgctcgttcattgcgattgcgctgctggtggtcgccgtatatgtggtgttcacccagattcagccggccgaaatgatcaaggccgtcagagacgccaatctcgccatggcgttggtttgcgtcgcgcttggctttgtggcgtggcttggttccgctatcaccttgggtgtgttcatggattccgataaacgcaacacgatcggcttgtattgctctcagatggcgtccggtttcactgcggtgtccatgccggccggcgtcggtccagcattcgtcaacctgcagttccttcgtaaaagcggctatcgcagtacggctgcgaccgcggttatgagcgcggtctgggccgtacagggaggcactaccatcgtgttgttgctgacgattggcctattcaccggccgcaacacattgtccggcatgattccgaccaatacgctgatcatggtgatcgccatcgtcgcgttggttgtgtcggccgccatggcgattcctccagtgcgtcatttggtgaccgagaaataccttccagtggtcaaagcatacgcgcgcaacctggtcaatgtgcttgcacggccaaaggaactggcccttggcattgccggcgcactggtgcttaaccttgcgaccggactgggattctgggcagcattgatggcgtttggataccacacgaatcctgcggaaaccaccttcattttcctgcttgccaacactttgggctccgcggttcccactcctggcggtctgggtgccgtggaggccgtgctgtcggtggcgttcactgccgtgggcatcccctcctccatcgcggtttccgctactcttgtctaccgaatcgccttctactggttgcgtattccggtcggtgcgttggccatgaaatggcttgacatgcataatttgatctgacaaacacccccgtacactttgttttccccctgattttcaaaaaagcgaccaaaacccttgtaaaatgccattttcctcataagagtgcgctaatatcatagagaacgtggatgttcgtaatcagaatgtcccctgacccaagaaggatgctttatggcatacaacaagtctgatctcgtctcgaagatcgctcagaagtccaacctgaccaaggcacaggctgaggcagctgtgaacgctttccaggacgtgttcgtcgaggcgatgcagtccggcgaaggcctgaagctgaccggcctgttctccgctgagcgcgtcaagcgcgccgcccgcaccggacgcaacccgcgcaccggcgagaccatcgagattccggcaacctacggcgttcgcatctccgccggctccctgctgaagaaggctgtcaccaagtaagtcatgtactgatatgttgcttacacgacgaaagccccgaccatgacggtcggggctttcgtcgttcatgacacttgtacaagcgtcattctgcgctacactatgcatatatattagacatcgtgtccatatagatggagagagacatgaccgatcaacgcaaggaagtcatcaatcaactgcatgaattgaacattctgctgctgcataccaagctgaaggccacacgcacacagaccgcgctacgagccgccacacgagtatgcaacgtcgaagcggcacgtcgtggcgtgccaccgctgcaacaacttcccaaaagccatgacacggcaacgcacatgcttgactgcctcagcaccgaggatctttccaccctcagcgaacttctgcagcgcatcatcgacaacaccgacaccaggattctcgatgaagaggttgtcgagcgacgcaaagccatccatgaattccttatgctgaatcacacagatacggaggtgcaggaatgagcgacgagcaggagaccattcccgaagcaaatgcccccaaaccaatccgcatcgacaaacgatccctgttcactcccagtgaagccgtggccgtggaacagcattccacaacaccacatgtgtcacgaacccgttatggaaccgcacgcatcgaaggtcgcctctcctcccccaatgcgagagtacccgcagtcatatcgcaacattgcggcggcatcacagtcaaaggccatacgctcaaatcgttcgcttataccaccgacgctgcgatcatccgtaataccaatgccaacgccattctcgccgtctacccgttcactggagaaccggtgatcacacaggcgttgctcactgtggcacaaatgccacttttcgtaggcgtcggaggaggcaccaccaccggtccgcgtgtgaccgagctggccatggtggctgaaatgcaaggtgcggcaggcgtcgtcatcaacgcgccggcacccgcggaaaccatcgaaaccaccatgtccatggtcgacattcccgttatcgcaacagtcacggaagacgacgaaatcaccgaatgcaagattctcgccggtgcggccatcatcaacgtcgcagccggagcacgcaccgcgcaagtcgtggcaagcatacgtgcgcatcatccggaaataccgatcctggcatcgggaggcggatccgaagatcgcatcctcgccaccatcgaagcgggcgcggatgccatcacatggacgccgccaagcgcgcaacagctgcaatcgcagatgatggcgaaatatcgcggcgaagcctgattcaagccaatcaaaaacgaaagcgaccgcagcgcaatcgcaaaacaattcaggagaacataccgatatgggagtggggtgtgaccgaagcctgtcggccacaccccactcccatcgacgtttcccattgccaccatcgcttactccaaagcgccaatcatggcttggaaatcctcattctccctgcattggaacggatccagcagcaccatatccatcttccgcggcgcatgcaacgatagtctggtccaatcgcaggaatactgcgcgccatgcgatttggccgcactgacgaatctgccgcgcaatgcggcacgagtatccgccggcggcatggtacgcgccttttgcgcctcacgaccgtcaatcagcgaacgcaaggcaccacggcgaagcaacgacgcatacaacgcgccattggccacgtcatgatagtccagatccaactgttccagcttgctcagcggaagatccgcactggaacgggcacgtaacgcttcaaacaggcggtacttgcacacccagtccacgctgtctcccaaagcattcgcattgccggaacggaacgcttccaacgtattgcgccactggcgaagcacatcatgcacatcggtgcgaggcaacgacgaagccacttccggatgctcgcccacaaactgttccacagcctgcagatagcgttcctgcatggctacggcaccaccctgcaacgtcgatccatcggccatggcaaacgaagcattcacgccgctcatatcgcgactgaccgcacggtttgcggcaccagcgtccgcgaacgcgaaccgcgagaatcccgactcacgtccttcacgccccgcctgttcgataacgcacagcaccagatgcgtggtggccagcttcatcatcgtggcccattgagaacggtttgaatcgccgatgatcacatgcagccttcggaaggcgtcgggatcggcatgcggctcatccctcgtgttgaccattggacgcgatcttgtggtcgccgatgaaacagcctcatccagaaaatcggcacgctgcgtgatctggaaacccgattccgtcaccctgcctgcgccagtgaacagctgcctggtaatcaggaacggcagcaattcgtgttcgatgacgtccaacggcacaaaacgacgtaccagatagttttcatggcagccgaaggaatgccctgcggaatccacattgtttttgaacacatgcactgtggcacgtggcccatgcgtggctcgaagcctttgctgggcgtccaacgcaagatcgcgcatcaccagttcgccggccgcatccacggcaagggcgtccatgggatcgcaggcctcggacgtggcatattcaggatgcgatccgacatcaagatacagtcgcgacccgttttcaatatacgtattggtcgatcgcgcggaggcaacgatcggctggaacatcatcattgccgtctggctggcgtcgcatggcacatccgcaccggtcacactgacgccgtattccgtttcaatgccgaaaatacgagcgaaagaatgaacctcacgcaacgttcccgcatcaagcggtgacgaggaatgattgccgctgtctcgcagctgcggcatcactcgccgcctttttgcacgaaactaccgacatattcctcagcattggactcgagcaccgattcgatatcgtcaagcacggcatccaacgcatcagcggttccgtcgacttgtacgccggcggattcgacaatgtcacccacctcttggcctgcggatgcggattgagcctgttcaaattcctgaggcatgacattcctccctgtaacttccggttgcaaacctgcaaaaaaacgctgcgccacaccttatatcaggtgtggcgcagcatgcaacactatgccaaatactggctcagatcattggtgatcagaccattggtggccatcacatcgttctcctggcgccagtgaacgctttcgccattccactgggtcagatggccttgcgcctcccaaatcaccacagcaccagcagacacggcaggtacgtcccactcatgcaagtgcggttcgaaatacgcatcgtacgtaccgtcggccaccttgcacaaatcaagggacgccgggccgacacgtttaatatcggcaggacgtccggcaatcttcgccaccacatcgagcgcacgctgcgattcggacgataccggagacatgccgaaactcaccaccgaaccatcgagggacgacgtggtggaaggaatgattttctcgcgtttgtctcccaacggagtcttgcgaatacgaatcgcgccggatccacgcaccgcaagatacgtcaatcccagcgccggagcgtgcacaatcgaaaggatcggctgtgcggagcactggtcgttgaattcgaacaatgtcacggtgatggcccattccggcatgcttcgcgcgaaattgatcacgccgtcgatgccacccacacaccagtatcgctggccgggatagcactgttcagggcgaagctgccagaagccgtcgaacacgttgacataggtcaggcggttgctgatgaactgctgcaggcgcttgtcggtgtctgaagtgaagtggaagcagtcttcggacacttccagttttctcatgtcgtgcggattcatctggtcgttcaacgcatgcttgcctgcgtcctgcaggatgcgtgcgacttcgagggcgatttgcctcagttccatagatatgccttttcgtttcctctgtacagtcccggcacgtcctctcctcaaaataccgggatgatgttacctgttgtcaatggtcgttcttcgcgaccaattgatggcaatgttacccgcacagattgcatttcaccgtaacatttccaaaatcgacgccgcatcttggacacgctcacaatagcgggaacattgagatttgctatatttcagagggtctgacatatccaatgagaccatcggattctccacggtattatcaccaatcgttcgatggcgcaccgtaagatgcgaccacgatgcggccacaacctgttctggaaaacgacgaatcatttcggcacgcaaccaagcacgggtatcggaaggcgcttccaccgaagcctgcaccaactgcccgtccgtaaacagccgctccgtttgggcacgcaaccgatcgaaaatcgagtcagcgggatcaatcgcagcccactttaaatcgacggccgcaatacgcgcatcatcccaaccggagccaattttacgacgcagcttctccaacaactgccatttcaatagccattcaatgcggccagcttgctcgcgcatcgtcaaacgcgcatcatcatcggcatgcctgatggcagccacatcggcgagcgcctgcccccacatcgccatgatgttacgggtcgaacggtcagaccatgccggttcaccggacgtgtcggttccatagatcacggcagcggcagcatacaccaggccacgcagggtgacctcaatctgccatgccgaggtctcgccgccatattccagcggcaacatggcacctaatgtcaaatcatgagacacctcgtgcatggcgctcaccggatcggcgagcatgattggctccaacgcttcgtctatgttcaatcccgcctcttcggcatgctcaagcagccacagcagcatgctggtggtgccgagtttcagcgcctgcggcacatccatacgattggcgtccccgacaatcacatgcaatcgacggtatgcatccgtgctgtgcgattcgtctcgagtattgatgatcggcctgtcgaatgtggtctgcaaaccgactttcatatgaaaatagtcggcgcgctggctgagctggtatccggcggtttcacttcgttcgccgataccgacgcgacctgatccggtaaaaatctgtctcgctacaaaatgtgccgtcatgagtttcgcaacttggtcaaacggcaccgaacgcagcatcatataattttcgtgggtgccccagcttgcacctttgccgtcgacattattacggtgcagcgcgattgcgataccggtctgttcgctggctttgcgcgcgcactcacgcatgatgagatcgccggcatggtcgtagagcacggcatcgaagggatcatcggtttcgggcgcggaatattcaggatgcgcatgatccacatacacacggccgccattgactgcaatcacattggtgatgttgagctgcggcgcgtccgtcaacagatcaggatgcgcggatgcacgttccagcctggtgccgcgggcgtcgttgaccggatcctcctgccgatagtcccagcgaatatgcttggtttgttcgttcgccgcggcaccgaccacatcgaacgatagcttcaccggattgtaatgctccattccgagagcggaaaccgcgtattccgtttccgtgcccatgattcgacgaacgctcattgatacgacttcccttcgtctgatttcgcgttgcctgccagcattattcgactggtcgtatacgggtgatgcgccctgcttccaaaccattgatacggctccactgttccggattggcgtccaacaccgcatcgcgggtttcaagaaactcctcgtcgacggccttcgccaacagatcgacgccaatcgccgccggctgtccgctttcgatggagattttcacagcacgggttttggcacgatccacaatgtttttcagcaccgcacccgacaccacatccgccagatagatcggatgccattgcccatgctcatcgcacacgtcgcacagataccggtgctcgtccgtcgaatagatatcgctgaccagcaccccaatcaaagccttcgcatccacccctggcaccaacggcaaatcgtcggtcagataatggcggatgatctgcgccgcctgagccgctttcggacgctccacacgaatcttcacatccaaacgaccaggacgcaacaccgccggatcaatcatgtcaatacggttcgaagcgccgatgaccataacattgccaagcgtttccacgccatcaagttcagccaaaaactgcggcacaatagtggtttccacatccgacgacacgccggatccacgagtgcgcagcagcgagtccatctcgtcaatgaacacgatcaccggtttgccatccgccgcacgctcacgcgcgcgcttgaaaatcatgcggatcaggcgttccgactcgcccacgaacttgttgagcagttccggccccttcaccgacaggaacacgccacgaccgccggcagcgccttcggcgagcgcattggccacagccttggcgatcagcgtctttccattgcctggaggcccatacagcagcacgcctttcggcggcttcaaatcataacgttcgaacagttcgcgatgcaggaacggcatttgcacggcatcgcgaatacgttcgatctgctcatccaaaccgccgatatcagcgaacgtgacatccggcacttcctcaagcaccaagtcggcatcatcctgcgcgggaaccaacgcaagcgcgaatctcatggacgaatcgaccgtaacacggtcggacacattgatcgaagttttcgacagcgctcccgaacggcggaccaacgcaacgtttccaccgccatccgcgaccagcaatcgcccatcatcaatgacctgcttcaccgtgcgcactgcgcccacagcatcagtgccggcttgcgaaaccaccaccatattctcgttgagcagcaccgtgcgcccagcctcaagcctggatgcctgcacattcgccgcaaccggcacgatcatgcgacggcttccggaaatcacctcggcgctggcatgctgtaccccctgttcgtccgtgcgagaggaatgcacgcgaaccatggtggcgaaggtcatgggcggtcccgccaactggttcagctgggccttggccttggtgagctcctgggtggcacggctcaacgccttggccaacgcatgattcttggccatcaactggtcgttggcctcacccaacgacgccaacgtctcatcacgttgatccatttcatcagcctcgctttccaccgaatgcgtttcgagccgttccgtcatttcgtcatgtcatggcgcattcgcattcaacatgctcaacccttaagaatacccattgtcctcatgatttccgacaatcaaaaccatgcttgaacaagaatcgccgaacattgcgcccactcccaccctttcccaacctggactgctggtgatggatgtggattccacgctgatcgatgaggaagtcatcgatcagctgggcgccgccgctggaattggcgaacagatcgcgtcgattaccgcacgtgcgatgaatggcgaacttgattttcgcgaggcgttgcaggctcgtgttgcgctgcttaaggatctgccgacttcggtgttcgatgatgtgtatcgtcgcgtgcatttcacacagggggcgcttgatttgattgacgctttgcatgcgcatggttggaaggtcggcgtggtttccggcggtttccatgaagtcgtggaccgtcttgccgccgacgcgcatcttgatttttggattgcgaatcgtttggaagccgctgatggttgtttaaccggccatgtgcttggcgatatcgttacgaaagatgtgaaattgcagtcactgcgtgattgggcttcacgcatgggcatcagcatgggtcagactgttgcggttggcgatggagccaatgatctgccgatgattcatgccgccgggcttggcgtggcgttctgcgccaagcctgcggttcaggcggatgctccgcatcgtgtgaacgaacgtgatttgacccggattcttgattttcttcgttgattcgcattcttcgatgatgcgaatcccgatagatccgagtcgcgatatagcaaaatccgatattgcaggataacgatattgccgtgtgaaatgatgatgttcacacggcaatatcgttatgatccgtttattcgacactacttgcagtaggctccgtcgagatgcgcgccacgcgcccaatcggcggcacgcatggcttttttgccttgggctttgacttccagcaattccaaaggatctgaggaagtacccacccacacgttcttttttccggccacgatccgccctggttctagcgaaacgggtgtgttgggattgctcatatcggcgccctgcgcacgcaacacatgcaacgtggccggttctgcttcggcattggcgtgcagttcgcaccatgcgcccggattgggcgtgcaggctcgaatctgacgatccaccgcgaatacaggaatgtcgaaacgaatatgcgcgtcttcaaccgtgatcttctgagccacctcatatgcgccggcaggctgttccacaggcgcgatctgatcgtcggccatggcctgcagcgaggcggcaagcaaacgggaaccatcctcggcaagacggttcagcagctcacccgccgtttcatgcgctccgatttccacagtggactgcgccagaatcggaccggcatccatggctcgcacgatgcggaacaccgtggctccggtcaccttctcgcccgcccaaatggaacgctgcacgggagccgcgccacgccactgcggaagcagcgagaagtgcaggttgtaccatcccatcggcagcgcgtcgagcacatcctgcttcaggattttgccatatgccaccactgccgcggcctgggcaccggtcgcagcaagttcggaaatgaacgtttcctcgctcggatcggattcaatcaccggcaaaccaaaatcaagagcggcctgcttcacgggattcggtaccagtttgcgtccacgcccggtaggagcatccggtcgggtgagcactgcgaccacttcgaaacgctcggtatcttcagccagcattttcaacgacggcaccgcaacatccggagtaccggcaaacagcactttcagcacgaaaagtcctccttatcaaatcctcatcacatcgttatcatcgtgggaatcattccggccgtatcaacagcatgtaaggcagcggaacgcaacacactatgcctgatgcaccgcgggaatcttcacacccgcatcaatcagcagcgcacgcaacgcacgtgaatccttgaatcgaacgccacgaatgcccgcattgttcgcacctacgatattcatggccttatcgtccacgaacaccgcgccggaagcgtcaatgccgaactgttgcaacgcgaactcgtaaatatccttattcggcttacgcagggagacatatccggaaaccacacgatcgtcgaggctgcgcagaatatcgaaattgtcgagcgcgatcgggaacagatccttctgccagttgctcaatccccacacatgcacgccggccgctttcaaatcgttgatgagcacgcgggcgcccggcaccacgccggtcaacgagtcgacgaaattgtcgagatagtactgcagcatgtcggcccatttgtctccataacgttcacgcatcagggcgacgccgtcatcattcgacatgccgcagtccagttcatcgttgatgtcgtagaagccggaaatatcgttgtcaaggaactgttcaacaagctcgtcgctatagcggggcgtcatcacggccaccggatcccagtagacgagcacgttgccgaaatcgaaaatcacatcggtgatcggcttgcccgcattcaccgcagcttcgccgtcagccatgagcacgtcgtactccatatcaggctctccaggccaacccttcatatgatcctccattcactgctgtgcggcctcatgccgaactgccaacctgtctagtttttcacggcgaggggacgtgcgtcagattcgctccttcggatcaagctgaaaacgcagttctcccggttcacgcgcggccacatggcgggcactggcggaacgcaaacgcaacgccaactcacctcggcgactttgcggcacacgcaccaccgccttgacacgatccgcagtgccttccaattcgcgcgaatcaatggtccgaggctgcggaataggtaccggccccaatacggacggcagcatgccttcggtggtttcgatggcggacaggtcacccccacccaacgcgccgatacgttccagcgtgaccttcaccgcgtcacgacgtccccatacgcatgcggcggcaaacacaggcggcaatgcggtttgttcacgttcccgcaattcggtttgcgccagcaacgttgaattccaaagcatcaacgattgagcgagcgtgggatcggtttcgccgatcaacagggcctgacctcccctgattcgcggcgcgcacagcgaaaccgcgcgcatccacgacgtcaacgtgtctacgcccgcgtcaatgccgaaggcgtacaagctggtccatgcgtcgagaatggccacggcccggtattcgcattccgaggggttcctcccacgtacacggggttctgcgccgggagtggcgatgaccaactgcggcgcaaacccgatatcgggaacaatgccgcgtggctggctcggcgttgaaagcacaatgggcacgccacgaaacagtcggctcagctcctgcgcagttccggcggcacccacacgaaccacgcgcatacgttcgttatggcatgccgggcaagcccattgcacagtggcgacaccgcaccaacgacaacgcaccgacccatcccgtaaccgttccaatggacccgtgcagtacgagcagcgagcctgacggtggcatttcgcgcagctcaatgcttcaccgatgccatcctgcggaatgctcaacagcaccggaccgctttccaacgccttcgacagcactcgcaccgcagtgtgcggcacacgcgctccgatggtcgaatccgcaagtcttgccaattcgtcacggttcagccaacgaatccaaggactcgcttccttggttacggcagggaatgcgtgaatcggcgtactgaaaccgctgacctgggtggcaccgacatgcgccgcatcggtttcccactggctttgcacactgcgcgcattggccatcgcgacgaacacgccattatgcgcttttgcacgtaaccgcaacactccgcgggcgttggcgtaaggcatcatgccatcggcatcctgatagcacacgtcatcgagaatgaggaacaacgcattgccatccaccggcgcatacatcgccgcccgtgtgccgatcacgcaccgcacctgccctccactgatggccagatacgcacgataccgttcagcaggcgccatctgcgcgttcagaatggcgaaatcgccgccgtacgcaccgttggatgattgggttggcgcgaaacagcgcaagccgatcgactgcaacgtttcggccatgtcctcaatctcacgcatggtcggcaacaccagtaccgccggtttgccctgcaataaggccgcggccaccatccaggccacgcactgcctccaatgatgggatcccggcaatgggtcgagcacgaacgcttggaaacgttgcccttccaatgccgtacgaagcaggtcgatattaccgtattgccgctgcaactgctcgtacgattcccgctcgatcttggcaagcgattcgatacgtccgtttttttcaatacccgttcgattgccgatacgttgttcctgttcgacgcgagccacgcgcggaggcaccgccaaacgcaggatattggctcgcgttccgccgaatgcgtccgcgataagtgtggcatcgttgcgcatggattccgacacaagcacacgatcgatgaccacccgttcgatgaaccgcaatgacgattcaggggtttcgctggtatcggtccgtttccaaatgatgccgttgacccgttgcccgccgaagcggacacgcaccattacgccgggctgggcggcttcggaatacttctcctcaacgtaatagtcgaaggtttgccccaaatggatggcctgaatatccagcaccacttgggctatgggatgctccgcagccggcgttttaaccgcgggcgcacgcttgcgccgcttgcgcggggcgagcccgtcaagcgccagctgctcggcatcctcagtactcatgattcaagggtaactcagccttcgatggcagctttcagctcgtcgaccttattggtggtctcccaggtaaaatcagcatcgttgcgtccgaaatgaccgtaagcagcggtcttggaatagatcggacgcttcagatcaagctcgtcgataatggcggccggtcgaaggtcgaacaccttacgcacagcctgctggatctgctcgcgagtcacaccattttcagtgccgtacgtttccacattgatggacaccggatcggccacgccgatggcatacgccacctgcacctcaaccttgtgggccagacctgccgccacaatgttcttggccacccaacgcgccgcataggcagcggaacgatccaccttgctcggatccttgccggagaacgcgccaccgccatgatgagccgcaccgccatacgtgtcgacgatgatcttgcgaccggtcagaccggcatcggcagccggaccgcccaacacaaacgaaccggtcggattgacaagcacgcgatattcatcatgcgccacacgatcggcaagcacatcatcaagcacaggacgaatcacatgttccgtcaactgctccttaagccacgcctgatcgacttgaggatcatgctgcgtggacaccaacaccgtgtcaagacgaacgggagcatcatgctcatcatattcaatggtcacctgggttttgccatcgggacgcagatgaggcacttcgccattcttacgaacctcagtaagacggtaagccaagcgatgagccaaataaatcggcaatggcatcagcacatcggtctcgtcgcacgcatagccgaacatcacgccctgatcgccggcgccctgcgcctcataacgctgctcgcgagatgccttcgactccgcttcgccactcaaacgagccacaccctggttaatctcagagctctgctcggtcaacgaaacggtcacgccgcatgaatccgcatcaagaccaacgcgagaactggtatagccgatattgcgcaccacagaacgcacaatgctctgaatatcggaatagccttcactcgtcacttcgccgaacacgaagaactggccaaccgtggcgcatgtctccacggccacgtgggactgcggatcctgagcaagcatatcgtcaagaatcgcgtcggaaatctgatcgcagaccttgtccggatgcccctccgtcactgactcagcggaaatcaacttcaattcagccatctggctgctcctttcacgaacgccccacacgttcgcccttctgattgctacgaaaaaacgccccgtccttcgcatacgcaatcaatagcttcactatggactattcaaagcgcaccgctcagatatcggggcgaatgaaaacttggaatccggttcttatcgcaagaaccgttacatcagttgccttcggtcagatcgtcttcgccgagggtctcttcaagcagaccatcattgatctcacggaaagcgatggatagcggcttttcctgattctgatactccaccagcggaccgacgttctgcagcaggccctcgttgagctgggtgaaataggaattgatctggcgagcacgcttggctgcgaaaatagcaagagcgtacttggagtccgcatgctccatcaagtcatcgatcggcggttccgcaagaccggtcggggttggctgagtgccgaatgccatattgattatctcccaatcatcagataagccaaaagcttcttttccaaagtcttaagtatagggccgccactggacctgattcaagccctttctctcatgttttcggcaagcgcaagcatcttcggcaatgctcgcgaatataacgcttctgggaattccacatagtgactcttgacaaaaccgtgtcccgcttaaccaccacaatagagaacatggaaatgcgatctgcaaaactgatgaatggacgagtattcgcgggcgcacgcgccctctaccgtgccgctggcgtggacggtaaggatttcggcaagccgatcatcgccattgccaattccttcgatgagttcctgcccggccacgtgcacctgaacaaggttggtcgactgatctccgaggccatcaaggaagctggcggcattccgcgtgagttcaacacgatggccgttgacgacggcatcgccatgggacacaccggcatgctgtactccctgccgagccgtgacatcatcgccgacaccgtggaatatcaggtgaacgcgcactgtgccgacgccctgatctgcatcccgaactgtgacaaggtcgtgccgggcatgctgatggccgctctgcgtctgaacatcccgaccgtcttcgtctccggcggtccgatggaggccggcaccacggtacttcccgacggaaccgtgaagaagaacaccgatctgatcgacgtgatgtatgcctccgccgacgacaatctgaacgaagaggatctgctcgcctatgagaagaccgtctgcccgacctgtggttcctgcgccggcatgttcaccgcgaattcgatgaactgcttgaccgaggccatcggcctggccctgccaggcaatggcaccattctggcttcgcactcctaccgcaaggatttgttcaagcgcgccgccgagcagatcgtcaagatcgccaagcagtattacgacgatgatgacgagactgtgctcccgcgttccatcgccaccaaggaagcgttcgagaacgccatgaccatggatgtggccatgggtggctccaccaatacagtgctgcatatcctcgccatggcgcagtccgccgacgtggacttcacgcttgacgacatcgagcgcatctcccacaccgtgccctgcatctgcaaggcttcgccgtccggcgaatgggagatctccgacgtgcatcgcgccggtggcatcactggcattctcggcgagctcgaccgtgccggcaagctgcaccgcgacgtgcattccatcgattacaagacgcttgaggacaaactcaacgactgggacatcatgcgtgatacctgcaccgaggaagccaagcagatgtatctggcggccccgggccacatcgtgtcccctgatccgtggacgcataccacgctgttcgactccctcgaccgcgaccgtgtgaacggcgcgattcacgacatcgatcatccggccgtcaccgaaggcggtctggccgtgctgcgtggcaacctcgcccctgacggctgcgtggtgaagaccgccggtgtgccgaaggagatttggaccttccgtggaccggcactggtcgtcgaatcccaggaacaggccatcgaggtcatcctcaacgacactctgaagcccggtatggcgctggtcatccgttacgagggcccgaagggcggccctggcatgcaggagatgctgtacccaacgtcgttcgtcaagggcaagggtatcggcaagcaggtcgccatgctgaccgacggccgctattccggcggctcctccggtctggccatcggccatatcgctcccgaggcggcaaacaagggcccgattgccctgatcaagaacggcgacatcattaacattgatatcccgaaccgtacggtgaacgtcgagctttccgacgaagagctggcccagcgccgcaccgaactcgaagccggcgacggctatgtggcgcaccgcgaccgcaaggtctcccaggcgctgaaggcctacgcggcgttcgcccgttccgcagacaagggtgccacgcgcgatccggagctgatcaacaagctttccggtctcgcctgatcctagcgaatattaaataacataatgaggattgtgcagttaatatgctgcgcaatcctcatttttatttcatacttggcttcttttatataaaaatatgcgcccgatatgttcgagcgcatattacaatccttgtaattattatgattacaaatcgaattccgttgcgataaggttccacagttcatctgctgcctcatccacaacattattgacgatgactttgtcgaattccgattccgcggcaagctcgatttttgcggtttccaatcgtttcgcctgctgcgccggagtttcagtgccgcgcccgatcaagcgtcgttccagttcttcaaatgacggcggcgcgatgaacacggtcattacctcgatacccaactcccccgcacgctgcttgacactgcgagcaccttgaatatcgatttccagaatgactggaatatttcgctcaagatgttccacgacaggtttcacgggagtgccgtaatgtgcgagaccaaacacgtcggcggtttccaagaactcaccggcagcttccttgtcgagaaactcctgttcgggcatgaagaaatagttcacgccatccacttcacctggacgaggctgtcgtgtggttgcggataccgacagccagacttccggatgctgctcgcgcacgcgcccgagaacagtgcctttgcctacacctgccggtccgcaaaggacgattaaacggccatgctgggagtcggtcattgcttcctcactctgtattagttgctgaagatatttacaagaaggaattattgttgacaaatcgatgatgatttactcgtcttcttcatcatccaaaatctcatcatcgacttcgttctgggcctcgatgagcgcttgacgaatatcgagcgccacggattccgtagccgcggccaaactggaaatatccggaccatgcgtggcgatgaagcgagacacggtgacgagcacattgcccttggtgcctttgaacaccgtcttgaggtcgcgggtttcagcaccctgccatccgtagcccggagacagaataggaccagtgaacttggctggatcgacaccggaatcattgatccactgaccgatggtggcaccgatgatcaagcctacggaacccataccgtcattgcccttattgaacttctgagccgtgctggcaatgccgtacgccactgttctgcccttgtactcgcctgcctgacgaatggcggtctgcaggctggcgccctcttggttcgaggtcagcgatgcaatgaatacacctcgaccgttgttcagggcatcgttaatgacaccgcccaacgagcgtgcgccataatatggcagcaaagtgatggcgtcggcaagcaacggagacctcggcttgaaatagacatcggcgaatgcggacaccgtagtcggcaagcctccatgcaggcagtcaacgatggtgatgatacccatttgacgggctgcgtacagtacccgctcgagcgctgcgatacctttcgaaccgtagcgctcgaacatggagaactggaatttgacagctgccgctcgcccattggctgcctgcagcatacgcatggagtatagttcggcacccaatgcgtctacgttgtagccccagtcagtaagaagctgcctgtgtggatcgattcccacgcatagcggaccatattgggccatggaattgctcagtcgcagaccgaagtccgaacgctgggcactcatttcttcactgctgaggctgctcatcattactcacggctttccaactcgaatagctgctgggaatgatcctgaatgctcatgatctgataatcattattacgcacggcctcgatggccatcaacacggcggagaattccgtcatggtggtgaactgaggcaaatccgcggcaatagcggctgaacggatggcgtaaccgtcggaacgggagccacgagaattcggcgtgttgagaatcagatcaatggcaccctcttcgatcagctgaacgacgttcttgccgacgctgccctccgcatggtaggtggtgatcggatcgtccggattggaatccatacgcacgctgatcttgtcgacgatcttggactcgatgccgtaacgacgaagcacggatgcggtgccttcggtggcccagatgttgaatccaagctccaccagtcgcgcagcgaacaacggcagctgacgcttgtcggtatcgttcacggagatgaacacgttgccgctggtcggcagaccgccatcgtaggcggccagctggctcttggcgaacgcatgcgggaagtcacggtcgaagcccatgacttcgccggtggaacgcatttccggtccgagcagcacgtctacggtcttgccgagcgacgtacggaagcgcttgaacggaagcacggattccttgacggcaacctgctggccgcggcgaatgtcaccaccgtctccatgaggcagcagcaagccgttatcgcgctgctgctggatggtttcgccggccataatgcgggccgcggccttggccagtgccacaccggtcgccttggatgcgaacggcacggtacgggaggcacgcgggttcgcctcgataacgtacagggtgttggccatgaaggcatactgcacgttgatcaggccttgcacgccacagcccttggcgatggcataggtgccttcgcgcagacggcggatctggtcatcggaaagggtgctcggcggcagagtgcatgcggcgtcaccggaatgcacgccagcttcctcaacatgttccataatgccgccgatatacagctcttcgccatcgaacaaggcgtcgacgtcgatttccacggcatcctgcaggaacttgtcgatcagcaacggagaaggcagacggccagaaaccacggtatcggcctgagcttccttcaatgcgcgatccacatacttgcacagctgggcgtcgtcgtacacgatttccatgccgcgaccgccaagcacgtagctcgggcgcaccagcaccggataaccgatgttatgagccgcctcacgggcttcgtcaaggctcagagcggtgccatagcgaggcgcgttcatctcggccttcttcagcacttcgccgaagagctcacggttttcagccagatcgatggattcaggcgtggtaccgagaatcggaacaccggcagccttcagacgagccgccagagacagcggggtctggccaccgagctgaacgataacgcccttgaccggacccatcttcttttcggcctcgtagatttcgagtacgtcttcgaaggtaagcggctcgaagtacagacgatcggacatgtcgtaatcggtggacacggtttccgggttgcagttgaccatgatggtgtcatagtccttgcccagctcctgcacggcatgtacgcaggtgtagtcgaactcgatgccctggccgatacggttcggaccggagccgagaatgatcacggcttcacgctcacgcggacgcagttcactttcgtccgcatagcaggagtaatagtacggcgtgaccgcgtcgaattcggcagcgcaggtatcgaccgtcttgaaaaccggacgaagatcatacgaccaacgcagttcgcggatcgtgttttcgccttcgtcgcccaagtggcgcaggtgtgcgatctgaaggtcggaaagacctgccagcttcgccttctttagcagcttgcggctcagcttgctcgcttccttgatttcaagggcggtctcgttgatgagtacaaactggcggatgaaccacgggtcgatcttggtggcatcgaagatctgctgttcggtggcgcctccccacagggcgcgctggatctgcagataacgatgctcggtcggcaccttgatggcttccaacagctgctcgacttcctgtacgtcaggcttgtcgccgtcccagttgaagcccatgtggcgcttgtcgatggaacgcatggccttgccgagggattcctggaagttgcctgccagagccatggcctcgcccacggacttcatggaagtggtcagcgtcggatcggcacccgggaacttttcgaaggcgaaacgcgggaccttggtgaccacgtagtcgatggtcggctcgaagctggccggagtggactgcgtgatatcgttctggatttcgtcgagcgtgtagccaagagccagcttggtggcgatcttcgcaatcgggaagccggtcgccttggatgccagagcggaggaacgggacacacgcgggttcatttcgatgacgatgatgcgtccggtgttcgggttgatggcgaactggatgttgcagccgccggtatcgacgcccacgccacgaatgatggcgatgccgatgtcacgaagcttctgatactcgcgatcggtcagagtgaacacaggcgccacggtaatggaatcgccggtgtgcacgccgacaggatccacgttctcaatcgggcagacgaccacgacattgtctttcttgtcgcgcatcagctcgagttcgtattccttccagccttcgatgccttcttcgatcagcacctcgtcggttggggaataatggatgcctgcgcctgcgatgcggtgcagttcctcttcgtcgtgcgcgatgccggaaccaaggccacccatggtgaagcttgggcgcacgaccagcggataaccgaacttttcggcgatcttgtcgacttcttcaatggagtgtgcgatgtcggaacgtgcggattctgcaccagcttcctcaacgacctttttgaagagctcacgatcctcgccgcgatcgatggcttccagagaagcaccgatcagctcgacgttgtacttcttgagcacaccggcctcacccaacgccatggccgcgttcagcgcggtctggccacccaaggtcggcagcagcgcgtcaggacgttccttggcgatgatctgctcgagaatcggcgtggaaatcggctcgatgtaggtggcatccgccatttccggatcggtcatgatggtggccgggttggagttgacgagaatgactcggatgccttcctcacgcaacacgcggcaggcctgagtgcccgagtaatcgaattctgcggcctggccgatcacaatcggaccggagccgatgaccatcacggacttgatgtctgtgcgcttaggcattgtgggttccctccttggcggaacgcatgagatccacgaaacgatcgaacaggtatgcggcatcgtgcgggccggctgcggcctccggatggtattgcacggagaatgccggaatatcaacgcactgcaggccttcaaccacgttgtcattcagatcgatgtggctgacgaacaccttgccgtacttgccgttttcaaacggcgcgtcaacggtttcgccgatcggcgcgtcaacggcaaagccgtggttgtgcgcggtgatttcgattttgccggtggtcatgtctttgaccggctgattgatgccgcggtgaccgaacttcagcttatatgtgccgaagccgagcgcacggccgagcagctggttgccgaagcagatgccgaagaacggatgacctgcgtcaagtacctggcgaagcaggttcacttcaggatcggcctgttccggatctcccggaccgttggagaagaagacaccgtcaggattgagggcttcaagctcatcgaacgtgatggtggatggcaccacatgtacacggcagccacgctcggccatacgatgcggagtcatggccttgatgccgagatcgaccgcggcgacggtgaacagcggttccttgccttcgaattcaccacacggctcgatggtataggcttctttggtgctgacttcgtcgtagaggctcatccccttcatctgcggagtggacttgacctcgtcaagcatggattcgatggtacgcagcttgccattggcgtcaagcagagcatcaccggagaaaatacctgcacgcatcacgcctgcggaacgcaggtggcgtacaagcttgcgagtgtcgattcggctgatgccaacgatgtgattggattccaaatcgtcatcgaggctgccggtggcacgccaattgctcacattcgggctgggatcgcgcacaacataaccggcaacccagattcgtgaggattctggatcctccccattgattcccgtgtccccaatgtgtgggaacgtctgcaccacgatctgacgatcgtagctggggtccgtaagcgtttcctgatatccggtcataccggttgcgaaaacgatctccccgctggtcgtgccgatcgcgccgtaaggttcacccacatacacctgcccgtcttcgagaacgagaacggcatcttgagggtcaaacatcacggcttcggaatcatactggttcaccaaaacccccttatagtcaaggtattcgtaccaaggatagcggccggttaggactcgcgacccggccgaatcgcttaactttcagctttattcagctgaaggttcggtcggttgctcatccacttgagcggcatccgcatcagcgcttaccgcgctgagcagaccgtggatgaatgccggtgattcgtcatcacacaacgtcttggcaaggccaagcgcctcgtcgatggccaccatattgggaacatcatcattgaacatgatctcccatgcggcgatacgcagaatattgcgatcgacaacgcccatacgcttgaccttccaaccggtggaatgctcgtcaagcgtggaatcgatggctgcgatatgttccgcaacgccacgaacgatttcgatggcgtattcaggcagcggagtctgggcgccgggctgctcaatgcgctcagcaagaagggacaggatgtcctgtcccttctcatccgcttcatacaacgtattcagagccctcttacgagcggtggaacgtgccatgaaacttctttcgtccttactctcagttctcgcggccgaggtaggagccgtcggtggtgttcaccttgaccttctcaccttcgccgatgaacagcggaacctgaatctcggcaccggtctcaacggtggccggcttggtaccggcgttggaacggttgccctgcagacccggttcggtatgggtaacggtcaggatcacggaagccggcagttcgacggacagcggggtgccgtcgtggaaggacacgacgcagtcggttccttccagcaggaacttggcctgatcgccgacgagagtctttggaatgtagatctgatcgtaggtggtcatatccatgaacacgaagttgtcgccgtcctcgtaggagtactggaggttgcggttatcgacggtttcgaattccatcttcatgccggcattgaaggtcttgtcaacgatcttgcccgagaggacgttcttgatggtggtgcgcacgaaagcggggcccttgcccggcttgacgtgctggaacttgatgacggcccacagctggccatcgaggttcaggacggaaccgttcttgatgtcattggtagtctgtgccaaattaactcacctatttcttcgtctaacagggaaagcttaaaagagccttgctcattatgccacggtgtgcatactttgtcggtaagccttccatatataggaaaacctccctcggcgaacatgcctcgggaggttttcctaaaaaacgctagttcaagcgtgccctgatatcaagcagaaactactcgatgatcttggtgacacggcccgagccgacggtgtggccgccttcgcgcactgcgaaggtcaggccctcctccatagcgatcggctggatcagctcaacgccgaaggtagcgtgatcgcccggctgcaccatctcaacgccttccggcagggtgataacgccggtgacgtcggtggtacggaagtagaactgcggacggtagttggagaagaacggcgagtgacggccgccttcgtccttggtcagcacgtagacttcgccctcgaacttggtgtgcggggtcacggagcccggagcagccagaacctggccacgctcgacctggtcacggttgatgccgcggagcagcagaccggtgttgtcgccagcctcgcactcatccatctgcttgtggaaggtctcgatggaggtgacggtggtggtctgggtcggacggataccaacgatctcgacgttggagttgaccgggagcttaccacgctcgacacggccggtaaccacggtgccacggccggagatggtgaagacatcttcgatcggcatcaggaacggcttgtccagatcgtgagtcggggtcgggatgtactcgtcgacagccttcatgagttccttgacggactcaacccacttctcgtgatccggagcgtcgtcgtgcagcgcgccgtaagcggaggtgtggatgaccgggcaatcgcgatcgaagccgttttcgtcgaggaggtcacggacctcttcctcaacgagctcgatgagctcttcgtcgtcgaccatatcgcacttgttcagagcgacgaggatacgcggcacgcccacctgacgagcgagcagcacgtgctcgcgggtctgagccatcgggccgtcggtggcggccacaacgaggatagcgccatccatctgggcagcgccagtgatcatgttcttcacgaagtcggcgtggcccgggcagtcgacgtgagcgtagtgacgctcagcggtctggtactcgatgtgggcgatgttgatggtgataccacgctgctgctcttccggagcggcgtcgatctggttgaagtcgtaagccgggttgatgtccgggtactcttcgtgcaggaccttggagatggctgcggtcagggtagtcttaccgtgatcgacgtggccgatggtaccaatgttaacgtgcggcttagtacgctcgtacttttcctttgccatgtgttttgtcctcctggacgtctcgtagtaagccttgaactcacttcaaggcactcgctacattttactgggtttgacgggtttgtgccactttggagcccgaacccagtcagcgctacaaaatactagcgctgactggagacagtttccacttaagcggcagcgcgtgtcactcgccgcgctgggccttgatgatctcctcggagacgttcttcggaacctcagcgtaggagtccatctgcatggtgaacattgcgcggccctgggtcttggagcgaaggtcgccgatgtagccgaacatttcggacagcggaaccttggcgtcgatgaccttgacaccggtggagtcggtcatggactggatggaaccacgacgggcgttgatatcgcccatcacgtcgcccatgtactcttccggagtacgcacttccacggccatgatcggctcgaggatgaccggcttggccttcggagcagcttccttgaagcacatggaacctgcgatcttgaaggccatttcggaggaatcgacgtcgtggacctggccgtccgtgacggtagccttgacgccaaccaccgggaagccggcgagcacgccggattccatggcttcctgcacaccagcatcgatggaaggaatgaattccttggtgatgtggccaccggtgacctcgttgacgaactcgtaggtctcgccctcttcggtgttgagcggctcgaagttcatcaagacctttgcgaactggccggaaccaccggtctgcttcttgtgcgtgtattcctggttcatgacggccttgcggatcgtctcacggtatgcaacctgcgggttacccacgttgcactccaccttgaattcacgacgcatacggtcgacgatgatgtcgagctgcagctcgcccatgccggagatcagggtctggccggactcttcgtcggtcttcacctggaaggtcggatcttcgtcggacagcttcgccagagcgatgctcatcttctcctgatcggccttggtcttcggctccacggccacctcgatcaccggatccgggaaggtcatggattcgagggagataggtgccttttcgtcgcacagggtgtcaccggtggtgatgttcttcaggcccacgaaggtgtagatgttaccggcttcggcggcatcgaccgggttctccttgtcggcgtgcatctggaagatcttgccgacgcgttccttcttgcccttggtggagtcaagcacggtgtcgcccggggtgacggcgccggagtagacgcgcacgaacacgagcttgccgtagaacgggtgggtagagatcttgaagaccagggcagagaacggatcatcggtggtcggcttgcgatcgatctcgatggattcgtccttaggatcgaaaccgacgatggacggaacgtcctccgggctcggcaggtagtcgacgacggcgtccagcatcggctgaacacccttgtccttgaaggcggagccacagagcaccgggtaggcttcacggttaatggtgagcttacggatgccgctacggatctcgtcctcagtcagttcgccggactcgagatacttctcaagcagctcttcgtcggattctgcgacctggtcgagcaactctgcacgatactgctcggccttgtcctgcaggtcggccgggatgtcggtagtgtcgtagtgagcgcccatgtcgccggaaacgtcgttccagacgtaagccttcatacgaatcagatcgacaacgccagcgaagtcgttctcagcgccgatcggcagctgcacgacaagcggggtcgcgcccagcttggttttgatggtgtcgacggagtagtagaagtcagcgccgagcttatccatcttgttgatgaagcagatacgcggaacgccgtacttgtcagcctgacgccacacggtctcggactgcggctccacaccttccttgccgtcgaacacggcaacggcaccatcgagcacgcgcagggagcgctccacctcggccgtgaagtccacgtggcctggggtatcgatgatgttgatctggaacttctgcttctcgtcatgggtctgacggttccagaagcaagtggttgcagcggactggatggtgatgccgcgttcctgctcctgagccatgaagtccatcgtcgaggcaccgtcatgggtctcgccgatcttgtagttcttgccggtgtagtacaggatacgttcggtggtagtggtcttaccggcatcgatgtgagccatgatgccgatgttacggatctggttgagatcattgagcacgtctagtgccatgagtgttccttaactctcgttctcgactaattaccagcggtaatgagcgaaggccttgttggcctctgccatcttatgagtatcctcgcgacgcttgacagaagcaccaaggccattggaggcatcgaggatttcgttggccagacgctcagccatggtcttctcacgacgggcgcgggagaagtcggtcagccagcgcagggacagagtgttcgcacgagccggcttcacttcgaccggaacctggtaggtagcgccaccgacgcggcgggagcgaacctcgagggatggacggatgttgtcaagagcgcgcttaagcactgccaccggctcctgatcagtcttttccttgaccatatcgagagcggagtagacgatgtcttcggcgatcgacttcttgccgtcgagcagaatcttgttgatgagctgtgccacaacagtggaaccgtaaatcggatccggcagcagctgatgcttcttggaaggtcctttacgtgacatatctcttacttcgccttctttgctccgtacagggaacgaccctgcttgcgatccttcacaccctgggtatcgagggcgccacgaacgatgtggtaacgaacacccggcagatccttgacacggccgccgcgcacgagcacaatggagtgctcctgcaggttgtggccttcgcccgggatgtaagcggtgacttccacaccggagctcaggcgcacacgagcgaccttacgcagtgccgagttcggcttcttcggggtggtggtgtaaacacgggtgcacacgccgcggcgcagcgggcttcccttcagtgccaaagtcttggacttcttcggctttgcctgacgtcccttacggacgagctgttcaatagtaggcaacttgaattctccgattcagtggtttctcttgcttttgtgtgaccgccgcactgcacccacactccacgcatctgaatcgtgaagatagccacagtccaccggcccgatggcccatccctctctcaccgtcgcattgctgcgcgtgatgcaatcgagttccgggatatcccaacccgcacgcctgtcacataaggcatgccgttggcacacacgaattatcagtatacggattcccaagacattccaacatgccgtgtcgcaaatcgcaaaagggatggccccggatcctttcgaatccggggccatccactcgggaaggaggttcccacttctttgctacgcgctaccttacgcgcactcttcagtctcgttgtctgttttgcatttgcggcccggcgcctgcgccgtactaccccattgccgctgtttcgaaccgctattgttcagttatatcttaaaggcgttgcgcatgaacctcacggccatcggcgcttcgttgcgacctgacgaattctcgactgatccacaactccggccttcagttacagtataccccaaaacgaacaaaaaacacgggtgaagacacccttaaatcccaataatttcaatcattttgcctacatcagcgcaaagcaacaaaacatcacaatgacacgtttgcaccactcaaaacaaaacattccctgaatcgttttgaaagattcagggaatgcgcaatatgacgacggaatctactgacgaatgtcagctgttagctgtttcggcagcgtcttcgcgggccttcgcagccgagcccttctcgccattgtcggaatcaggatggatctgatgcctgtcatcatgctcacgccaccagctggacagcacggaaccggaaatgttgtgccaaacgctgaagaacgtggacggcaccgcggccaacggattggaagcgaacgacgtcagcgccaaagtcgctcccaaagcggaatcctgcatgccgacctcgaaggtgatggctttctgctgtgcataacggaagcccttcggatataccttgtacataagtttggagaaaccgaagcccaacgcgtatccgcacaggttgtgcagaatgaccaccgggatggcaagcagcgaggaagccacgaacagcttcggaccgttggctgcgacgaccacgccgatgataagcaggatggccacctgggacacgatcggcagagcgaccgtaatcttctcgatcttctcgccgaaaatagcatgacagatcacgccaagagcgatcgggaacagcaccaccttgaccgcattgaggaacagggattccaccgggaccgacacatactgggaagccagccactgcatcaacagcggaatcatgaacggcgcgcacagcgtggacaaaatgccgatggacacgtccagcgccacatcgccacgactcagatagctcatcacgttggacgaggttccggacgggcagcagccgaccagaatcacaccgacggcgagcgcaccatcaagacggaaaatccagcacagcagcacagctaccaacggcatgatgacgaagtgggccacggtaccgacgatgaccatcagaggctgggtgagaatgcgcctgaaatcgtcaagggtcaaggtaagacccatgccgaacagcacgatacctaggaaataaccggtataggatttgccccacaagcttgcctgcggcacgaaatagttgaacacggcccacacaatcacaatcgcggtgaaccacttggtgagccaatcaccaaacgctttgaccttctgcatgaatctctcttccttcacatttcacagcttttcggccgatgatccgcatacgccgtaaacactccgagacggcccacaccgccattacagcacacccttacgcatgcagcgactacaaggtacgcgtgagtttcggatttgtgtaatatgccgttcacataatgaacaatccacagcgcaagccgacgacaggcacgcgcaacacgccgatgtagacatagctggaaaatcgtgtatagttttcatctgttgcgcttctgtatgaagcgaaaacatggtggctatagctcagttggtagagcatctgattgtggttcagaaggtcgcgcgttcgagccgcgttagccaccccggtagagacctcggaagaaattccgaggttttttgctatccggacggcttgaatacagcaaacagccggtcgcaagtcatcagcataggtcagatacaaggagcgcatcatgctgtcttttgaaaacgactattcctgcacggcaacaccggaaatcatcgaacgcatcagcgaaatcgcacaaaaccaatatccgggttacggcaacgacagcatctgcgaaagcgcgaaagccaaaatccgcgaagcatgcgcctgccctgacgcgcagattttcttcctggtaggtggcacgcagaccaaccagaccatcatcgactccatcacaccgcagtatgccggcgtaatcgcggcaagcacaggccatgtgaacgtgcatgaggcgggcgccatcgaattcaccggacacaaggtgctgacgctcccccaccatgacggcaaaatcgatgcgaccgaactcgacgagtactgcgccacgttctacgcggacggcaactacacgcacatggtgttccccggatgcgtctacatttcgcaggccaccgaatacggcacgctctacacgctcgccgaacttgaggcgatccgcaaggtctgcacgaagtacgacatgccgttgttcatcgacggcgcacgacttggctacgcgctgaccgcaaccggcaacgacgtgacgcttgaagacatcgcgcgtatcgcggacgtattctatatcggcggcaccaaggtcggagccatgttcggtgaagccgtggtgttcacgcacggcaatatgccgaaaaacttcgtgacgctcgtcaagcaacatggcgcgctgctcgccaagggatggctgctgggcgtgcagttcgacacgctgttcaccgacgatctgtattgcaggatcgcccgccacgccaacgatgcggccgaccgtattcgcgaagtgctggtggaacgtggctatacgctcaccttcgacgcgccgaccaatcagatcttcatcacgctcgacaacgcgacatccgagcgtttgcagcgcaatgtgcgcctcggcttcatggaaaaggccgacgacacgcacacggtgatgcgcatctgcaccagctgggccaccaccgatgagcaggtggagcagctgatcgcattgctgtagcgcgcatcgtcgctgtcaatcggaaaaataatcattacgacaaacaacaaaaaggcgcaggaattacatcccgcgcctttttgcctacgttacgatcatttatcacgcatgtggttccatttatgctgattgttacgcattgatttgcttattggcattatcggcgatcgcctcgcgttccatagccacgaatttacgcacggaagcagccaccgaataatgctctttagtgtgttcggcatagatttcgccccattccgacagttcatcgggatgatcgacccaccaatcgatgcgccttgccaacgcttccacatcgtcgacagggaatagcgattcgtcacgtaacgcgaactggcctgcggcgctcaacggagacgatgcgatgaccggcaccaaaccggcggccataccttcaatgacgctcaccgattcgagatcggcaatcgaaggatgcaccagcaaatcgccggaacgcagcaacgcgggcatttcggtgttcttatgaaatccgatcgatgtcggtcgggaaagcaaacgtgcggcgagttgctgcaatttctttttcaaaggaccggtgccggcaatcgtcagttcaatatcttgcgcatgcctgcaacgggcgatcgcatgaattaatgcgacatgattcttttcgttcgtcaatcgtccggaagcgacaatgtggaacggaaccggagcagacttccccgcatcgcgctgcgttttcgcagtgaatcgtgattcatatccgttggaaatcacatgcagtttcgatttgtacccgtgagaacgcagcaaacttgcgccaagctcggtcggcacatgcacatggtcgattttgcggtacagccacaaattgaacagccagtagatgaacttgtcgatgcccggaatatatttcagcggacctgccgaatacgtgatgttctccggctgcacatgatagcccgcagtaaccgcgattcccatctgtttggcgactttgcacgcatgctggccaaaacggaacggcgtgtagatgtgcaccacgtccacgcctcggaacgcggttctgaacagcgtgtcgctcggttcggcgaactgcatctgctgctttttcgccacccaactgaccagaggcacatggttgactcgtgccgggtattcaggcgcaccaatgcccacaagcctgaccgtatggccttgacgcttcaattcctccgcccactgcaacgccgaattcgacgtgccgttacctcggtttcccgacgtgtcgaccaccatggcgatggtcaggggtcgctgtgtttcttcctgttccgtctcagacatgcactccatcctacgccgatggcacaatggaaggcatgactgaagagaatcgtgccttgggcactccgcttggtaagcatccgactcgtgttctgtttcttggctccggagagctgggcaaggaagtcactctcgaactgatgaggcttggcgcatgggtgtgcgcggccgattcctatgagggtgcccccgcgcagcaggtggcgcatgaataccgtgcgctcgatatggccaatgccgaacagttgcgcgtattgtttgacgaaatccagccggatatcattgttccggaagtcgaagcgatcgccaccagcgaattggctgccgcggccgagcgtggcgcacaggtggtgccaagtgccgaaatcgcatccatttgcatggatcgtgaacgtttgcgcgtacttgcgcatgaggaattgggattgccgaccacgccgtaccgcttcgcaggctcgctggaagagcttcgcgctggggcaaaaacggttggctacccgtgcgtggtcaagccgattatgagttcttccggtcacggccagtccgtggtgcgttccgccgatgcgattgatgcggcttgggttgaggcacaggaaggtcgtcgcgcgcacgacgagggagacgtttcccgagtgattgtagaagcgttggctccgcttgattacgagctgacggtgttgaccgtcagctccagcgccggcatcgtgacctgcgctccaatcggacagcgtcaggaaagcggcgactatcgcgaatcctggcaaccggcctccttcacacaggatgtgcttatgcaggcgcaacgcatagcgtgcaccgcagtggaaggtctggtggcgaaggccaaggcttccggcgagaagggttggggtgtgtttggcgtggaattgttcgtgctgaccgacggttccgtgctgttcaatgaggtctccccacgtccgcatgacactggcatggtcacgatggcgtcgcaacggttaagcgaattcgcgttgcacgcgcgtgcgattctcggtttgccgattacgcaggaacatgtcgccttgtcgatcccggacggtgccgtcgcggcaagccatgcgatcgtcattcagggcgatggtgaagccgaattccgcaacgtcgccaccgctttgtctcagccgggcaccgatctgcgtattttcgcgaagccggaagtgcacggccatcgtcgcatggcagtcgcgctggccatcggaacagatgaggccgacgcgcgtgctaaagccgagaatgtggccgaatcgctcgaaatcgacatcgcctgacgcactattgccggatactgacggaagactgccggaacgcgcccaaaaaccattcgattgtagcctcccgttggtatcttgttaaccgtcaagttcaccaaactatctacctcccaaacaccaggaaaggcgagtaatggagaagttggaaaagctctacgagggcaaagccaagcaactgtacgcaactgacgatccggaggtgctctgggtcgaatacaagaactccgctaccgcaggtgacggcgagaagaaggaagacttcgccggcaagggcaggctgaacaacctcatcaccacgctgatcttcgatctgctcaagaagcgtggtatcgacagccatctggtggcccgcgtaggcgaaacctcccagctggtcaagaaggtcaccatgttcccactcgagatcgtgctgcgtaacaccgccgccggccacttctgctctcgcttgggcgtggaagagggcatcgagctcaaggagccggtgctggagtacttcctgaagaacgacgatctgcacgatccgttcgtgaacgacgacgatctggttgcgttgggcgtctgcacccgtgaggatctggctgagatcgcacctctcgcccgccgtatcaatgaggccctgatcgagatcttcgccaagatcggcatcaagcttgttgatttcaaaatcgaaatgggtcgcacttccgacggcacgctgctgctggccgatgagattacgcctgattcctgccgtctgtgggatcagcgtgacggctccggcaaggttgagcatctcgacaaggatctgttccgccgcgatctgggcgacatcattccggcttacgaagaggtcgaaagccgcttggctgaactcgccaagtccgaaggcattgaagtagccgaataatacttgcgatagcccgcatctgcagtacaaactcggatgcgggcttcatcgtttttgaaaatcttatttttatcaatctcaccaagcccctctttcaaggagtcaaccatggtttttcgcgtgtacgtggaaaagaagcagggttttgatgtcgaggccaagcagctcgccaacgagctgaagaccattcttggcatcgcatcgctgaagaatgtgcgtctcgtcaatcgttatgatgtggaaggcattagcgaggaactgttcgcacaggccacccctaccgtgttcagtgagccgcaggtcgataatgtttccgccgatttgcctgatttcggttctgataatgtgtttgctgtggagtatctgcccggccagttcgaccagcgtgcggattccgccagcgaatgcattcagctgatctcccagggcgagcgcccgactgttcgttccgccaaggtgtatgcacttgaaggcgagctgggcgacgacgatatcgccgccatcaagcattatgtgatcaacccggtcgaggctcgcgaagcttcgctggataccaagaccacgttgaagacgcaggtgccggtgccgggcaaggtggagatcatcgaaggtttccgcaccatgagcgacgccgatcttgaacagttcatcgccgaccgtggcctggccatggatttggctgatctgcagttctgccgtgctcacttcaccgaagaacagcgtgatccgacaatcacggaaatcaaggtgatcgacacgtattggtccgatcattgccgtcacaccacgttcggcacgcaacttgatgatgtgcagattgacgacgcgaccgtgcaggccgcgttcgataagtatcttgagatgcgtcacgagcttggccgcgacgaaaagcccgtatgccttatggatatgggcaccatcggcgcgaagtggctcaagaagaatggtattctgaagaatcttgacgaatccgaagaaatcaacgcctgcactgtcaaggtgaaggttgatgtgaatggccatgatgaggattggctgttcctgttcaagaacgaaacccacaaccacccgacggaaatcgaaccgttcggtggtgcggcaacctgcatcggcggctgcatccgcgacccgctttccggccgttcctacgtgtatcaggccatgcgcgtgaccggtgccgccgatccgaccgtgccggtgtccgagacgcttgaaggcaagctccctcagcgcaagctcgtcaccaccgccgccgccggttattcctcctacggcaaccagatcggcctggccaccggtcaggtggacgaaatctaccaccccggatatgtggccaagcgcatggaggtcggtgcggttgtggccgcgactccggccgatcatgtacgccgcgaaaccccggctccgggcgacaaggtcatcctgctcggcgggcgtaccggccgtgacggcatcggcggcgccaccggcgcgtccaaggcgcataacgtcgaatccttggagcttgacggcgccgaggtgcagaagggcaatgctcccgtcgaacgtaagctgcagcgtctgttccgccgcggtgacgcatgccgtctgatcaagcgctgcaacgatttcggcgccggcggcgtatccgtggcggtcggcgagctggctgacggcctgtatgttgatctcaacaaggtttcgaagaagtacgagggcctggacggcaccgaacttgcgatttccgaatcccaggagcgtatggccgtggacgtggccgccgaggatgtggacgagttcctgggctacgccaaggaagagaatctcgaggccgaagtcatcgcgacagtgaccgaagagccgcgcatgacgatggtatggaacggcgacacgatcgtggatctgtcccgcgagttcctcgcctccaacggcgctccgaagcatcaggtggtgcatgtcgaagcgcagcacggctacgccaccccgtggaagaccggcacgctcgccgaacgcatgcacaccatgctcaccgatctgaacgtggcttccaacaagggtctttccgagcgtttcgactccaccatcggcgcaggcaccgtgctcatgccgttcggcggcaggaagcagctgaccccgaacatggccatggtcgccaagctgccggtgttcggcgagaccaccaccgcctccgcgatggcttggggcttcaacccgtacatcatggagcagaaccagttcacaggcgcttatctgtctgtggtcgagtcgctctcgaagctggtggccgccggtttcgaacatgagaaagcgtatctgagcttccaggaatacttcgagaagctacgcgacgagccggagcgttggggcaagccgatggccgccgtactgggcgctctgatggcgcaggtcgatctaggcgctggcgcaatcggcggtaaggactccatgtccggcacgttcgaacagctggacgttccgccgaccctgatctccttcgccgtggctgtgggcaacatgaagcgtgccacttccccagagttcaagggcgctggtcaccgtgtgatccgcatcgcgccgcgttaccaggccgacggcctcacaccggacaaggattcgctgctggaggtgttctccgcagtcgaggagttcaccgatttcggcgatgcgctggccgtgtccacgcctggctacggtgccaccgccgaggctatcttcaagatgacggtcggcaaccagatcggcgtgaagctggccgatggcatcagcgtggacgacctgttcgccccggcctatggttccttcatcatcgaacttgccgacaccgcgaaggttccggccgtatccaacctggttgaggtcagtgaggtcggcgagaccaccgaggcctaccagttcgtggcagccggtgagacgctggatctggccgaactgcaggacgcttgggagggcggtatcgaatccgtgttcccgtaccgatccaagggcgatgaaaagggcaagaccgttgagaccgtgtccttcaatgcgccgaagaagaccgtatacaccggcgccggcgccgccaagccgcatgtgatcatccccgtgttccccggcaacaactgcgaatacgattccgcagccgccttcgagcgcgcgggtgccgacgtgagcacactcatcgtgaacaacctcacccctgctgctgtggctgagtccaccgcagctttggttgaggaaatcaggaagagccagatcatcatgattcctggcggcttctccggcggcgacgagccggatggttccgccaagttcatcaccgcgttcttccgtgctcctgccgttaccgaagcggtgcgtgacctgttgaacaaccgtgatggtctgatgctcggtatctgcaatggtttccaggcgctgatcaaactcggcctggtgccgtacggcgacatcgtgccgatgaccgccgaatgcccgacgctgacgttcaacaccatcggccgccaccagagccgtctggtgcgcacccgcgtggcgtcgaatctctccccgtggctggcaaagaccgaggtgggcgacatgcacaccatcgccatctcccacggcgaaggccgtttcgtggcttccgacgatatgctcgcccagctcaaggccaatggccagatcgccacgcagtacgtggacgaggccggcgtgccgggcatggacctgagcgtgaacccgaacggttcactgctggccatcgaaggcatcaccagcccggacggccgcgtgttcggcaagatgggccactccgagcgttacagcaacggtacgttcaagaacgtgcccggcgagaaggatcagccgctgttcgcagccggcgtggagtacttcgccgcctgatccgcgaccgcatccataaaagcgttctgacgtagattcgaacatacagaggctgtttggtttgatcgggattcctccctagtcaaaccaaacagcctcttttttggtctccgacgcatgttaggcggagaggtagccttcggcgagattgacgggggtgttggcgcgttccactgcttcgttggaatgggtggcggtttgtttgatgatgtcgtcgtagccggtgagagcggcgaaaggcatgaattgcgcggcacggttgtgcatgctcatgtgcgggcgcgtgcacgagcgatgatgaggcaagttgatgatgtcatcgtaacggtcggtttgctgcaaactcatgctgcatgacctccaatctgccggttgcgctgttgacctgtggcatcagcgaacatgtccatccctttaatgacggcgtttttgccgaacttgcgtttgatgtcaagaatcgtctgctgcacatgctgttcggaaatctcatcgacaacccgcatatcgtcagcgtaggaagaccgcacgttgttatcgacgttatcactgcaatcgttgctatcgcttccatttgagacttcctgcatatccgaaaacagatcgggctgaacgtaattcgccgcagcattccgctcagccagctgttcgaccgtttgcaaatcagaagcaaccacattcaatcgacgtaccaacagccgatgatcgacgattctgcagaacaattcgtcaaccgcatcgcatatgcgcgtggtggatgacgtatggtcgtccagaccaatcgaccctgtagccggcttgggcacacgccgaccatacctatcaagagttacgggaccgctatattcggcaatggctcgctcagccatcgccttcaattccggagtgccacactcccctagccgctttggatcaagactggcggtatcgtaaccgaccatcaaccccatatggccggccttcacacctttggcaaccaagtccaaagacaaggcgtccgccatttctctcacaatcagccgcgccgagtcaaaaccgaccgcgcccgtaagcacctgccccgaactcatactatgaccagctggcttatacgctttgatgtcggcgatcgtgcaaggttcccaaccccacgcatggtcgataagcagctcggcgttcacaccgaacatcttgtacagcaggccctcgttgtaatactcgtcggcacggcctatggaacatcgggctatatcgcccattgtcattagaccttgggcttcgagcttcttcgcataccctcgtcccacacgccagaaatcagtcaacggcctgtgcgcccataacagccgacgatacgacatctcatccaattgcgcgatacgcacgccatccttatccgcgggaatatgcttggcgaccacgtccatagccactttcgccaaatacatattcgtaccgataccggccgttgcggtgatgcccgtctcccgaagaatctgctggatcatttcacgggccatatcatgcgcgcttttgccgtaagcccgcaaatacccggtaacatccatgaatacttcatctatcgaatagacatgaatgtcagcttcggatacgtaccttaaatatatgctgtagattttcgcactgatgttgagataatgcgacattcgaggcttggctatatacacgccggcagccagattcggattagctgcgagcgctttcgcatcatacgattcacctctcagcacaccgcccggtgccgctgcccgccgtgcagcattgacttctttaagcttcgctttgacttcgaacagtctcgcccgccccggcagtccatatgctttgagcgatggcgacacggcaagacagatggttttgtcggtgcgcgattggtcggccactaccagatgcgtggatagagggtcgaatccgagttccgcacattccgaagacgcatagaaggatttcagatcgatagcgatataggtacgttcggccatcttcagactccttccatgatttggctccatcttgaaacgtcaacgagcacttcgcctcgcaaagcaccgacaaagcatcgccgatgcaccgcactgtattttcctgcattcagcatatcagagagttcgaacaattgttcgacacacccgacatgccaagtgcccctaaggactccacgaaaaccgccaattgtagcctccggttggtagggttgaacggtagcgaaccccttgtctccatggttttggaaggagctttggcttgtcagctgaactcgaagacatccacgaggaatgcggtatttttggcgtttggggtcacccggacgccgcccgactcacctacttcggcctgcacgcgctgcagcatcgtggtcaggaaggcgccggcattgtctcgaacgataacggtcatctcatcggtcatcgcggaacgggtctgttgacccaagtgttcggcgacgaacgcgaaatcgaacgcctgaagggagacaaggcgatcggccatgtgcgttacgccactgccggttcaggcggcaccgacaacatccagccattcatcttccgcttccatgacggcgatatggccttgtgccacaatggcaatctgacgaactgcccgactctgaggcgtcagttggaagacgaaggcgcgatcttccactccaattccgacaccgaagtgttgatgcacctgttgcgccgctccacacagcgtacgttcatggacaagctcaaggaagcgctcaacaccgtgcatggcggtttcgcctacctgatcatgaccgaagacgccatgatcggcgcgcttgatccgaacggtttccgcccgctttccctcggcaagatgaaaaacggcgcttatgtgctcgcttccgaaacctgcgcgcttgacgttgtcggcgccgaattggtgcgcaatattcgcccgggcgaaatcgtggttatcgacgatcacggctacaagatcgtgcagtacaccaatcagacccagttggccatctgctcgatggaattcatctacttcgcacgccccgattccgacatttacggcgtaaacgtgcattccgcccgcaagcgtatgggtgcgcgtctggcccaagaatcgccggtcgatgccgatatggtcattggcgtgccgaattcctcgctgtccgcggcctccggctatgcggaagaagctggtctgccaaacgagatgggcctgatcaagaaccagtatgtggctcgaaccttcatccagccgacgcaggaactgcgcgagcagggcgtgcgcatgaagctgtccgccgtgcgcggcgtggtcaaaggcaagcgcgtgatcgttatcgacgattccatcgtgcgcggtaccacgtccaagcgcatcgtacagctgctgaaggaagctggcgccgccgaagtgcacatgcgtatcagctcgccgccgctgaagtacccgtgcttctacggcatcgacatttccaccaccaaggaactgatcgccgcaaagaagtccgttgaggaaattcgcgatttcatcggcgccgactcgttggcgttcctttcgcttgacggtttggtcgagtccattggattaggcgcggacgccccgtatggcggtttgtgcgtggcctacttcaatggcgactacccgaccgcactcgacgattatgaaagtgattttttgaagtccctcaccccagaagatcgcgtgcgtctgcctgaattcgccttgtataagagcaagtacgaaggcaacgaatacaccaccacttcatcccaagaagaacactgaacccgagaaaggtttgatatgccaaaagcatatgaggaagccggcgtaagcgttgaggccggttacgaagtcgtcaagcgcatcaagtcccatgtggcgcgcaccaaccgtccgggcgtggtcggcggtatcggcggcttcggcggcctgttcgatctggcttccctcggatacaaggagccggtactgatttccggcactgacggcgtcggcaccaagctggtcgttgccaagatggccaacaagcacaacaccatcggcatcgactgcgtggccatgtgcgtcaacgatattgccgctcagggtgcggaaccgttgttcttcctggattacatcgcctgcggcaagaacgatccagcactgctcgagcaggttgtggctggcgttgccgacggctgcgtacaggctggttccggtctgatcggtggcgaaaccgctgaaatgccgggcatgtatgacgaagacgagtacgatttggccggtttcgcggtcggtgttgccgagaagtccgcaatcgtggacggctccaccatcgctgagggcgatgtgctcattggtctgccgtccaccggcgtacattccaacggcttctctctggtgcgcaaggccctgttcgagaaggctggctataccgtcgataccgtgcttgacgagctcgacggcgaaaagctcggcgacgtgctcctcaccccgacgaagatttatgtgaaggccctctccccgctgttcaaggccggcgtggtcaagggtgtcgcccacatcaccggcggcggcttcatcgaaaacgttccgcgtatgattccggacggtctggccgcacacatcaacctcggctcctggccggtactgccgattttcgacgtgctcgaaaaggccggcgaagtcgaccatatggaaatgttcaacatcttcaacatgggtattggtatggtgctggccgtcaacgccgaagatgccgataagaccatggaattgctcaagtccaatgacgaagccggttacgtactcggcaatatcgtcaagaagaccgatagcgacgtcgaactgcagtaaatacatatacgggggtgagccataacggccacccccctttatttccgaagactttcctgaacataggattttcccaaaagggacacaacaggaggaaacatgaaggttctggtcattggttccggtgcacgcgagcatgccatcgcccatgcacttatgcgcggcggcagcgtcagcgaagtcacggtggctccgggcaatccaggcatggagcttgacggcatccgcaccacgcagatcaacccgtccaatcatgccgcgctgattgatttcgtgaagaacaacggctacgactgggtgttcgtcggtccggaagtgccgcttatcgagggcatcgtcgacgatttcgcgggagctggcatcaaggcgtttggtccgagcaaggccgccgcgcaaatcgagggttccaaggatttcgccaagcagttgatggagcgtcacagcattccgaccgcaaagtatcagacgttcgacgatttggagcgttccaccgcttatgtgcgtgaacatggcgctccgattgtgatcaaggctgatggtctggccgctggcaagggcgtgaccgttgccatggatgaggaaaccgccatcgccgctcttgacgacattttcgtcgatcatcgtttcggcaacgccggtgcgaaggttgtcatcgaggacttcttggagggtcaggagttctcgctgatgagttttgtgaatggcaccgatttctggccgatgccgatttctcaggatcataagcgcgcttatgatggcgataagggtccgaacaccggtggcatgggtgcgtacagtcccgttccgcagatcggtcaggatgtggttgacaccgctatcgaaaccattgtgaagccgaccgtgcaggctatgtccgatgagggtacgccgttcacgggcattctgtacgctggcttgatcgccaccgcggatggtccgaaggttatcgagttcaatgctcgtttcggcgatccggaaacggaagtcgtgctgccgaagctcacgtctgatctcggcgccggcatcagcgctctgctcaatggcgagactccggagttcacttgggataatgacaacgccacgcttggtgtggtgctcgccgccgacggctaccctgtcgatgtgatcaagggcgctgcgattcctgagattccagtcgatgaggattcccacgtctattacgctggcgtggctcgtagcgaagaaggtctggtcgccaattccggccgcgtgctgttggtggaaacctccgcagccgacatcaaggccgctcaagacaaggtgtatgcgattatcgaccagctcgataccaagggcatgttctaccgtcacgacatcggcgccaaggcactgaacatctgaatgcacccagcgattgcataccatcagaaatgtctgtaaccatacaatcgcaatcatatatataaaaaggacggcggttttgtggtcggacagagaggagtccgactgcaaaaccgccgttttttaatcacacaacacaggcaagcttatattgattacttctgctctcccggcttcggaatgagcagggatgcgcagaacgcgaggccgagcagaatcacaccgccaaccatggctgcgatgtagccgctggtcgcaccgccggatgcggtgaacgcgttctgagcagcgtacagcactgcataactcagaccggcacccaggttgaatgcaccggagttcagaccaggcaggtagcccggattgtcttccggagagagcacgatgcccagaccgttcagcatgatgttggcagtacctgcgtaggaaacacccaaagccaaagacatgaccacaagtgcccagatgctcggaacgttgcacacgaagatgccgaacagcacgcccacaacagagacgatcaagccagtacgcagcaccgcacggtagccgaacttcgaagcgagcacgcctgcgaccgggccgaatgcgagaccgatcaacgcatacggagtcagggtggcgaacgataccacgctggcgctcatgccggcgccgacttcggtatcctgagcgagagcaggcacgataccgttcatgatggcgaacacgccggtcatggtaagcagggtggtcagcagcagaccccaagtacgacgctgcttgaggtaatgcgtggtgaccatcggagccttctgacgcttctcaacattccagaacaccacgaacagcactgctgcaataatgatttcgacagcgaccagcgcccaattggcggagcccagcttctgaatctcgttgatggccagatatgcggccaagaatgcggcggcaagggaaaccacgccaacccaatccatcttcggagtctcggaagcggtggattcttccgcatacacgaacacaagcacaatggcaagcaccgcaacgccaaccatgacccagaacacggaacggaaaccgaacgtgccagcaagccagccgccaagaatagcgtcgacaccgccgatgccaccattaacggaagtcagaatagccatgagcttggcgtacttcttatcttcagtaaccttggcgtgcagcatgatcagcgtcatcggcacaatcggaccggcaacaccctgaatcacacgaccgatcatcagcatcggcacgttgaccgcgagcgcggaaaccacgcagcccaaagcggtaagcacaagaatgccaagcagcactttcttgcgaccgatcaaatcgccgagtcgcggcaggaacagcgagaacactgcgcacgaggtgaagaacaccgtctgggtcaagccaatctgcgcatcggtggtgttgagttcaacacgcatggtcgtcaatgcaggcgaaagcatggacgcgttgagctggaacgcgaagatggctgccatcaatgctgccatcaatgcgacgacggacttgccgccttcgtcgagcattttgctgtttttggtctctgtcattagagcacccctttacttatctttctcttctttcagccgatggtcttgattgcgtcggttaccaaatcccagaatttgttgaaatcaagcttgactgcaacctgggtgtggcattcttcggcgctcggctctggacctcgcaggtcggcgacggtcatgccaagtgtgagatctccatggatttcgacatcaaccgggcaacgacgggtggtcatgacgctcggatcaatgaggtatgccaccgtgcacggatcatggaccggaggatcgatgaaatcttgattgtcttgataggtcttgcggaagaagtccatcagaccagacacgaacttggcgagatcagtgccaacgccttcgatacgctgctgcacttcgggcgtgcacaatgcctgatgcgtcagatccaatccgaccatggtgatcggccaggcttcattgaacacgatgtgagcggcttccggatcgaccttgatgttgaactcggccacggcactccagttgcccacatggtatccgccgcccataagcacgacttccttgacacgttcaacaatgcgaggctccatgcgggcagccatggcaatgttggtcagcggtccggtcggcaccagagtgatggtgcctggctcgttgctcataatggtgtcgataatccagttgacggcatgtccggcttccagcggacgactgggttcaggcagttcaacgccgtcaagaccggtttcgccgtgaatggaagctgccacttcctgcttgcgcaccagcggacggtcacatccggcatgcaccggcacgtcggtggcatgcgccttttccagcactgcacgggcgttgtaggtcaccttgtcaaggctctgattgccacctaccgtggtgacgcccagcagatcgatattgggattgcccacggcaagcaggatggcgacggcgtcatcatgtcccggatcgcaatcaaggatgattttcttggacattatggttcctccttatgtgctccaactttgaaccgataatgaggtggtcgacgattgactgactccggctcatcggtcacacaacttgttgcaaggccggcaatggcctttgatatcagcgacttccgaaaccttcgagcagttgttcggctgcctgaagatcgatgtcacgaggtgtgtttcctgcaaaacgctcgtcaactacggcctgcgcattggaaacgagttcttcaacgctgatgccgtaatcctcaacaggatgcagaccgagcatgcggtcgcggaaatccttgaacgctctgcttgcgataatcgcaacctgctcgtccggcgcattttccgggtagaccgcacctagaatctgaccgatctcacgaaccttatgcgcacgtacgggagcaacgaactccataaccgccggcaacgcgtagccaacggcttcaccgtgcacgatgtggtatttcgctccgagcacgtgtgcgatggaatgccccgcaatggttcccgcattgttcagcatccatcctgcaagcgtcgacgcgaccatcacacgttccctggcttcacgatcctgaccgtttgccacagcacgcggcagatagttgtacagcaggaacatcgctttttcgcaaatggcatccgtgaccggacttgccattcgggaaaggtatccttccgcggcgtggcagaatgcatcaagtccgcaagcgatggtcatttttgcgggcagtgtcagcatgagatccgcgttcagcacggcatattcgctgactgccggatcggcaagcaccgcgagtttacgaccggtggatccttcggtgaccaccagcgcgttggacatttcgctgccggtgccggcggtggtcggaactgcgatcataccgttgcatggtgcgatcggcttggctggatcggtgtattcgatgatggatccgccgttgacacgcacgatgttgatgcctcgggcaacatccatggaactgccaccgccgatggcgatgatgctgtcagccttatgcgcttcgaatgcttcgacgccggattccacggtttcgcaaagcgggtcgggcttgacctggtcgaataccgccacatcgacaccgacctgttcaagcttggtacgtgcggcaacgaccagcggcatgcttccgacgaaggaatccgtgaccatcagcggacgagaatagcccgcggtctgcatgatatcgaccagagtctcccctaaatcgtcagtgcagaccactttgacgggttgcagcagtttgacttccatagccatcggtcactgtccgatctttgcggccgcagcgtcggcattgatgcagaattgacgaaccttgtcgatgtctttctccatgtagccgccgtcgtatttgatgctggtcttcgtcagggagtccacgccatacggcttgcactgttcgatggcttcggcaacattgtctggtccaagaccgccagccatgatgaccggcttgccgcattcggccacaatacgggcgtcaatgctccagtcgtgggtcagaccgctggcaccaatgccggtgtcgggggccagaccggagtccgtgaggatgagatcgcagtattgtgcgtacttcttggcacggtcgacggcggattcatcgtcaacgagcacggcctgcatgagtttggtgttcggagcggcttccttaagtcgggccgcgaatgcttcatctgcggcgtacccatcgcctgcgatatgcagaatgtcaggccgcacctctctggcaagctcgatcatctcgtcgggatcgttggtcagcatgatggccacggaggtgacgccacgacgcttgcattcgtcgaaaatgcggtgcacgcgttcgattggcacacgatgtgccggaacgccaccattctgcatcggcaccagtccaatgttgtcggcaccagcctccatggttttgacggcctcatcgtattcgatcagagaatagatctgcttgactaccattgtcggttctccttgtgtttgtatgggttgatggacgtgtgatgtagcaaaattcaggcggtacgcacttcgtcgagcaacggctcgatctcgccggacatcttcttacgtatgcgttccacggtgatatcgggcactgcttttgtgcattcgagcgcgatgctggatgctgcctgcgcaattttgccgacttcttcaagatctcgatcggggttatcgaagaagctccaggtgatggctgccatgccggcatctccggccccatttgccgtggcgatttcggtacggtatggcggcacatgcttgaagctgtattcgtcgttttcgtgtctcgcgcacaggattccgttggcacccaatgaaatgaatacgttcttcacgcccctgtcgagcaaggtcttcgctgcggcacctgccgaatactggtcggcgataccgatgccggtgagtacggatgcttccaaatcattcggcttgagcacggtcatcttgttgaggatcgtgtcgaaacggtgcgctttgactgtggaaacggtgtctccgaacagtggcgcggtgacgtgttcgccaatccatgccatggtttccggttcaagattggcgtcaagcaggcagatggcggcaccgttgatgaagtcgaggcgagattcgaggaatgccggattgatttccttgcagatttccatgtcgttgacggccaccagcagatcgcccgtatcgtcggtgatgaacatgtaggtggaagaacggcgtccttccagctgtgcggcatagtcaagattgatgttgttggccgcgcacgaacgttccagggtcttgccgttttcatcgtcgccgtagacggtgatcaggtatgtcggcatgcccagatgagccatgttctgtgcgatgttctgcccgacaccacctgcggacatgctgacgacgcccggattcgagtctcggtccactacggtgctcgtcggtctaccacagatgtccatgttcatgccaccgatgaccacaacgtaacggtcaggaacagtatttcctgaagtcatatctgccatggatattgcctcctacattttcggggatatatctgccttgatacacccttgatgaaacgttttatcttcaatttagaatacaacaaaagtttaagccagtcaacttttgcttatatttcatcgatgtaacatatggaaaaatcgcgtgtctcgcgattacgaaagaaacaaatgtaagaccgccatacctgcgttactgcagcaaatcagctttgcgccgcacagcttcttcagaaaaatcagcgcaaatcgactgcacctgagacatattcatcgcagccgccgcagacgcatatctagcgcattcccgctgtgttttatgctcacgacgcgcccacaccagcgcactcaacgccgccgacgcaccaccattggtatatcgacgttcctccgcccttcccggcaaagaccagaaaaagctttcatgttcgcagcagtacagcatgtccgaatcatccacaaaaagaaacacattacgcacaccggaccgcagcaaatgttcggcgcaatctctggcactggcctcgtcatgcacctcaatccccgacacgaatttggcttcggcggaattaagcaccatagtgtcgatgcgatcgagcaccggcgtgattcgcgccgctttattaacggaaaccacgcgcacgaaaatcggtcgacttgttttttcgcaaacccatgctatggcatcagacggcaagctcgaatcaatcgccaccatttccgcattgacgatggtctgctctcgttgcgctagaaattccggggtgatttccgcactgatctgcatatcatcaagacccacaatctgacgcccctgcgcggaaacaaccgacaagaaggtggaagtaggcatatgggaaatctgcttggcatgcgtgatgtcaatgccgttggcatacgcgtcctgcttgacgcgttcgccgttctcatcatcaccatagacggaaatcaaataattcggcacgccaagccggttcagattgtaggcgatattgtaaccaatgccgcccacggatgacacaatgcgccccatgttggaactttccccaaccacatcctgcatggcgacaccgtaatggtctatattgatggcgccaacaacagccacatagctgggcggagtgacgatataccctttgccttggatgtacccttttttcatcaggttggagatgtgcgcggccacccctgaacgggtgatgccgcacagttccgcaagctcgttttggctgatcaaaggattctgcttaatccacgccaaaatctgctgttcgcgatcggttgcggccatctcttcccccttgcctctagggaagatccatgaaatcggtgtctttcaggtagttcttccctgtggtgatatcgtactgaatcagctggtagtcggcaagcaactgctgggtttccgcgtcgaagtcgctttcggccatgggattgccgtcagcgtcgagatagatgttctgaccttcagggatacggtcccatccctggatattgttgacgacaggtggctccatggcggagattttctcatgcatttgcgtgaggaacgccagatacggggacaccttggcgttcatatgctcggcggcctgcgccacgaagaagttcggcgacgaatagtcggcgttgtcgatctcgttgccttgcgagctggacgccttgttggaccagatgaaataatccgtcagatgcaaggcaagcgaattgttgtcgtcttcggaagcggacgaataaatgcccggcagatgatcgccgtagaacaccacggtgatcggcttgtcgatggcgtcgagcttgtcaaggaagtcggcggtcgcctcgtcggtcagagccgcacccttctgataggtttcgatggactccttctcatcgtcctccaaaggagtgtccgtagtggattcggccttgaaatcgttgttcttataccaatcgtggtatggcatgtggttctgcatggtgatgacctgcaggaactggttgccatcggttttcttgacttcttcgatggtgctctcgtacgtcgcttcgtcagacacgtacggcgaatcgtcgatcttgtcttgatgcgagatgacgtccggaccggtcaacgtgtagaaatgcgagaatccgaacttcttatagttggtcgcacgcgagtacatagacgattcgtacgggtgcagtccgatggaattcttcgacgccccccacagttggttgatggtcggcgtccaatgctcgctcggcacaagctgctgatacgggctggtgagcgacgaatcgaaattcgacatgctcaaacccgtcaatcccatgtattcgaggtttgcggtaccaccgccatatccggaagaaagcatcaaaccggaggtcgtattctctttgatggaacgaatgttgggcatggaatccttgttgatcttaagacccggcacgcgagacgggtcggagaaggattcggacagcacatagatcaccgtactgtcggtcatgttctcggtacgagatgcgttgatcttcttcgcttctttttcgtatcgtgccgcgacttccttcatggtttcttcggaatagtcgtcaggcttcaccatgactttcggattcagctgcctggtgaaggcgaccatcggtccgttgcgctgcgcatcgtagacggaatcccacatggacggcatgtcccccattgccgaagagaaggttttcgcccaagatccgacagtgctcacctgcatggaatacagcgtgaagaacgttcccggcacgatgatcagcagtagtcgcacgatggcattcagcgagcgcgactgcttgtcgtcgccacggaaaagcttgccgtgacggccgtcacgatgattcaggaatacgaaaagcgcaatgaaagcaacgaatatgacgacggcaagcagaatggtccactgtgcgcctgccggcatgaagctcataagattgcccgcatcggctttgaggaagttcagatcgctgggaagaatcgcctcatatcggatggatactttgaaatgttcgatcaccgcgataatgaatgtcaccgccagaaatattggcgtggcgatccagaagcggttgatgagcatgagcagtatcacatacagcacgccccacaaaatcaggttgagcaccgccacaaagttgaggttggtgaacattttggtgacgaagccccaaccggtcagccacatgttgttcgaaagcttgacgcgtgtagcggattgactgacgccaatctgtagcgctgccacaccgatggcgtcgaacaccacaaacagtatgccgtacaaccaccctgggaattccttacgttccttggcgggtgcgtttggatcaatcgtcgagatcttcagttcctcaatcgtctctgtattcacggattcgttcgtcaagtgtttatctccactcgtaacgtgtcagttcgcttcgtttcccgccttacggcgacgccaaggcactattctcgcgaccatatctgacaaaaagctgtaatgatcgatttcatccacagtttcttctgattttcttacgcatatgtcgatgaaatcgcaaaagaacgatgagggggtatagacagttcggatggcagtatctagttgtcgtcaaggattccgccgtccgcataaccgttgttgctgaaatcggcgaaattgttgagatcgacggaattaccgtcgtgcctcattccggcagtcggggcatagtccgaacacctcaagcgtatgcctttcgatggtgaatccgtatttctcgctgatgccacgcagccaagtttcggatggcgattcgatttccacggttttgccgcaattcgtgcatacgagatgatggtgatgcccgtcatcaccacacagacggaacagctgttggccttccaaacgcacggtatcagcctcgcctgcctcagccaaggcattcaattgacgatatacagtggcaaggccgaccttcacgccttcgtcttccagcttgcgatgcaaatcctgtgcggaaatgaattcatcgtttgccttcaacgcatcatgaatcagttctttttgtttggtgttgcgctccacgcgtccgtccgtcaatctatgtccgttcttgatggcttcgcgcgccgtcctcccctcagggaaaggctgacgcgcgaaacatgccgtcatcggttttatttcaaatcatcccagcagccggtccgttcaagatccgccacagtttgcctggtgtcgtcggtcagcacggtgatatgccccatcttgcgatcatgacgcacttcagccttgcaatagtcgtgcatattccattcgggatgctcggcgatcagcgcgcgggtcggtgccacatgctgcccgagcacattgaccataacagccggcttgagcagttcgggctgttcgagcggccacccggcgatgcctcgaatatgcgcgtcgaactggtcgaacgagcacgcttcgatagtgtaatgaccggagttatgcgggcgcggggcaagctcgttgacgataacccgctcatccttggtaacgaagagttcgatagcgaggatgccggccagttcgaagccttgcgccaaacgcaaagcgagttcgtgcgcttccttcgccacgtcttcgctgacttcggccggagcgatggtcatgtgcagaatattgttacgatgctcgttgcgcacgatcgggaaggtcacataatccttgccgttaccggcaacgagaatgctcgcttcgaatgcgaaatcgacgaatccttcgagaatgctcggcgggaatccgccaccgcgatcggcacgggctcgtaccttttcgagatcggcatcggatttcagcacggtctggccgtggccgtcgtacccgccggaacgggttttcagcacggccgggtaatggatttcaccgagcgccgcatcaagctcctcaacgctgttgacggccttccatggtgcggtcggcgtgccatgatcattgatgaactgcttctcgttgacgcgatcctgcgtgacacgcagcaaatcggtgccttgcggggctgcagacaaggaacgcacttcgtcgatggcgtcggcgttcacgttttcgaactcgtacgtgagcacgtcggacttttcagccagttctcggatcgcggtgatgtcgtcgtattcggcagtgacttggaagtcggccacctgtgcggtcgggcaatccggagtcgggtcgagcacgccgatgcggaagcccatgtagcgggcggacaacgccatcatgcggccaagctgaccgccaccgataatgccgatggtggcccctggcatcagacgttcaacacggccattggtttcctcagacaagctgggcattggattcagccaccttttccttcagagagtcacgatattcctgcaaagcattggccaaacgctcatcggtggtgctcagaatgctcacagccaaaagacctgcgtttgtggcaccggagttgccgactgcggtggtggcgaccgggatgccgcctggcatctgcacgatggacagcagcgaatcccaaccggacagcgcatgggaacgcaccggcacgccgatgaccggcagggtggtctgggccgcgaccatgcccggcagatgtgccgcgccgccggctccggcgatgatgaccttcagaccgttggcacgggcactatgcgcgaactcgcccatcaattccggggtgcggtgcgcggaaatcacctgcttcatgtacggcacttcgaactggtcaagcatctcgcaggcatgcttcatggtttcccaatcgctcgccgaccccataatcactgcgacttcaggcttgttgtctgccatcaaggacctccgaaagaatccaaaagaacatgttcttgaacaccgtttactttacgcaatcggctagatgtgcagcacgatttttccgaaaacgtcgccattcacgatcttggagaacgcaagatgcgcgtcgtcgatcgcatatgcggaatcgatgaccggatgcagatcggcatgttccacgaatttcagcaaacgtgcgaaatcctcacgggagcccatggtattgccctgcactcgaatatcctggaagaagattctcgtaagctctgcacccggctggtcgccagtagtcgcgccgcaaatggcgatagttcctcccggacgtacggatttgacggaatgactccatgtggccgcgccgacggattcaatgacggcatccgccttgcgtggcagtcgcgcacccgtttcaaaagccgcatcggcaccgagctgcaacactcgcgcacgcttgtcttcgcttcgtgacgtgacgaacacttccaatccggccgcgtgagcaagctgaatcgccgcggtcgacacgccgcctccggcgccttgaataagcaccgtgtctcccggcttcacattcgccgatgcgaacagcagggaatatgcggtaagccagctggtacccaatgcggcagcctcatcaagattcagattcgcgggcttggcgaacacgttggcgctgggcacctgtgtgtattcggccatggttcccgcataccgttcggacaggatcgagcgtctctcccccggcatcacaccggcgccatcggtaccaacgaaggtatacaagaccacttcggaaccggccttaagtccctttcgtacgggaatgtcttcttccaacacgccagccgcgtccgtgccgaggatcatcggcgtctgctcgtcggaaagccccacaccttgcagactccacacgtcatgatggttcacgctcgccgagttcacacgaatggtggaccagaatggcttggtttcaggctcaggcatagtgcccacttcaagcacggacagcggatcatcataattcgttccggtggcatatacggctttcatgttcgcgctcctttgcgaataacggcttttcacgattgcaaacacctctattgtgcctcaagttgagaagactttgcgctcctttgcccgcaaacaccctcgtcggggcatacagtgggatatgatttcgcacttggttgcactgatcgtagggaagggtgattgcgcacgatgaccgctggcattttgagttcgattcacactccggcggacgtacatgccctttcagcccagcaattacgcgatctatgcctcgaaatccgcgccacgctgctcgactacggcaaaaaacatggcgggcatatcggctcgaatcttggcgtggtggagctcactgtggcattgcaccgcgtgttcgactcgccccgcgaccgtttcattttcgacgtgtcgcaccaaagctacgtgcacaaaatgcttaccggccgcgccgaagcatacttggaccaatctcgttttgatgaggtgaccggtttcacgaatccgctggaaagcgaacatgattcctttgtgctcggccataccggcacttcgatttctctggcctgcggtcttgccaaaacccgcgatatgcagcgcggcgccgccggcgaaagcactatcggcaatgttatcgccattatcggcgatggatccctgagttcggccattgcgttcgaggggctgaacaatgcggccgaacagggcggtaatctcatcatcatcgtcaacgacaacgaaatgtcgatcgctgaggatttcggcggtatgtacgggcagcttgccaagttgcgtacgtcgaatggcatggccgaactgaatctgttcaaggcattcggcttggactaccgctatgtggagcagggtaatgacgttgacgcgctggtggaagtactgaacgaggtcaaagacattgaccacccgatcgtagtgcatatccacaccaccaaaggcttgggcttcaatgacgaaacggaagccgacaatggttcggatggctgcaatcagaccaatcctcaacctcatgcgggccaatgcgaggccaaccattggcaggatccggaggcctcgctcggcaaaccgctcgacgcacgcaaatattatggcgaaatggccatggcatcgctggaacgtcgtttcgacaatgagccgggattggtggtcatctcccccgcaacccccggatcgaatggcatcacccgagattttcgtgaacgtgccggcgcccactacgtcgataccggtatcacggaagaacatgccgccgcattcgccgcgggtatcgccagggctggcggacgcccggtgcttgcgacttccgccacgttcttccaacgcacgttcgaccagctgcagcaagagttggcattgaatcatgttcccgccacgctgctgattttcggcgcgggaatttccggcgcggacaatacgcattcgggcacattcgatatgacgatgttcgccaatgttcccgacgtgacctgtttggctcccgcgagcggcgaacagatgcttgacatgttggcttgggctaccggcccgtccggacatggcgtagtggcgattcgtatgcccggcgagcagattctcgcacttgaacgtgccgccgatatggcgttcgacccgttgcagcgtgccgaagagcatgatccagccgtcaatattgccggagcatgcccgttcgcccgctatcagatcgttcagcccggcagggatgtggcgattcttggactcggcaataccatgccgttggctgccgaaattacgtcggcactggccgaaaatgatgaagaacatgctgcgattaccgcaacgcttgttgacgcattgcaatattccacgatggatgccgaattactggcgatgcttgccgatgggcatcgtttggttgttacgttggaagatggccagctagaaggcggatggggtgagaaagtcaccgcattttatgccaattccagtaataccaaggcttctcacgttcgtgtgctgaatttcggcgcagccaaagagttcaccgaccgagtgcctcttggcgagcttaacgaacgttacggattgacttcagaaaccatcgtctctcgaatccgcggtattctcagcgaataatcgatacataagcgaattggcgggaatgatcggtatatctgtggaccattccccgccaatctataaatcagcgatctgtaatcagcaatcactgatcattcttgatggcatccaaagcgggaatcttcacagccttattggccgggccgaaacctgctaccacaccaacggcgatcgaaaacagcatggccaccacaaaaagccaccacggaatcaccgaaatgcgagtcacatcgtcgccgcccataatcgctttgccgatattctcaatgctgaatccacccaaagacgccatattgatgcctatcgaaccaatcgcggaaatcaagcaagcgatcacaccgccgacaaggccgatcgcaccagcctcgcacaggaacatcatgcgaatatcgcgcacatagcagccaagagccttcataatgccgatttcgcgcgtacgttccgacaccgacataatcatggtgttggcaataccaatcgcggcaacgaagaacgacaccgcgccgatgccgcccaaagccaactggatgccccgcgactgcttttcgatctccttacgcgtttgctcaaacgaggaagtctgataaccggcgcccttgatttgcacttcaacgtcggcaacgtctttgatgtcttgggtgtgcaccagtacctgatcgtaaacgaccttgctcgacgtgttggccttggtgtcccccgatattttggcgttcaacgttttcatatcgtcgatgctcatcacaatgccggaagtgaacgcatcatagttgttggcggaggaatcaatgacacccaccaccgtgtatggcatggtaatggtgggactctcaccactgccggaatcggatggcgccacggatccgccgcccaccttgtggtagtcgtcgggactttgatagttggctccggtaatcaacgtgattttggagttcagcatatcgaagaacgggtcttcgccttcggattgggcgcaaccgtgctcatcgcagtaataaccgcccgcttctatacgatgattgctcggatctgacgcatacttgtcgtagaacgaatacacgaaggatttgcccgccaacacttcgccggcacgcatcggaagacgtccgctggccaatttatagccggattcttccaattgcgtggcgtcgactcccaccacgttgacatattgcgacacgtaccgggagccagctccttgcgtggcatccacactgtatgacatcgttttctgaggaagcactccagccacaccggcaatgctgcggaaattctgcacggcgtcatcgtcgagtttcgcctgttcgccgtcggcaccgctcacgctggatgacgttgccgtggaatgtgaacctccgccgtccgcatatacggtgatgtcgttcaggttgcccatgtttttgagcatctgctcgttctgttcgttgatgccttggccaatggaaatcatgagcacgatcgaacagcagccgacgatcacgccaagtaccgtaagaatcgtacgcgatttgcgacgcagcagattctgcgtgcatgaacgtgcaatatccgaaaatcgcatgctcactccttgtcggagggcacggaatcaatcacctgggtcggcgcgtcaatggcaccagccgtattagccgcaccatcatcagcacctgcatgcgaatcggagggatcccaatcccaatcgtcatcctcggcagccttcttcgccttcttgcggcgacgcacaaccaccacaaccacaatggcgatcacggcaacgacagccacggcaacggcaatccacacccaagtcggaatgccttgattttcctgcgggtcaacatccataccgggatcggcgggagccggagcctcagacaccgtaatcttcaccggcgattccttggtctgctgctggccgtcggcatcctcgtacgtcaccttcagtttggcatcatattcgccggccgcatccgcagtgaaagcgaatccgatggaaccagaagcgccggacgccacattgccgatatactgcgtggcttgcgtggcggtgatgccgtcaccctcgatggacgcttcgacattggatacatcccccttgcccttgttcacgtattccatggaaatggtggattcctcgcccgcattgatggcgtctggaagcacgggatcgcccagttcgaaacggtcgggctgcgaaacaggtacggaaatcttgatatccgaagtgttggaattgcgggtgccgccatcgacatactcgtatttgaagttgatatcgatgccctgcgcgccgttcttcgcactcgacagcacctgcatgggcacggtctgggtcagggaatagcccgcccacagcgaatcgtaatagaacgtgttcgtaccgccggaaatggcgaaattctcgccgccgtcaacggtcacgaccatattgctgaccgcgaccttgcccatattctggaaggtgaagccaagatcgaaattcgtgccgaccgccacggaaccgtcgccataggtgaagttggtgatgatgatgttcggcaccggaccggccggctgcacggtggagccgccgttgttgtcgtcagtgccatcaccgtcttcggcgagcgccgtcggcacaatgcaggtcagcgcgatggcgatggacgccatcaatgcgatgagcatgttgatgaattttgcggaatggttgctgttactcatggaatttccttctcttctctgccgtcacgcgttgttcatcagacggtcatcgatgatgcgtccgtcaagtagcgttacgatacggtcggcatattgcgccatattgtcatcgtgggtgacgagcacgatggtttggtcgaggtcgcgagcgaacgcgcagatcatgttcatcacgtcggttttggttttggagtcgaggttgccggtcggttcgtcggcgaatacgacttgcggtctggctgcgaacgctcgcgcgatgccgacacgctgttgctgtccgcccgacatttgcgtcgggtagtggttcatgcgtttgccgagccctactcgtttcagcattttcttggcgattgcctcacgcttgtttttcggcatgccttggaacatcagcggcattgccacgttttccacggcagtcagattgggaagcaggttgtatgactggaatacgaaaccaagatgtttttgccgaaattccgccaattgccgttcattcaaccgagaaatgggcactcccccgatgcgcacgccgcctttggtcggtttttccatgcctgctagctggttcagcagagtggatttgccagaaccggattcgccgtagatacagcagatctgcccttgcggaatggtgagattgatgcgttccagcgccacgacggtttcatcgagcaccggatattccttacgcagattcttgacttcgatgatgggtctgcgcgtccccgccatcgactcttgcccttcatgatctgtcatagtcttcattgccctcccccacacggcgtcaatacgtctgtcccacaaccgagtttataccgttttccagttccctgcatcccttaggggaataccccgagaagcacagaccccccgtctcacatcctcctaaaacaaccctaactagggtggttttctcgtttcgtgccaaaaacacttcgtttcgtgccagacggcaaaatccccgaatctcgcaaaaatagaatgaaaacaacgaggcagacattcggatgacgttgtcggaagcgtcatccgcataccacacaaggggaaccatcatgcgtcgtcgttttactcaaaccgaggtgtattacctgaacaccctgcccgcggtggagcgagcttccatggaccgcatcacgtactcgaaggaatttcaggtgcgttgcatggcgcaatatctgcgcggcaacggtcctaccagtattttcgccagcgcaggtcttgatccgaaaatcatgggaggcaagcgcatcgaacgcgcgatcgcccgttggaaagccgatccgaaaatcatgcttgaagcacagacgttggcaaacaaatccgattccgggcagcgcgatctgctggtgatcacccaagccatgaccatcaaatggctggaaaagaaagtcatggacctgcagaaacagcttcacctgcttgaatcacatgcgatgaactgctcactgccgaattcaaactccaaggaaggtcttgtcagcatggcgtgacatacgccgaaacgtatgacatgcgtgcgcaaaacacggtcattgccgacaggccaatcacatagacgtgcgttgcggtacggcaacgcgccaaacaataatccctcctttcaccgccgcgctctccgtcacatataagcggccgtctcgaaaggagggattcttcatgcctctggaacgtcagcgaaacatcctcgccccgtatcgacactctgcatttcgtgtataaaacgcgctgtccttactctgcatttcgtgtaaatgccttaattttcaaggagtacaccatgctcttcaggcgcaaggcatatcaaacactcatggcttggaaaagcccgtcgaatggcaagcgcgccatgcttattattgagggagcacgacgtgttggaaaaagcactttggcgcaagaattcgcacaacacgaatacgaaggtcatcttgtcatcgatgcagagcatcggcacggctattttgcgactatttcgcagcttcgtccgcggacatcatggcctgggtgatctggtcgcgcatctcgttgaaaccgccaggcgtcgaagccggcaacaccaccgtcttcgcattctgcgacgaggcgagattacgcatggtgtcgagatactggttgaacaacaccacattgttcacgtcgttcacgttcatgccgactgcctgcagactcttgatctggtcgacgataccattggcgatctcacgacgatagttggcctggccttcaccctgaagacgggtcttctcagcctcggctgccgcctgggtctcgatctgaatacgctgggcttcggcgcgctgacgggtggcctccttctcgcgctgggcagcgttgatggaatccatggcgttcttgacctgcggactcggatcgatggcagtgatcagcgtcttgaccacagtgaaaccgaagcgggacatttcgttgccgacggtcttctgtacgtcaaaggccacatcgtccttacgggagaaggcatcgtccaaagacaatgcaggaatggcggaacgcagcgcatcctccatgtaggaacgcagctgaccagccggatcacgcagctcatagtatgcggtggccacattgctcgggtcaacacggaactgagtggacgccaccaccgtgacgaacacattgtcaagcgtcttggtctccaactgcacattaagctgattgacgcgcatgttggttttcatggcgatacggtccacgaacgggattcgaatatgaatgccggcgaactgcaccttgttgaatttgccgaaacgctcaataatataggcctgctgctgcggcacgataaacaacgtggacaggaacaggaacgcgacgataagtgcaatgacaaggagcgtaataaggaacggcatgacattactcccttctttggttttctctcgaaagcctgttgattgacggctttccgtaggttctgcaaccattgccgaccccaagcaaaaacttaccaaagaatgcaatcacgtgcagataatgtccgcgagttgggcaaagtccattcggaagccggacatcgaccgtccggaagccgacccacatacgtctacgagccgaacaggagacaattctccttgtccgactcgtgagatggcatacgcaatgttgaatcagatcaggccgagttccttgcatttggcttgcaactgcgtggccgaaggctccaccagccatgagccatcggcgaaccgaatcacgggaatgtgctgttgtccgctgatcgcaatggccttctctgcagcaccatcctcatgctcgatatcatgaaggctgtaggcgaccccgaaacggtctaatgctgccttggctcgatggcagtcgccgcaccagtcggctccatagaaatcaattgccgcattgtcaatcataaaatcactccttacgaggcattaatctcatcaaatttaggcgatgcctcaagcaacatcttcgtatacgcatctttagggtgtcgtaacacggaaccgacagctccatattcgacaagatggccgtctttcattaccgtcacctcatccgcaacttcctgaacaatgtccaaatctcatactcatgccccgacaatcccggataatgcacggattttaccagcggatgcagcaacagatagctggagatcgcacgcgcgttctcctgctggcggtccatgcgcagggcgagcgtctgaataccacgacgcaccgaatcgcattcgttcggcgcaagcacgccacccaaacgattctgcgcgaagtagacacgtttgcccaacccgtcgtccttgaccaccacaagaccggcgttgacttcggaatggccggccagatacttggtagcggaatggatgacgatgtcggcaccttggtcgagcggcagctgcagatacggggtaacgaatgtgttgtcgacaatggaaatcgcaccatagcgatgagcgatttcagcaatcttcgtcacattgttgacctgcagcaacggattggtaagaacttcgaaatacacggccttcgccggacaaccatgcgcgggtcccttggcggagtgcccggaaacagcggcatcaagcgcttcgtagtcggcgggttcacggctccggtgttgttatcgttgaccggcagtccgtggacaaactgagtgttgaatctggtcatgatgtgcacccccttgggttgtggttcattgccgcgtgccattcacgcggtcgctggtacccactaaaccgcatcctgcatttcaacgcgcgccgcaccttatcaacgttggctatagaacgcgcgaatcgccataacattttcctgtaagcagctatcaaacggcggagatgcaagacaccgcaccgcaatcgcaaaaacgtcgcctgcataaggagcgtgtgtcggtttcctaagggaaagacgtttcgatggcaattggaggatgggacgtccacaaccgatcgaaagacgatcgcaaacaatcggaggaaaataggaaaagcgattgcgcaagcacgcaatcgctcatccatgccaaaaggctacgtaggaaaaattacgctagcacagcagtcacccggcgcacagcctcacgcaactggtcctcggatttaagcaggctgaatcgtacgtaatccttgcctactttgccgaaacacgtgcccggcagcgcggcgacggccgcacgttccagcagcgtgtcggcaaattgttcacccgtctgatcttcaggagcgtgcacccaagcgtagatgccaccgtctgaatcgaaaacatcaagtccggcttcacgcaatccacctgccacgatttcgcgacgagacgcataccgttccgcaagttcggccacacagctctgatccgacagcagtgccacagtgcccgcgtcttgaatgctggacgtaaccatggaacccatttgatagtggtactgcttcacatgagacacaatgtcgtcgttgcccgcgatgaaaccggcacgccagccggccatcgcatacattttcgacagcgagcatacttccaccgcaatatcgaaggcacccggcagcgacagtatgctgatttgctgcgcatcgacccccaatcccgcataagcgaaatcctgcacgatcgcgaaatgatattcatgagccaaatcgatggcacgttgcagaaacccacgcggagcctgcgcacccgtcggattgttcggatagttgagcaccagcactttcacacgattccacacttgcgcaggcaccgcatccaagtccggcaggaagccgcgctctggcagtgacggcagcagaacctcctcggcttggctcatcaccgtcatgcaatgatacgaggggtaatacggatccgcatacgccacagcgtcgcccggggagaccaacaccgcgaacagcgccgcgagaccatcaaccgcgccctccacggcaaaaagctgggttttccaatcgacctcaacaccgtacgtattgcgataccactgttcggcagcctgcagaaaactcggtttgccgtcgaacggcgaataccgggcattggccggatcgtcaaccgcctttttggccacttctcgaatgaagtcagcggggaacgcatccggattgcctttggccaggtcgatcacgtcggccccgtccgcaaccgcggcagccactttgcgatccatatcggcgaacacattcggcggaatcgactgcgccaccgtagtgaacgcaacaggagaaacatacgaagtcattcatcaaccctccctatcatcgtgcgactgtatatgcgcacattcacgcatatacgcaaccatcagtgcgtcaccttgcgtgcgaaccaatcgccgatccattgaatgatctgcacaatgacgatcagaataataacaatcacgacgagcacgccggtttcgtaacggttatagccgtattgaatggccatatcgccgatgccgccagcgccgatcgttccgaccattgcggaatagccaatcagtgaaataatggtgagcaccacaccacgaatgaacgacggcaaggcctgagggaataccgcatccacaatgatttggcgtgtggtggcaccagtggagatggcagcttcaagcaagcccggatcaacttcggaaaacgcgctttccgcgattcgcgcaaagaacggcaccgcggcgatcgacagggaaattgcgccacctgtcggcgtgtaaggatcacccagaatcaattgcgcaaccggaataagcaccaccatgagaatcaggaacggcagcgaacgaatcgcgttgacgatgaaaccgacaataacgttcaacgcatgattcggcgtgaacaaacgattttcggtcaaatacagcagcaacgccaccaacgtgcccaacaccacgccgataatcgccgacaccacaaccatgtatgccgtgtcgatcaacgcctgaccgagattgtcttgaaggatttccagagtttcttccattgttctcacgcctcctgattatccgcagcttcggcggccacaaccagctgcccacgatcaagttcccgatagctgaacacatgcgttctcaacgtattcaacgcctgcaccagcggctcccccgcgccagaaacgagcacaatcagaatgccgatggcctgcgaaccgaaatactccacattcgcatgcagcacgtcgatgctcacgccgtaatcctgcgcgacccggctgatgagcggttcgagtgccgcatcccccttgtatcgcagttccacgatggtgccggccggcagcgacggcaccagctgcggcggcaccgcaatgcccagatagcgttccaccaacgctttggtggtcggatgcttcggcgtgctgaacacgtcgaaggtgttgccttgctccactaccacaccgttttccataacggccactcggtcgaaaatctgcttcgccacgtcaagctgatgcgtgatgaacacgatggtaatgcccagttcgcggttgatgcgttgcagaagcgccagaatgccttccgtggtttccaggtcaagtgcgctggtagcttcatcgcacagcaggatttccggcttgttggcgagcgcacgtgcgatggatacacgctgtttttgcccgcccgacaggcttgacgggtagctgtcgattttgttttccaaaccgaccagtgccagcagttcgcggatgcgtgccgaccattgcgctttcggatatccgccggctttcagcgcgaattcgatgttcttgccgaccgtgacattggtgatcaggttgaatccttggaaaataaagccgattttcttgcgcaggtcgcgcaactgaccgcctttgagtgcggtgatgtcgctgccgtcgatcaccacatgaccgcccgtcggtcgttccagcaggttgatggtgcgcaccaacgtggatttgcctgctccggagaagcccacgatgccgaagatttcgcctttttccacgctgatgttcacatgtttgaccgcttcgacggttcgtccgccttcatgaaaggtcacggacacgtcgttgagttcaataacgctcatggttcgttcctcattccgttcaagtacgtgtttacgttcgttcgatacgtttcgttcgatacgtttcgtttgatacgtttcgtttgatgaatctcgtttgcataaagcccgtatgagtttcccaattcatacgggcctttgcatattacctatcgccgcgctgcagcggtcaccaagtggtcggcttgccgaaatccttgaactcgctcttggcgatggcgtccttgaatttctgactgacgagcagtttcttgacggccttgccgaagtcggaatcgacgtcctgggtacggaccacgaacacttcgatcacgccatcatcctgcttttccatggcgagcgcgtcggcaggcttcagatcagcagcccaagagtagttgcccggcaccagagccacattaacggtgtccaaggaacgggccagctgtgcagcatcgatcgttttgattttgaggttcttcggattggatgcgatatcgttgaccgtggccttggtggcatcgacttcgcccttgagcgtcaccagaccctgctgctggagcacgccgagagaacgtgccaggttagagccatcgttcgcgattgcgaccgtagctccgtcttcgatgtcatcgatggacttgtacttgttggaatagatgcccaggccaagggttggggtctgtccaagggcggtcaggtcgagattgttgtcggcggtgaacttcttcagataattgccatgctggaaaagattcgcctgaatggaaccagatgcaagtgcctgattgggctgcacataatcgttgaacagcttggttttcagtttgaaaccgtcatctttcagcagtggcgcgatgaccttgtcgaccatgtcgccgtatggtcctgcgcacacgccgacggtgattgtggtggttttgcccttcgtggtgttcaggctttccttggatgcggatgcgccgttgccggaaccgcatgccgcaacggaaataagtgttgcagcggcaagtactgctgcaacgattcgtttgatgccgtccggcctcttgaaaatagcgatggtcatggttgttttccctctcctacttgttttgaaaaaatacgattattccgttaccggcttactggcttcgacgtcggctttggcctgtgcgacgatgtctggattgtggatggcgaaggcttgttcggcgagatgcacttcgcgggttaggaattcgtgcagcttgcattcgtagccatgctcgcgtccgactttggcgatatagccgttgatgtagtcgacttccgttggacgtcccttggtcaggtcttgatacatggacggatagtgcagcggatgtgccacgcccgcggtgtgcagaatggtttcgacttccgtttcgcgcgtgcccaacagttggtatccggctgcttcggccgcactgtaggcttcatcgaccagctgttcggtgagccagcgtgcgtcgggatgcgcatggaattcgccgaaacgaatctggtacatggtacacagcgtgttcagtaccgagttgaatacgattttcgccatgcacatgccgatgaagttgtccacgatggtcgggttgagcgtggccgttgcgaaatcctcgtacagcgcctgctcgtgtttgcgcacctcgtcagtcacatcatccgcgtaggcacacaggttcatggccttggcatgtactccgccggtgaagttgaaatcgccggggccgtacacgtaggcaccgatcagtgcggtaccgccgtaaatgcggtctgtggagaagtattcgttgagcttttcgaagtgtccatagccgttcatggcggagaacacgatctgcttctcattgaacagatgggcgcagcgcttgagcacgccgtcaagctgcatctgcttgaggaacacgatccacacgtccggctggccggcgtattcctccggatagtacacgttgatcggcacgagatggcggtcttcaccgtcttgcgacacgtaggcaccgccctgctcgcggatcttctcgacgttcggcttccatgtatcgacgaagtcgacgtctttgtgcgcgaattcctgcagcagcacaccgtactggatgcccattccgccggcaccgatcactgcgtacttcatgttccgcgctcctctctcgtaaaacatctcgcttgtttttcaagccgacaatcacaagatatcggaaaaacaacatggcaacatcggcgtggctatatacgctttttatggaaggcgcgaatcgtaataattgttttttatatagcgttatcagcaatcatatatttgtatgtaaatatgattatgtgaatatagaaaaaccttccgcctgaagcgacggaaggttcaaaatatttagtttgattaactagttatcagtcgaccacacctttttcgaccacgatttcatcaggatcgacttcgtcgccatacaccggcttcagtgtctcctcataatccttgtggaagaagttttcatcgccaagcttgtcgatttcgtcgttgatccagtcaagcaattccttattgcccttctgcactgcggcagcgatggtgtccttatcgcccagttcggtgataccgaccttgaagcccttgttggacttggcccatgcgagcacctcggtgttgtcggtggagaaggcgtcgccacggccgtcgagcagcgcgttgtaggcatcggcgtactggtcgtacttctgcagcttgatgtcggggtagtttttctcgaagaaggtttcggcggtggtgcccttggtcacgatcagggtcttgcccttgagctggtcaacgtcggtgatttcggcgttttccggggaaacgacgcccaacgccaccttcatgtacggcttggcgaagtcgaccttctccttgcgctcgtcggtgacggtgaagttggccagcgtgatgtcgaccttgttggaggtgagcacgtcgactcgggcggcggcgtcaacggaggtgtattcaacgtctacgccaagatccttgcccaagcgctcggcgaagtagacgtcgtagccggcatagttgccgtccttgtcgacgtagccgaacggagccttgtcggagaacacggcgaccttgagcttgccggacttcttgatctcatccagagtgcgggcggtggcgctgctgctggaactggaatcgctacccgtggagccttcgtcgctcggagtggccgcggacggaccgcaagcagccacggaggctgccatgatcaacgcggccgatgcggccacgatgctcttgaatgttttgttgatgattgatgcggtcatggtttctcctctcttgcaaagatgactgctatcaaaatcttgggtttcgccgattcgcactatttcgcgctactgttcggaccgttcggattgctcggcggacttgcgatgccggtcgaattcaaacgtatgcaggaactgcttggcacgttcggtggtcggattggtgaagaatcgttcggcatcgtcggaccgttccacaatgccgccatcttcaagcaggatcacctggtcggcgatggctcgcgcgaattgcatttcgtgcgtcacgatgagcatggtctggccggaatcggcgagttcgagcatcacgtcgagcacttcgcgcaccatttccggatcgagcgcggcggtgacttcgtcgaacagcagcacttccggatgcaggatcagcgcacggcagatggccacgcgttgacgctggccgccggaaagctcgtgcggccaggaatccttgcggtcggcaaggccgacgcgttccagaagcctgatcgcctcctgctcgactgcggccttatctcgcttctgcaccaaggtcggcgccagtgtgatgttgccaagcacggttttgttgggaaacaggtcgtagctttggaacaccatgccaacgcgggtgcgtagttcgctgctgcgcttgctgcgtccagcggactcagtgcccggcttgcccgtttcgatcacttcgccgttgagcgaaatggtgccgccctgaatcggctcaaggcctgcgatggtgcgcaacaacgtcgatttgccggaaccggaaggcccaacgatcacaaacaccttgccatgcggcacgtcgaacgaaatatcgttcagcactggcctgtcggcattggcgtactgcttgaccaaatgcgcaatcccaagacttgcttggcctgcctgagtctgcttgcccgctgcgtcagtcatgcgaccacctcttttccagtcggcgggccacgatggacagcggccagcacacgatgaagtacatgaagaaaatcaccccgtagatccacagggttccggtcgggtattggaaacggttcgcgtcgatgatctgttgacccactttgatgacctcgaccacgccgagaagcacggccaacgacgtcgttttcacgattcgtgtcgccagattcaccgaagccggcagaagcctacgcaacgcttgcggcagaatcactgtgacgaacgtctgccagccactcaacccaagcacatacgcggactcatactgggctttcggaatcgactcaagcgcgccacgcaccaaatcgcccaattccgcgccgccccacagcacgaacacgaacacgcatgcgccggtcgcatccaaattccaattccacgcacgggcgaaaccgtaaaacgcaatgaacagcaacgccaattgcggcatgatgcgaatgaaatccaaataaatcctggtcagcacacggatgacgggatttttcatcgtcatcagccagccgacgaccaatcccacaggaatggaaagacccaccgaaacgccggcgatccataccgtaacccacaggccctgcagcaggcgcgggaacacgcccggctcgagcagaatctcagcgccgctcatagtcgaacctccgttccagccaagtgccgaacaatgaaatcggcagcagaatcaccaagtacgcgacgaccagcatcagcaacgattcgtacgtgctgtagtacatgccgatcagatccttggccatgtacatcacgtcggcgagcgcgatggccgacacgacggatgattccttgatcaggaagatcacgttggccacaatgcctgggatggacgtgccgatggcctgcgggatcaccacgcggctcaaggtctgccattggctcaggcccagcacgtatgcggattcgcgctgcacgttcggaatggtttcgaggccgccacgcatcgcttcggccatgtaggagccgccgagaaagccgagtcccacgatcgcgcattgttccgcggaccagacaacgccaagcttcggcagaccgaaatacaggaaatacagttgtaccagcaacggcgtgttgcggctgagttcgatgtagacgcgcacaatctgcttcaacactgggatgcgtgcgatttcaatgcccgcgcagatgagaccgaccacaatcgaaagcacgatgccgaatacggaaatgaacaacgtcatcgccgcaccgttgacgaagaacggcgcgtagtgcgtcacgaatgtccagtcgaacacacgcgcctcccctctttctcgctaggttttcgaatgttctgcggatcgtttgaagccttctcaggctgtttccaagctttagccttgaacgcgccccatcgtaccgcgcgataatcacggaacaggccacgtcgttatcggtttttcgtataagcgtttattaaccttcaagaaatgcttcccggtaatccttgccacagtattgcacgtcggcgctttccgccgtcagctcatatcgaaatgtgaagattgggtatgccttgcgagagagtatgcacatgctcattcgacatgcaacgatggaggatttggacgcgattgaggctgtggaggctgcctgcttcccgcctgcggaggccgcaacgaacgagagcctgaccgcacgcgtcgccacatatccggaacatttctggcttttgatcaacactgacgccgatgacgacgcctgcttccccgcttccgtggaagatggcacgttggttggtttcgtcaatggcatgacgaccaatgagaaagatttggctgatgtcatgtatgaggatgtttccatgcatgacgagcagggtgattggcagatgattttcggcgtggatgtggctcctgtctaccagcatcgcggttgcgccagctatctgctgcgtcgtgtgatccttgattcgacgattgccggacgcaaaggcattgtgctgacttgtaaggaacgtcttgttggcttttactcccgcttgggattcatggacgaaggcatgtcggcttccacacacggcaatgtggcttggcatcagatgcgtctgacgttagcccacaccaccggtgagtccaatgattccaacgcctccggcgacactgatccggatgcgatcaccatggagatccccgtcgtgccacttactgattgacgcgcgtgtcgcagcccgcccaaccaaccgcgacacgccgacgatttgcattccgccgagaatccacgtaagctagcactcgcttcgggcggttggcgcagaggtagcgcacttccctgacacggaaggggtcacaagttcgaatcttgtatcgcccaccgaacacgaacaccaacgcgaacggccacatgaacttccaaccacgccaatccgccttgtgtttattgacacgcacggttgccgaatgcagtggcatattggcaacaacttccgttgctgacatcattcctctccttcgaggcaataccatttcacagggcaatttacacccccgtaaaacagctccttccaaatgtttgcgttatcataataacaccatattccaaaagtgtctacttttcgcacattctagaccacatattcacttcatcgaacaaattgcatggtgacgaaaacaatacagaagtaagcatgtaaaattaagcacagtacgcattttcgttcggaaggtagatacacatggcacgcaactcagtctcgctgcaagacgtcgccagggaagcaggggtttcaccgcagaccgtttcccgagtggctaatgggagcgatgccgtacgcccagcgacgaaacttaaggtcgaggcagccatggagcatctcggatacaggccgaattatgcggcacgtgctttgaaaagcggacatttcaacaatgttggtgtactgctttcgcatatgtcggcctacgggaactcacgtatcctcgaaggcatcactacagcggccgcgaatagcggctattccatcaccattcgccccttggataacctgcaggatcagtcactcgccggcgcactgaaacttgtggaaggcctccccctcgatggtgcaatcgtgattatggaacgcgatttcaccgacttcaaccagttcaagccatccgacaacctacctgtagtgcttatttgcgaggaaccggcaaaccactgccccaccatcgattcggactcgtatggttgcgccactgcagccgtggactttttcctgtcgaaggggcataaaactgtgtaccacatcgcaggccccaccgtttcacgcgcagcacagagccgcatcagagggtggcgcgacgcattagcgcaagtcggcattcccacaccacccatgtattacggcgactgggaagcagatagcggctaccaagccggattggccttggctcacgaaaaggattgcaccgcaattttcgcaggcaacgatcaaatggcatacggtgccatgcttggactgaggacagcaggaaagcgcgttcccgaagatgtcagcatcatcggtgtggacgattcactccgcggcgttgtgccccgtcttgaactgaccaccatacggctcaagctcagaactgtgggaaaagaggctttttccatgatcgagcaacaatgcaatggcaaaaaagtgccttctggaatcaagaaacttatcacccccgaattcatcgaccgcggatccgtggcggaactcgactaatcgcaatatctcgcgactttaatcaacgcaatcaatcaaatcagccaatacgaaaagcgcctctccagcgtgggtgaaccacgtgggagagacgccttctagattgaacgaaaagctgaaatcgggtgaaatcaggcttcgatgccgagctgctgacgttccttcttggaatacatgaacgccggaagctgacggccctgcttgagccaagcatgatattcggcggttgccgcaaactccacgtcggaagcggaattcagacaggtctccacggaatcctggatgacgccgatgatgaagccaacgcccaccacctgcatggcgatgtcattgctgatgccgaacagcgagcaggccattggaataagcagcagcgagccaccggccacaccggaagcgccgcatgcgccgagcgccgacaccacagacagcagaatggcggccggcaacgaaatctgaatgcccatcgtattagcggcggccatggccatgatggtgatggtgatggcggcaccgttcatgttgatggttgcgcccaacggaatggacacggaatacatgtctttatcaagaccaagcttctcgcacagctgcatgttgaccggaatgttcgccgcggaggaacgagtgaagaatgcggtcaggccggattccttgaagcagcggtacaccagcggatacgggttgcgatgcaggtacaggaaaatgaccagcggaccgaacacgagcaccatcagcagcatggtgccgacgagcaggagcaggaggctaccgtactcggtgaaggccgccaagccgttttcggaaacgctggtgaacaccaagcccataatgccaaacggggcgagattgatgacccaacgaatcacctgagacacgccatcggccacattggcaaggaacgccttggagctttcattggcaatacccttcatggcaagaccgaacaggcaagcccacatcagaatgcagatgtagttgccgtcgatcatggcctgaatcggattggccacgatattggtcaacaacgtctgcacaacctcgctcaagccctgcggcaccacatcagcgtcagcggcatcgcccaacgatatggtctgcgggaacatgcgagacgtcaacaccgccacgacggcggacaggaacgtggtgaacagatacaggaaaagcaccgtgccgaaacggccgtcaagcttggaattgccttgagccaaagcgcttgccaccagcacaaacaccagaatcggagcgacggccttcaatgcgcttacgaacagggtgccgaattcgctgatccacgtcatatgcggaacaaccaatgccagtgcggtacccgcgataagaccgacgataatgcggataatcagtgatacgccgttatatttgtcggcaacgccacgaagcgcttttgaaatatggttcatattctctctcgttctttccagccggcttgcctttgccagccagcacaacaagagcacatcctaatcacgctcgataacacgaaatgtaaaatgtccgattatagggacgcgcaacttcaacacgccatagcgatgcgagcaaatatgagtacagcgatggacagtttttatatatcttgattcagcgagcaatacctgctgatcagaccgttaatcagccaagcggcactttcgaaacgaatgtacgaggctctcccgtcaccggatcgtcgaaacgtaactcacgagccaccaattccaacggctgcgagaaatcatcgtaagaacgctgcacaatattcgggtagaaatcatcgcccaaaatcggcaatcccaacgaattcatatgcacacgcaactggtgcgttttgccggttttcgggtgcagcacgtaattcacatatgctttgccgtcgaggcaacgtaccgtacttccccgctcaatcaacgtttgcgcattgatggtttccggaatttcgtacgcctgaagtcgcccgcgatccttgcaaatatgcgatgctcggattgccggaaagggttgatgcctgtcgattcttacgattgttccgtactgcggatgctgttcgggggcaagtggcgccaaacattcataggttttgatggttttgcgattctggaacagcatttggtaagcgccgcgcaattccggtttgcgcacaaatacgatgatgcctgcggtaagtcggtccaaacggtgcgcgggaacaatatcaggttcgccatactgttcccgaagtcgaatcaacgcggtttcgcgataccacatgccacgcggtgtggtggcgagaaaatgcggtttgtcaaccacgataatcgcatcgttctcgtaaagaacctcacattcgaacggaatatgaggttcttcaagaacgtaacgatgcctcttctgctgacgctgttgacgcatcgtatgaacgattactccacggtgacggacttggcgagattacgaggcttgtcaacgtcgtaattcttcagcttggccatgtccatggcgaatagctgcagcggcaccacgtccaccaacgggctcatcagcgtcgggcaggccggacgccagaacaccacgtccgcatagcgttcaacatcggggtcgttctcttcggccacggcgataatgtacgcgccacgggccttgacctcttcgataccggaaataaccttggcgtgcagcacattgcggccacgtgccggcggcacgatgaacactaccggttcgccttcgtccaccaatgcgatcggaccgtgcttgagctcgccggccgcaaaaccttcggtgaaggtgtaggcgatttccttcaatttcaacgcgccttccatcgcgaccgggtagccgacatgacggcccaggaacaggaaggacttcgcatcgaccatctgcgcggcagcatcatgcacggtcttggtctgcgtatcaagaacccactggatcttgcgaggcatgtctttgagggaatccaacgcctgcgcgatctcgtcgcggaacatcgcgcccttgacctgcgccaaatacaagccaagcacgtaggcggcagtaatctgcgccacgaacgccttggtggaggcgaccgccacttccggaccagcgtgcgtgtacagcaccgcgtcggattcacgcggaatggacgcgccctgcgtgttgcagatggccagcaccttcgaaccctgctcacgcgcgtgacgcgatgccatcagcgtgtccatggtttcaccggactgcgaaatggccaccaccaacgtgcgcggggtgagaatcggatcacgataacggaattcgtgggcaagctccacttccaccggaatacgcacccaatgctcgatggcgtatttggccaccatgcccgcgtaggcggcggtaccgcaggcgatgacgataatcttgtcgatcgccttgaaatcatgctcgtcgatgcgaacctcgtcaagattgagattgccgtccttgccaagacgtcccaacagcgtgcgctgcaccgccgccggcccttcgtggatctccttgtccatgaaggagtcccaaccgcccttttcggccgcggaagcatcccaatccacggtataggtcttcggatcggccacgatgttgcccatgaaatcagacaccacaaccttatcggcggacaccatcacggcctgatcctggtcgatttccatggcacgcttcgtgtaggcgacgaacgcggccacatcggaaccgagaaaattctcaccttcgccaagaccaaccaccagcggcgaatcatggcgagcaccgaccacgatacccggctgacggcagtcggtggcgagaatcgtgaacgcgccttccagcatgcgcgccaagcgtcgcacggccttgaacagatcaggcttgccggtttcctcaacgattttctcgctgattttgcctagcagtttcgccgcgacctccgtatcggtttccgatgagaaacggtaaccttccgtctgcagatcaagacgcagctgagaggcgttttcgatgatgccattatgaatgatggcgaccttgccgtcacgcgaagtatgcggatgcgcgttgatgtcattcggcacgccgttggtggcccaacgggtgtggccgatgcccacggtggccatcggcattggattgcgttccacgtcttcgattagattggcgagacgccccgccttcttacgcacttccacatgatccatgccgggcgcggtcagcgccacaccggccgaatcatatccgcggtattccaaacgctggaggccttggaggcacacttccaacggcttgccgcacgcggtttccacatttcctgcatatcctacgattccacacataacacctcagcttatcgggtaatggtgtcattttcgaaacgaaaccgtctcatcgcgctgaacctttgatatatgaacacaaaaatccccatgctgacagttttcaacatggggattttctcagccattcccttgatcgcaatccttacgacgaagaggtgtctgattcttacgattatgcttgcggcgatttacagcacgtgctgcaggaagtccttgaatcgtggttcctgcggattgtcgatgatttcaggaccgccctgttccacaacaacaccgccgtccatgaatacgatctgatcggcgacttcgcgcgcgaagcctatttcgtgggtgacaaccaccatggtcatgccttctttcgccaaagacagcatgacgttcagcacttcgcccaccaattccggatcgagtgcggaagtcggctcgtcgaacagcatgatttccggcttcatggcaagcgcacgggcgatggccacgcgctgctgctggccaccggaaagctgtgccggatagtgatcgaggcgatcgcccatgcccacgcgattcagctcttcgatggcaagcttgcgggcttcctttttatccatgtgcttgacgtggactggcgcttccatcacattttcgagcgccgtcatgtgcgggaacaggttgaacctctggaataccatgcccagtttggaacgctgctcggccacttccttgtcgttcagggtctgcagcacctgcttgccgtccttgtcgacgtacttgtagccgatcatttcgccgtcgacgtcgatttcgccgccggtcagcgtttccaactggttgatcaaacgcaggaacgtggattttccggaaccggaaggtcccagaatcaccgtcaccgagccgggcataaccgtcatatcgacgcccttgagcacgtgcaggctaccgaaagccttatgcacctgcgtggccttcactgcgggaacaacaccgttggtggttggttcagtcattgctcactcccctcacgcggtcatgcccgcgaacgttgcctcgttctgcttggcgatatcgtctttcggctcgccttcggttttgcccggcagcggcggctgcttgccgcgcgcgccggccggtcgcgcatcgaagcccttgccgaaatgcttctccaggcgagattgcagcaccatcagaatggaggtgatcaccaagtaccagatgcaggccacgatcagcagcggaatcggcttgtacagtcgggttgcgattgcggtggtggcgaactgcagttccagcgtgaacggcacggcgttgaccagcgaagtggtcttcaacatgccgatgaactcgttgccggtcggcggaatgatgatgcgcatggcctgaggaagcaccacacgacgcatgatcatggaacgcttcatgcccagtgccttggccgcttcggtctggcccggatcgacggcttcaagacccgcacgcacgatttcagccagatatgccgcttcgttcaatgcgagacccagccatgccgcgttaaacgcggtaatgacggactgcgagtcaatgctccagaattcaatggaagtgaacggaatacccacgccgatgcgaggcaccaacacggcgaacagaccccagaacaccagctgcgtatacacaggggtgccacggaagaaccaaatgtagaaccagctcacgccacgcagcaccggattgatggacttgcgcattacggccagaatcactgccagaataatggcgatgcccatggagatgaccgtcagcagcagcgtgtatttgatgccttcgagcacattctcgttgaacaggtacttccagaccacattccattcgaaacgcggattggtaatcaggccctgcagcagcatggcggcgagcagagcgacgacgaccgccgccacaatcgggcccgtacgcttaaccggcagcgccttgatgcgattcggaatatcgaggccgtcgccgtcgatttgtttcttcgccatgatgcttcagttcctccgttgttgatgtaaatagtggggatgaaatcagtcgagatcggtcgggttgatctcagccttgtcgagagcgccggattccacaccccaatgcttgaggatcttcatatacgtaccatcgtccatcagcttctgtacggccttctgcacggcttcagcaagctgggtgttgcccttcttgacagcgatgccctgcttggccacaccttcgacgtcgcccaaggcttcaagctgtccgtcggtctgggagatggcatagccggcgaccggagaatcggcatagaacgcatcggccttgcccgtcgccactgcggtggccgcttcggcctgacgcttgtacgacatcacttcggccttgttatcggcctcgcatcctttggcgatggtgttggcttcctcttcctgcacggtgccggtctgcaccgcgatcttcgcgccgcacatgccggaagtgtcaagcttcttcggattgcccttcttcacggcccacgtggaacctgcacggtagtagctcacgaaatccacggactgcagacgctcttcagtgatggtcatggcggtgatgcccagatcatacttggagccaatggaaggaatgatggtgtcgaacatggaagacacgatgtttggcttcaaaccaagcgtcttggcgatggccttggtcatgtcgatatcatagccgaccggagtcttgccgtcttcggcatagaattcagccggagcgtacgaaagctccataccggcggaaagctcgccgtccttcaccagatcgccggacggaaccagcttggccagctcgtcatcttttttaatggtgctgacatcgtaaccggtggtagcgttcgacgaatccgacgaatcgccggaattggacgcctcggaggtgccgcaagcggcagtggaaaacaacatcgccgcactcagcgcaagcgccacaacggacttgatcttcaaagacatggtatgcatatccttcttcttatctcttcattgccataccgaaaatctcaacgccattcggttgcagagaacctcagtatctcaaataggcacgataagagcgcaatgctacatgtacgttacattgcgcaaaccttacgtatcagccaagaatcgcgcaatgtagctccgtcgaatcacggaagatccatatacgaaaacggaagacacgcggatttgacccgcatgccttccgtcatatcggcgtcacagtatcgccgtgtgcgatgtctgccttacgtttgatcgttcagtcgaggtcagtcggattgatttcggctttgtcgatcgctccgttctccacgccccaatgcttgaggatcttcatatacgtgccatcatccatgagcttctgcagtgcggcctgcaccgccttggcggtatcggaatcgccctttttgattgccacggcctccttggtcacgccgacatcctcgccgagggcttctagcgtatcttcggtttgcgcgatggcatagccggcgaccggcgaatcagcatagaatacgtcggccttgcccgtcgccacgttcgtggtcacatcggtctgcagcttattcgacagaatctgcacttcggacttgccgtcggccttgcattgtttggcggccgcgttgacttcctcttcctgcgtggtgcccgtctgcaccgcgatcttcaagccgcacaggtcggaagtggcgaccttgttcggattgcccttcttcaccacccacgtggaaccggccttgaacatgctcacgaaatcgacggcttccatacgctcgggcgtgatggtgaacgacgaaatgccgatatcgtacttggtgccgatcgacggaatgatcgaatcgaaattcgacgtttgcggcacgacctcaagaccgaacatattggcgagcgccttcgcgatatcaacatcgaagccgaccggggtcttgccatcctccgcaaggaattcggcgggagcgtacgacgtgtccatgccgacggtgagcttgccgtccttggtgactgattccggcagcatcgcggctatatcgtcatccttcgtcacgccggaaacgtcataaccggtggtgttcgacgacgactcagaatcactggaagccgcggaatcggacttttccgatgtgccgcacgcacccaacgaaacgatcatggcggcgcttagtgcaaaaacagcgagtttcctcagattattgaaagccatcgcggatcctctcttcattcccaaccgtatgaatacggccgaaccgaagtcctgcaggcaccatagaaaacgattgctacggccacgttaatagtacgcaaactctattcgatatgccgtttttccttacgaaaaagcgggttttgccatatcacaatatgatcaaaacccgctttgttcccagcacgtcgccagtcatgcgatcattgaaccgtctgatccgtggacggttcaatcatggaattattcggcgcccggcgtattgatttccgacgtttcgatggcaccgtcctcgacaccccaatacttaaggatcttcagatacgtaccgtcgtcgatgagcttctgcacggccttctgtacggcctcatccatctggctgtcgccttttttgatgacgatgccttccggagcgacgccttcgaccttgcccagcatttccagctgtccatcggtttgcgcgatggcatagcccgcaaccggcgaatcggcatagaacacgtcggccttgccggtgacaacgttcgtggtcacatcggtctgcagcttgctggagatcacttcaagcttatccttgccgtcggcctcgcattgcttggctatcttgttcgcttcggtctcctgcatggtggcggtctgcacggccaccttcttgccgcacagatcggacgtgtcgatcttgttcggattgcccttcttcacggcccatgccgatccggcatcaaaatggcttacgaaatcaaccgcttccaaacgttccttggtcacggtgaacgacgaaatgccgatatcgtacttggatccgaccgatggaatgatcgaatcgaaattcgcggtttccggatccgcttcaaggccgaacacctgcgccaaagccttggcgatatcgacatcgaagccgaccggggtcttgccgtcctccgcaaggaattcggcgggagcgtacgacgtgtccatgccgatggtgagcttgccgtccttcgtcacataatcgggcaacagtttggcgatgtcatcgtctttctgcaccgacgaaacgtcataacccgtcagttcgctcgctttcgaaccgctatcggacgaagccgcatcgtcgcttccatcactggtgccgcatgccgctccagcaaacagcatcgcaacgctcagcgcacacgcggcaaccgccttcagacttttcttcgcttccatatccttctcctatgtctcgctcggtctattcgaccgaatctgaaccatacactagagagggcaagctacaaaaagattacggccaccgctgtatatcagtatgtgaaaccggaaattttccggttaccacttatcgcacctgcttgttggcatatcgcatggcacgcaaggcctcacgcttgtcttgctcctcgcgcaatgcctgacgcttgtcgaattccttcttgcctcgtgccaatgcgatttccgccttgactcgaccgtctttgaaatacaggctcagcggaatgatggtgaaacccttggcttggctttgacgagccagcttgtcgatctgcgccgcgtgaagcaacagcttacgcttgcgcttaggggcatgattgttccacgttccgttgagatattcgggaatattggctccctcaagccacatttcaccgcgacggtcgatggtaatgaacgattcggccagcgatgcgcggccttctcgaagcgacttcacctcagtgccggtcaacaccagaccggcttcatacttgtcttcaatggcatagtcgtggcgtgccttcttgttttgcgcaatcggcttcacgccttgctccttggccatgtcggacctcctttccggttcttcaaagaagtgttctgcaacgcaacaatcgacaatatcatgggagcgcgccgcccaacgattcaggcggcgcgctcccgcgacacaacgctcaaggaaagctcaaacgccccttgatgaatcagtgcacataccagaactgggacgcgttgtacagtgtgcggtacgacaccacatatgggccaccagccgcgttcatttcggaaatggtgatggtgttgccattcaccgcttccaccacacccacatgaccgtagaagccatcggcaccagcctgaccgggcaggaaggagattgccgcaccgacctgcgggctatgatccacgcgaagaccatacgacggtgcggtagcgtaccactggccaccgttacccaagtacgagggggttccgatacccatctgtctacgacgttcgtacgcccaccacgtgcactggccggccacgtagccattgccgtaatcgccattggaggttccctgaccggaattgttattggtactcggcgcgggagcaggcgtaggcgtaggcgtaggcgtaggcgtaggagcaggcgtcacattgttgccgccactattggtattgttgttgcctggccgggtctgcccttgattgccaccattgttttgattagctgctgcggcctgctcggctgcatactggcggttgaaggaatcgacctgtgactgcaacataaccgtttgcgccgcctgtttggccacgctgccgttcagctgcgactgttggctttccaattcggcacggcgggtttcgccttctgcacgcaactggtcaagcgagtcgcgctgggtctgtgcggaagcagcagcctgctgtgcggaagcggctttttcgtcagctgcggttttcagattggcgatctgcttctcgattgcagaaagacgctcgctgcggttcatcgacgtgttcaacgtattcgccgcatcacttgccgcattggcttcggtacggctcaacgcatcacgagactgcatggaattaatgaattcctgagtgctcgtggaacctgtcaccacgctcatcacagtggatgcatcggaaccatgcagatcttcacgagccatctgtgccacggccgcatgcgcgtcatcataatccttgccggtctgttcgatctgcgcttcgaggttttccttatctttttgcgcggcctccaaacgggaagccgcagcatcagcttcactctgtgccgaagcggcagtagcatttgcctcatcgactgcagcttgagctgcaggaattttcgtatttgtcaattcatccagctcgacgatcttgtcggccaaatcagacttcacaccggaaagctgtgaacgcaactgggcttcacgctgagagctggcagccttcttattctgggcattcaccagattgctgtatgtattggcttgcgcctgcggaaccgcagacgagaacggggcaatcgccatcgtggcgcacaaagcccccgttgcaaacaccgcgacggccggttttagagctttcttgcttgtcattcggtcacttgcctcccatcattggttccataccatagcatcccatgcttaaaacgcgacacagataaacgtatccaatccgtacaaaacggaatgttctcaggctttcaaatatctatgcaacgacactgtggatgcaatcaccgacaacagcaccgctcctgcaaccaaaatcggcgaaatccacaataccgtcatctgattcacatatggaatccatttcacggaggccgcaagccaatcagtgatgaataccttcaccaatgccgataaagtgacgcaggaaagcaaggagccgaccattgatgcgatcgccccttcaagaatgaatggcagccgaatggtccaattcgaagcacccaccaaacgcatgatctccgtttcggttcgacgtgacgcagcagacatgcgaattgtggtaccggtcagcataatggcgacgaccaccatcaccgcggccaatgcggcggttgcaatggtcgcacgattcagcactgcgaacaccggctcaaaaatctgccgttgatcactgacagtatcgacgccctccttgccagaaagcacttcggaaacgacttgatatttctcaggattcttcagtttcagccacaatgaatcctgcatatcgtcggcagtgagcgtacgcccctgatattcaccgttcggatattgtttgaggaaagtgtcgttgtagaaatcttccttgcttacaaaagtgatttgcgatacatcatcggcaagctcgttgcgaatggttttctgcaagtcattgatctgagtctgcgttgccgcggttcccgcggtgcagttcacggattggctggtgccatcgggacacatccacaccaccacttcgaccttggaataccaatcgcctttggctttggtgatctgcgcctgagtgagcaccgatgcgccgataaacagaaacgagatgaatgtaacgagcatcactgaaagcaacatgggcacgttgcgcttgaggctgctccaggtttcggaaagaatgaaacgcaaacgcatcagtcgttctccttgctttcggacgtttcatgctgttcatcggattgttcgacggatttcgcctcgccaccggcagtcgcggcgggcgctgccggaggagccggaggcgcgggcggagcgggaggcatcggccgtgccggaggagcgggaaccgttggctccgcggattgctcgttttcagccgctttgcttgattccatgcctgtatcaggcgaagagccagtcgcgtcggcattggcttcggtctgcgaacgtgcagccgaatcggcatgctcctgttcggcaagatcctcaagtttcagtcccttgccccaggtcagcgtagtctccaccggagcgaacgcctcgccataacgaccggtgcgaccggaatgcacggaattggcgagacgcgcgatgcccgcatcaccattgccgctgtggatggccgcagctacggcatcaaccgcgttcgccgcggtttcggctcgcgtcgcgccttccacgtccaccgcctcatcggaaaaatcagacatttcaagcgcgcccggcgcacgatatttcgagtcgacgtcgccgccgttcaacgcctgatgcgatttggattcgacttcggcatccgggaagtacagtgcggaatcgtaggatccctgctgctcgtcacgcacgattttgccggtatgcagttcgaccacacgcttgcgcatggagttgacgatttcctcgttatgcgttgccatgacgatggtggtgccagtgcggttgatggcgtccagcacttccatgatgcccagcgatgtggtcggatcgagatttccagtaggctcgtcggccagcagaatctgcggatggttcacatacgctcgcgcaatggccacacgctgtgcctcaccgccggaaagctcgtgcggatagttgttttccttaccggtgagaccgacagtctgcagcactttcggcactaacgatttgacggtggaacggcttgtgccaatcacttcaagcgcgaacgccacattctcccataccgttttgttgttgaggagtttgtaatcctggaagataaaaccgatggaacgacggtaatgcggcacctgccttgacgacaggcgcctcaaatcattacctgcgacgcgaatctcgccatccgtgacctcctcctcgcgcagcaacaggctcagcaatgtggttttgccggaacctgaagcgcccacgaggaacacgaaatcccctcgattaatgtcgagattgatgtcatccaaggcaggcctggtgcctttcggatacaccttgctcacatgttcaagcgaaatcagcgccatcgtcgtacccctccactatgtgctgttctgattacggtaatcgtggtttttaggcgtccgcctcttcggccgccgcgcgacgctgctcatgacgccaacggatgccggcctcaatgaacgcgtcgatatcgccgtcgaacacggcctgggtctgcgaagtctcataaccggtgcgcagatccttgaccatctggtacggatgcagcacgtaggaacgcatctggtcaccccagctggccttgatatcgccggcgagctccttcttcttcttggcttcctcttcgtggcgcagcaccaacagtcgggactgcagcacggccatggcagcggcacggttctggatctgcgagcgctcgtcctgcatggtcaccacgatgccggtcggaatgtgggtgatacgcaccgcggaatacgtggtgttcacgccctgaccgccagggccggaggagcagtaggtgtcaacgcggatttcggaatcgggcacgtcgatgtgatcggtcgcctcaacgagcggcaccacttccactgccgcgaagctggtttggcgacggccttggttgtcgaacggggagatacgcaccaaacggtgggtgccgccttccacgctcatgcgaccatacgcataaggggcatccacctggaaggtggcggacttgatgcccgcctcttcggcgtaggaggtgtccatgaccttggccttatacccattgcgctccgcccaacgcaggtacatgcgcagcagcatctgagcgaagtcggcggcatccacaccgcccgcgccggagcggatggtcaccactgcggaacgttcgtcatattcgccgtcgagcagggtctggatttccatgtcggccagatcgttctgaatgctttcgacttcggactgcgcttccgccaacgtgtcggcgtcttcttcctcctgacccaattccaccaacgtttcgacgtcgtcgatgcgctggcttgcggaagcgagacgcttcagctgggactgcactgccgacagtttgctggtcactttctgcgcgttttcgggattgtcccacaatcccggttcggccgcctgaacttcaagatctttggcctgcgcggtcagtcggtcgacgtcaagcgccttggaaatcgactcgtatttggcgcgcgcctcgccgattgcctgggaaaaatcaaattctgccatcgtttacaccatacatttctttatgcgttctttatattctgtcatggagcctcatacggctttcgcacaatcctcaacttcttccacgtacccacatactcgttcccatcctgccgaaccgcgaaccagtctcgttacgtatgggattgcaggtccggggaggatcataccggaccaaaggcgtcaaagacctgcgtagatagcaggaataaccagactcagcagcatcgccgcagcgatgacgatgcacaccgcccgcaccatggtgcggcgacggcgttctcgctgctcgcgttcgcttctgtagtcactcacggggtactagtataggcaaggccttctacttattatctttcggcgatctcaccatattttgccgcatcgcaatcctgccatatcatattcgcgaaacctgtgtacgcattacgcgacattgattgcatgtcatttatgatacggttcgccggcattgattttgtatgcacgatacagctgttcaagcagaataacgcgcattaattgatggggaaaagtcattttggaaaaactcagcaggtagtcggcccgtttcacaatcgttgggtcaagtccgagcgatccgccgatgatgagttggatatggctggtgccatgcactccaagaccgtcgattttctgcgcaagttcttcactggtcagctgctggccttcgatggcgagcgcgatgacgaacgcatcgtcgcgaatatgcttggcgatgcgttcgccttccttggctttgatttgccgttccactccctcactggcatgctcgggtgttttctcgtcggccacttcgacgatgtcaagcttgcagtatcggctgagtcgtttcgaatattcggcgatggcgtcgcgcagatattgttccttgactttgccgacggtaatgagggagattttcatatttgatatttagttcttgtgcagtttttcgttcagttcgatgccggtcttgcgatagcgcgcttcgatacggccggacacggaattacggatgaacaggatgttgtctttgccggaaagatcggcgcccttgacggtttcgagcggttcgcccgccgcgaccttggccttgtcgtagatggtcaccttggtgccggcggtcacatacagaccggcttcaaccacgcagttgtcgccgagggagatgccgatgcccgcgttcgcgccaagcagggagtgctcgccgatggagttcttaagcttgccgccaccggacagggtgcccatgatggatgcgccgccgccgatatcggaaccgttgccgaccacaacaccttgggaaacacggccttccaccatggaaacgccgagcgtgccggcgttgaagttcacgaagccggcatgcatgacggtggtgccttcggaaaggtgggcacccaaacgcacgcggtcggcgtcgccgatacgcacgccggtcggcaccacatagtcgaccatgcgcgggaacttgtcgatcgacagcacgttcacgtcaaccttcggcagtcccggaacgcactggttggccgcggccatcacgtcaagcttgcgcagcgcgaaatcctcgaccgcgaacgggccataattggtccataccacattgttgagggctgcgaaaatgccgtccagattcagggtgttcggcttggcgagacgcatgctcagcagatgcagacgcaggtatgcgtcggctgcgtcttcgatcggttcgtcaagcttcgacaccgtgaacaccggaatgcggcgcacgccacgcgcatcgacgccctcatgggcgagattgccaaaattatggttcgggcgtgccacctcctccggagcctcgccaagcttcagttccgggtaccatacgtccaaagtgttgccggccgcatccacgctggacagaccccaaccccacgcagtgcgctgatcggtcattcttcgctccttcacaacagtgattgcattacttgcatgtttccgtgcaatactttagccgcagggcttggcgaacagcatcacaagtccatgaaacagcgaaaaagcaactatcgacggtcgatcggagtgtaatcacgttcggtataaccggtgtacacctgacgcggacgaccgatcttggtgttcggatcggcaagcatctcacgatactgcgcgatccaaccgggaatacgtcccaatgcaaacaatgtggtgaacatggacggatcgaacccgatcgcacggtagatcaatcctgtgtagaagtcgacattcggatacaggtgacgcgacacgaaatactcgtcgttcagcgcgattttctccaattccgtggcgacgtcgaacagcgcacgctcgtcggcaggcaatttcaacgtgtccgcgcgttccatgatcttctgcagatacttcttggcgatcgcggcacgcggatcgtacgacttgtacacgcggtggccgagtccggaaatacgctgaccgctggttttggcgtcttccacgaattccttgacggttttgcctgaatcgcgaatggctttgagctgacggagcaccgcttcattcgcaccaccatgcaatgggcccgacagcgcgttgatgcctgccgcaaccgcggaatacaggttggcgtgggcggaaccggcgatacgtaccacggaagtggagcagttctgctcatgatcggcatgaatgatcagcaggcgtccgagcgcatgcacgtacagcgggtcggaatcgaacggctcgtacggcaccgcaaagcacatgcgcaggaaatcgtcgacatagccgcgcgaataatccggatacagcatcggctcatcgcggcgacggcggaaaatgtagctgacgatggttcgtgcctttgccataatgatggtcgcagcctcgtcaagctggtcggaatcattgatatcagtagtgtccggatagaaggtggcgagcgcgttgaccgcggatgccatcacgctcatcggatgcgcggtgcgtgggaaagaacccatgaaggtacggaaatcctcacccaccatcgtgcgatggttgatgtcggaaatgaaccggtcgtactgctcctgattcggcagttcgccatgacgcagcaaccaggcgacctcaaggaaatcggattgctcacacaactgctcgatcgggtatccgcggtagcgcaggatcgagttcttgccgtcgatgtacgtgattttcgattcgcattgcgcagtcgtcaggaaaccagggtcgagtgtgacccagccgtcgttgcgcagcgtggacaccacgatgccgtccgcacccgccgtggcttcgaccaccggcagggtgaagtctttggattccacactcagattggctgtggccatacttgcacgctccttaaccgttcggaagtatcgaacactatatggcatgcgcgtttccaagcatggtttcgtctcaaaatcaatcgattgacatccgatacttcattcctgcaaggcaaataattcgactatttccgcgcgaaattacgcatataaaaggccgatgcccgaataatcgtgggcatcggccttcttttcgtacgcttcgctccgtcgtattggagctttgccgcgttttacgctaccgtctgatcacttgtcgcgaacggtgaggatcaccggaccgttgtcggtgatggcgatggtgtgttcgctatgcgcgccacgggaaccgtcggagctcttcagcgtccaaccatctttcggatcctggtagatttcgtcggtggtcttgaggaaccacggttcgatggcgatgaccaggcccggacgcagcttgtagccgtggtgcgcgcggccatcgttcggcacatgcggatcgccgtgcataatacggccgacgccatggccgccgaattcaagattgatcggatagccgtattcgcgggccacatcgccgactgccgcggaaacatcacccaaacggttgcccggctgcgcagcggcaataccggccgcgagcgcctcttcggtgcacttgatcaggcgcagatcctcaggatccttatgctcgccgaccacgaagctgatggcggaatcggcaacccagccatcgacgttgatcgccagatcgaggctgaccaaatcgccgtccttcaggttgtaatcgaacggaacgccgtgcagtacggcatcgttcacggaaacgcaaatatagtgcgcgaacgggccggtaccgaaatccggagcatagtcgacatagcaggattcggcacccttgcgatcgacgatgcgcttgtgcacgaattcatcgatttccagcagattggtaccaactttggtaaattccttgagatcgcgcagaatgccgccgacaaaacggccggcaggcttcatctcttcgatctctttcggtgttttcagttcaatcatgcctctaaccctacttcgtacgccctacagtgctcggctctccctggcttttcttacgattatgcaaatctcaccttatgcatgccgttgcggaatgatgattattcgtttcagatacactgttttgtcaccaaagatggatagtgtgaagtcatgagtaccactttgaattcgggtatcgatccggcatcgttctccgccgtgaccggccctgcgcaagatctgttccgctatgtcaacggcccatggatcgacatgtatcgtcttcctgatgatcgttcccgttatggttcgttcgataagctcgctgaagatgccgaaaaccagattcgtgagattctcgaagacgacgactgccctgccgagaagtcccacgccctgtatgcaagcttcctggacgttgatgccatcaacgcttccgggctcgccgccattgaagaccagttgaaggctattgacgtcgctgccgacaaggctgaactcacccgctctttgggcgcgatgaacccggctggcggccctgacctgatcggcattgccgtgtatggcgatccgggcgctcccgaaaccaacatcatccatgttgagcaggccggtttgggtctgcccgatgaggcgtattaccgtgaagaccattatgcgccgattcgcgaagcgtacgtcgatatggtggccaagcagttgaagaacgcgaagcttgccgccgatagcgagcaggccgaagctcaagcccagcgtttcctcgatgttgagacgcgtatcgccgcgaaccattgggacaatgtagcaacccgtgattcggtgaagacctataatcccaccgattatgcggaattgagcgccatgctcgccgattacgatctcgacacatggatcgaatcctggcagtccgcatatgatcagacttccgcagctcaggtgcagccgcttgatttccgaggcattttcaaccatgtggtggtgcatgagcccagcttcctcaccggtcttaacgcattctggaaggccgcggatctcgacgatctcaagctgtgggcacgcgtgcatgtgatcatcggctccaccttggagttgccgcacgaattcgatgagacgaatttcgagttctatggcaagacgttgtctggtcagaagcagcagcgcgtgcgttggaagcgcggcgtttcgctggtcaacggcatctgcggcgaggatgtcggccgcgaatatgtgaagaggcacttccctgagtcgtcgaagcagcgtatggaacagctggtcggcaatctgatcgacgcctaccgcgtgtccatttccaactccgcctggcttggcgaagaaaccaagcagaaggcgttggagaagctctccaagttcgtgccgaagatcggctatacgaaccattggcgtgactattccgcgcttgatgtgcacgagaatgccggttttgccgagaacatgcgtgccgccaacttgtatgagaccggctatcagctggccaaagtcggcaagagcgtcgacaaggacgaatggctgatgaatccgcagacggtgaacgcctattatgagcagaccatgaacgtgatcgtgttcccggccgccattctgcagccgccgttcttcgacccgaacgccgaagacgccgcgaactatggcggtatcggagcggtgatcggccatgagatcggccacggcttcgacgatcagggtgcccagtacgacggcgacggcaagctcaacgactggtggaccgaagaagacaaggccaatttcgagcagctcacgcagaaactcatcgaccagtacaacgcgttcgtgccaacgcagcttgccgaaaaatacgccgacgatccagctcaggctccacatgtgaacggcgctttgaccatcggcgagaacatcggcgacctgagtggcgtgaacattgcgctcaaagcatatgcgttcgctcttgacgaggcggcaggccgtgagaagaacggttccatggagtccattgaagcttcgctgtctgaagcgccggaaatcgatggtttcaccggtttgcagcgtttcttcctcagctacgcgtccatctggcgcaccaagaatcgtgacgagctggcggagcagtatctgcagatcgacccgcactcccccgccgaatgccgcacgaacggcatcgcacgcaacgtggatctgttctacaaggcgttcgacgtgaagccggaggacggcatgtggctcgatcccgatcagcgcgtgcgcatctggtaacaaaccacatcatcggctggcaatcggagccaagcatgcaaggcatcggtgccgcctaatatatgtcgccgtcgaattccccggtatctcccgagaattcggcggcttcgtcatcttcgggaaccacgatttcgaccggcgccacactgccctgcctgacgaacggatcggctcccacacgcggttccgttcctttcgcttccggctggtgctggtcgttcggcttgacgaacttacgcaacgtggtgactccccggttaaggtcgtgccctgcggcgctggcttccagcactatgcgtgactgcggtttgccgttctgatcggcccacgtttccgtggcgagcgcgcccatcacgataaccggctcgcctttcttcagagattggcagatgttctcggataggttccggtacgctttcaccgtgatccatgtggtgggaagatccttccattgctgtgtgcgattgtcgaaataccgtctggtgctcgccattctgaacgaactggcatggggcatgccatccttgttgaattgcgtgggattggcgcccacatatccggtgatggtgatgagagcttgctgttgtgccatgatcggccctttctgtcgcattggtaataaaggggccgcggaaagcaccgatgaaggtgcgaaagcaacgcgcagtcggagaaatgggttgcgagagaggggttctgcacgcctttccgcttccttgcgtttccgcggtagaaccactatccccgattcgaccatactggcacaagcgcaaccggcaaatgtggataaaggacgccgtttcgggcgagtcgtggatagtcggtggataaatctcacttatccaccgcaaggcactgccgatatatgcatggtttttcgtttgttttccccataaatgttttcctcacaatcatgcttcctcccacctgtttccagataaaaaacggaagattatggcatatccataatcttccgtttatatggtgaaataatcagaaaaaatacgattattacttcagcagcgcggcgacacgatcggcaatcacccgggctgcgtcggcgacaggcacggcttcggcgttctcgccattgcgatcacgcacttcgatggtgccattgttgacagtgtcgcggcctgcgacggcgatcagcggcacgccgataagctcggcatccttgaacttgacgcccggggaaaccttcttacggtcatcgaagatcacttcgatgcccttggcttccagatcggcgatcagttgctcggcggcttcgaatgcggccgcatccttgccggtggccaccacatgcacctgggcgggagcgatgatggccggccatgccaagcccttctcgtcatggtgggtttcagcgatacaagccatcacacgagacacgccaatgccgtaggagcccatccacaccggcacggtcttgccgttctggtcgagcaccttcaggccgagcgcgttggaatacttcaaaccgagctggaacacctggccgatttccacaccgcgttcgaagctcagcgggccggaaccgtccgggctcatgtctccgtggcgaacctgcacggcttccaccacgccgtcggcttcgaagtcacgaccgtacacgagatcgtagtagtcgactccggcttcatcggcaccggtgaaccatgcggaaccgcgggcgatatgcgcgtcaatgaggtaacgcaacgcttcgccggtttcgttggcgttttcagccttttcaccgccgcgagcctgcgggccaaacgccatcgggccaatatagcccttgacgagttccggatgcttcttcagatcctcgtcggtggcctcttcgatttcagccggagtgaactgcgcttcaagacgcttcatgtcaacggtacgatcgccaggcacgccgacaaccaccagttcgcgccacggctcgtcatgctcgtcatcctgcggatgcatcacggcgatcaccacgttcttcagaatgtcggaggcctcccacgcgcggccatcggaacgcggatggttggcgttggcaaattcaaccatctgatcgatggtttcagcattcggcgtcgggcgcttttcagcggccggagtgttgctgaagtcgatggcttccggttccggagtggtcagcgcctcaacattccaagccttgccgctcggcgactgtgcgaaggtatcttcaccgatttccatcggggcaaggaactcttcggattcgaaaccgcccatcggacctgccatggcgtgcaccggcacatacttcaaatcgagacggttgaaaatacgctcgtaggcgccacgctcgtccatatacgccttgacaaggccttccttgtcaagcgtgaaggagtaggcatccttcatgatgaattcacggccacgaatcaggcctgcacgcggacggaattcgtcacgatacttggtctgaatctggtagagggtagccggcagatccttgtaggaggagtacaggtccttgaccagcagggtgaacatttcctcatgggtcggcgccagcaggtagtcggcctcatggcgatccttcaaacggaagatgttgtcgccatactcttcccaacgatgggtggcctcatacggttcacgcggcagcagaccggagaagtgaacttcctgggcgtcgatcgaagccatttcctcacggatgatgttttcgatcttgttcagaacattcaggcccagcggcagccaggtccaaatacccggagcggccttgcgcaggtagcaggcgcgctgcagaagcttatccgatacgacatcggcatcggcgggatcctcacgcagagtgcgcaggaacatggtggacatacgaagtgctttagtcatatgcccaaaactactcaggcaaggggacgtaagcccaatccaaccacccgttcaccgacgtatggcaacgcacggacggaacacaacagtcatatccgtcgaatcccaaaaatcatcatacatgtcaaacaaggcaatcgccatactagaacagcgcgtcctgcgcgaactcgtcaccgtcgggaacggcaatgttctgctggaacgcggcgatgccatcatgagccaacatatcggatgcctgcgccgaggcgagacgcaactcaccatccaatcgcaccgcatcgggcgaaaccaagaacatgcgttcgttcacaccgttcaaatacaggccttgcagaccttccacacgagacagcgccacataccccatgccgggcgcgaaagtgcgccgcaaatccatcaccgcacgctcgagcgtcataccttgcgatttgtggatggtgatcgcccacgcacagcgcaacggcacttggttgacgctggcgagcactgtgtcgccgtccatcatttcccagcaattcggcttcatggtaacgatattgccgttttcaaattcaacgatcggccatccgcccttgttttcggcggcaaatccgcgcacggtacccaatgatccgttcacgaattggtggtcggtgtcgttgcgtacggccatcaccgcagccccggttttgagctgcaaacgttcgggggcaagcatgttcttcttcaaacgttccaccagattgactggtcctgcggcttcggcgaaatattcgtgcggctcctcgttgatttcgaacaggcgcatgtcgttgagcgtgtccgcctgcttgttgacgggaaacagattgacggcctgttgaccaggttcggggattgtgcccagtctggtgaggagcacattgcgatcgtcgtcgttcacgcaaccgttgcgaatatcggtcaatacggtgagcagactgccgtcatcctgacgatgctgttcggtcaggtaacagattgcgggattcaattcccgccataccaatgattcggtgacgaaaccatctggattgagtcccgctttcgcatatcgttcgcgggaagccacgaattccgggcttggtgtgaccaaatcgtggttgcgcccactcacactcactggcggaagctggaagaaatcgccggacagcaccacttgaagcccgccaaacgggcgttggtcacgtcgaatgatgcggcacacctgatcgaccatgtcgaacagccacgcatgcaacatggaaacctcgtcgatgatgagaatgtcagcgccctgcagcttacgtttgcgtcgggtacgtatggttttgatcagattgtcggtgagcgcgttggcaagtccgacaccgctccatgaatgaatggtctgcccgttgatatgcgtggccgcgataccggtggacgccgtcaccgacaccgccgcaccttcggcacgggcctgacgcacgaactcattgagcacgtaggtcttgccagcacccggcgcacccgtcaggaagacgctcgcgccactttgcagaatcgccaatgcctcagcctgccgcatgccgcaccgcctttcctgttcaatcgaccatcaatttcgaagaaacggcttccttacgcaatcagcttgtcgacaacctgaagcaccccgtgatcggcattggatggagccacaaaatgcgcggcttgtttcaacgcggggtgcgcattgcccatggcgaacgaccactgccctgccgaaagcatctgcaaatcgttgagataatcgccaaataccgccgtttgggccgcagtgacgccaagcacgcgctgcaacgcttcgacgccttgtttcttattggttgtagcattcatgatgtcgacccacagtttgccggaaaccaccacctgataatcgttcttcagtggcgtcagcttttccgcggccatcgcttcggcatcgtcgaaatcgagaatcgccagtttgagcatggtgtcgctttcgccgtttgatgcgatcacatcttcaagcacgctatgcagatcgtccacaatctccagtgccgcataatatttgccgacttcatcaaggaacggcttgtccgtgcgctgcacgtatgccgtgcgcaggccacaaagcaccaatcccatatcgtattcgccagccgcggcagaagcgttcaccgtgtcgatggtccagcgggtcacatcggtatcgacgccgtgcacttcggcgatattaccgtcaatggccacgacattgccgttttccgcgatatacgaaagttcgccgccgtcaagcacctgcgccgccttatcggcgaacatggcacgcaaggtagcgtactggcgtccggatgccggcacgaattcaacgcctcgtgagcgcaaccgggcaagcatcggccagaaaccttgcggaatctcgctatgctcatcaagcagggtgccgtccatatcggcaaccaccaagcgaatgtcttgcgggatttcgatgctggtccaatcggctgcgctcactggagtcctttccatgttttcgttggaatatcagattttccaacgattgtgcgatatgtggaatcagttgttgttcaaaatgctggttgccacgatctgatcggcgatcgccttggcttcggctgcgtcaggaccgggcgccgctgccatgaacgccttacggtagtaacgcagttcgtccagggattcgatgatgtcggcgagcgcgcgatgtccgccgttcttcggcggacggttgttgtatacggccggataccagcggcgggcaagctctttgaacgtgctcacgtcgattacacggtagtgcaggtgttccatgaggttcggcatgtaacggtcgaggaattttttgtctgatccgatggagttgcctgcgagcagcggcttgacgccgtccggggtgaagcgggtcacgtattcggtgactttccgttcggcctcttcgacgctcaggccgttctcccattcgttgatgagtccggaacgggtatgcatggcgcgcacgaaatcgttcatattggccacggccgcatcggagggcttgatcacgaaatcaatgccttcatcgagcacattgagatcgaagtccgtcggtaccacggagatctcgcacagttcatcgtggaaaatatccaagccggtcatttcgcaatcgatccagatcaggcgtgaatccttcgccgtgtatgtttcaccgtcatgtgcgtcaaccattttgcctcgtttcctttgcgtgtgcgcgtgccgcttggcacgcttcagctgaacattcgaagataccgcgaggtagggagattggaaggcctacgcaccgggaagtcacacttgttttagcgatttgcttcgtacatcaaacaccgctacttggcgatagggcgacgttcggttataaatattcacgttgcagatatgagtaaagcctcttactttcggtcttttccgagaagtaagaggctgttaccgattttgattactggaattcagcaatcactggcggccggagtagttcggagcttcggcggtcatgacgatgtcatgcggatgggattcgcgcaagccagcgtcggtgatacggatgaaacggccacgttccggcatttcggcgatgttgtgagcgccgatgtagaacatggactggtgcaggccaccgatcatctggtacagcactgcgttcagcggtccgcggtacggcacttcgccttcaacgccttccggaacgaccttgtcgttagaggtgacgtcggcctggaagtagcgatccttggagtaggacttcttgccacgcggagccatggcgccgagggagcccatgccacggtacagcttgtactgcttgccgtgcagcagcaccttctcacccggagcttcctcgcagcctgcgagggtgccgccgagcatgacggtggaggcaccggcaaccagagccttggcgatgtcgccggagtagtgaatgccaccgtcggcgatgcacggcacgccagcggcacggcaggcctgagcggcctcgtacactgcggtgagctgcggcacaccgacaccggccaccacgcgggtggtgcagatggagcctgggcccacgccaaccttgactgcgtcaacaccggcgtcgatcatggcctgagcgccctgacgggtggccacgttaccgccgatgatgtcaacgcccttgaacgcggaatcggacttcagacggcgaatcatgtcgagagccagcttggcctcaccgttggcggtgtcgaccacgagcacgtccacgccggcttccatcagagcggaagcacggttgtaggcgtcacccaggaagccgatgccggcggcaacgcgcagacgaccctgttcgtccttggtggcgtccggatactgctcggtcttcacgaagtccttcacggtgatcaagccggtgaggtggccttcatcgtcaaccagcggcagcttctcgaccttgtgcttggccagcaggtcgtgggcgtcttccttggagatgttggacgggccggtgatgaggttctcgcgggtcatgacctcggaaaccttgagccggtcgtaatcctcggaggcgatgaaacgcatgtcgcggttggtgatgatgccgacgagcttgttgtcgttgtcaacgaccggcagaccggagatatggaaacggccgcacagcttgtcgagatcagccagcgtcacatccgggctgacggtcaacggatcgttgatcataccggattcggagcgcttgacgatgtcaacctgagcggcttggtcgtcgatggaaagattgcggtgcagcacgccgatgccgccattacgagccatggcaatggccatgtcggactcggtgacggtgtccattgcggcggagatcgccgggaccttcatcgtgatgttgcgggtcagatgggtggtggtgtccacttcggacggaatgacatccgtctcgttcggcagcagcagcacatcgtcataggcgaggccaagctgtgcgaaaatcggaggaagtggagcgtacgtggaatctgcattcatatcaggaattgtagccatagacccactatatgaacgcgggctgacttaccgcgacacggcagaacaagcggcaaacaagggtgttatgaaagttaactaataccgcaaggcaaagcgtttaatcagtttttccgacgcttcgatgaccgcaccgacgcatgtctgccgccatccgcagcgtcctcctccagcatctcgggaatcctatgcttcacatacggatacatggtggcgacggtcagcaccacggccgcaatcaggaatccaacaagcacgtattgggccttgaaaaacagcgtcataatcgagccgaatgcgatcagtgccgcccaaccccacagaatcagcacagccccctgcacggaatggccgatgcgcagcatgcgatgatgcaagtgcatgcggtccggatgcatcggagactgtcccttgcgcaagcggcgcacaatcgcaagacacatgtcgagaatcggcaggaacaataccagaatcggcagcagaatcggcatgaacaccggcaagtaaatgctggcatgaatactggccgggtcaaggcggcccgtcatcacaatcgacgcgcacgtgatcaaatagccgagcagcatggaaccggagtctcccatgaacagcttcgccggatgccagttgtgcatcaaaaagcccacgcacatgccgaccatggcaatgtcgatcaatgtcgccatcgaagcgtacgaaggcgagttgcgggcgatgatgtatgaataaatggcgaatgcgatgccgccgatcgccacaatgcccgacgacagaccgtccaacccatccacgaaattgaccgcattgatggacgcgacgatcaaaaacgcggtgatggccatcgacaggctcggcgacgccgtcaccaacgagccaagcggaagcgaaatgatctgcagaccgccccatgccacgaacacggaaatcaacagctgaccggcaagcttgagcatccaatcaagatcccacaagtcgtcggccatgccaagcagactgatcataatggcgccggcgagaatcacccacgcctgttgcgattgcgcgaacaatccttgaatgaacggaatgcgggatgcgaacagcatcgacacggtgaaaccgatcagcatgcccaaaccacccagtcgcggtgtcggaatggtatgcacgtctcgcgcacgcacttcgccgacggcgccgatctcaatggcgatatggcgaatcaacggcgtgatcaaataggtgacgccgccagcaatcgcagcaatgaacagatagattctcatacgcccaaagcaccgccattcaacgtcaaggcctttcggataaccggctcgtgaatcactccctctcgaagaatcgcaatgccatcacgcccataagggtcagccgccacaaccgtggaagccacatgaccgggagtcgctcccccgtccaaatacaaatcaaccgcatcgccaagcgcctgcacggcctcgtcaacggtttgcgcactttcatcgccggaacggttggcactggtggcggccaacggtccggtagcgcgcagcacacgcaaggcggccgcggaattcggaatgcgcacgccctgcgtgaccttgccggtggcgggatcggtacgtaccgtggcgagcgtgcaatcgtcatcggccacggcgatcggagagaacgcgcccggcatgaacatggcggacaggcggttcagcggcaccggcagatccaaatgcagtttctccatgctttcaatagacggcaatagcacttgcaacgacttgtatttcgggcgttgcttcgccgcgaacaccttgcggatcgcctcaatgttgcgcggatcgcacgcaacgccgtagaccgtgtccgtaggaatcacaatcaatccgccgtcacgtacgatttcgacagcctgggcaagggattcgtctgaaatagcgcgaatctcgctcatgacacctcccttttcggcttgctgaccccaccattgtaaggcaggattcttcaactgcgttgaaactgaccttatgcgcccagatacgccttgcgcacctgctcgttgtccatcagctccttggcgtcgccttccatggtgatgcgcccggtttcgagcacatacgcacgatcggcgatcgacagggccatattcgcgttctgttcgaccagcagtacggtaatgccctgatcgtgcagcttgcgaataatggcgaagatctctttgacgagtttcggagacagacccatcgacggctcgtccatcagaatcgtgttcgggtggctcatcagggcgcggcccatcgccagcatctgctgttcgccgccggaaagcgtgcccgccttctggttgcggcgttccttcaggcgtgggaacatgtcgaacaccatggcaagatcgtccgccatgtgagaccggtctttgagactgaacgcgcccatttcaaggttttcctgcacgctcatgcgcgtgaacacgtggcgtccttcgggaatatgcgccatgccgagggtcacgatcttattgttcggcgttttcagcaggtccacgccgttgaacagcacctcgccggaaaccgccggagtaagacctgtgatggtatgcaatgtcgtggttttgccagcaccgttcgcaccgatcagcgacacgatctcgccgtcgttcaccgtcagactgatgtttttgaccgcttcgatggcaccgtaggagacggaaagattcttgatctgcagcatcaggcgtccttcctttcggtcgtttcagacgtttcgacggcattgttttcagcatcgtccgcaccaagatatgcggagatgacctgcggattgttggcgatttcctctggcgttccgaaggcgatggtacgcccgtaatcaagcacttgaatacgctggcacacgttcatcaccaggctcatatcatgttcgatcagcagaatggcgatgccgaaacggtcgcggatcgtgttgatgcagttcagcagatcctcggtttccgtaggattcatgcctgccgcaggctcgtcaagcaacagcagtttcatgccggtcgccaacgctcgtgcgatttccagcttacgttgcgctccatacggcagattcgcggcttcggtttcggccaatccttccagtccgaaaatacgcagcaggtctatggctttggcatgcatgtcgcgttcctgcttccagaaggtcggcgtgcggaagatcgcaccgcccagccggtaggtgaaggattcgttgaacgccacaagcacgttctcttcgaccgtcatttgatcgaacagtcgaatgttttggaaggttcttgcgattcccgcacgcacgacctgatacgttttcttgccgttcatgcgtttgccgtcgaggaagaactcaccttccgtgggctggtaaacgccggtcagcaggttgaacacagtggtcttgcctgcgccgttcggcccgatcagaccgacaagttcgcccgcattgatggtcatgttgaagtcggatacggctttgaggcctccgaaggtgatgccgagatgctcggccttcagaatcggctcgctcatgcctgcacctccttgtcttcgctggatgtgttgatttcgctagatgcggtagtctcgccggtttccttggttttcttagatgccgattgagacgcacccgatttgccgtgcatcttcacgcgtaccggatagaaccacttgttgacgaatttcggcagcgagaactcccaattgccgaacaatccctgcggacggaacaccatgatgatcaccagcaccaccgaatacacgagcatgcggtatgcggagaacgcacgcagcaattccggcaaaatcgtcagaccaaccgcggcgacaatggaacccgtcagcgaacccataccgccgaacaccaccatgatcacgtaattgatcgactgcagccaaccggccatgcttggcgtgagcgcaccgatatattgcgcgaaaataccacccgcaatacccgcgaagaacgcggaaatcgcaaaaacgagcactttcatataggtgatgttgatgccggaagcgccagccgcgatctcatcatcacgaatcgccttgaccgcacgaccataacgggaacgcgcgaacatgaacaacagcaccacggtcacgacggtgatacagaacaccacatacagattggcgagacggtcgatgccgatcagtgcctgcccctgctggccgtccgcaagtcccttgccgccggccactttcagattctggatgatcacacgaatgatctcaccgaaaccaagcgtgataatcgcaagataatcgccgtgcaaacgcaatgccggaatgccgacaagcacaccgaacacacatgccaccacaccgccgacgaacgtgaccagcaggaaacgcaccgtatcatccatctgaacgccgttggcaaccagcagcttgctcatcaacgcggcggaatatgcgccgatcgcctcgaaaccgcagcagccgagcgtaagctgtccgagcacaccgatcgtcagattcaacgacgtggtcatgatcaccgcaatgcagcaagtcatgagaatacccttgacatacagggaaatagcgcccgtttcacataccgcaacaagaatgccgaacagcacaagcacgccaatggcacacaatgcatacgattgcttcgtggaaagcattgatttcttcataatcacaccttctcgctttccggctcgcccatcagaccggacggcttgaccagcagcacgatgatgagaatgccgaacacaatggcgtcggagaacgccgacgtgatcacaccggccgtaatcgtaccgatatacgccttggtaagactctcggccacgccgatcagcaagccaccgaccatagcgcccggaatggaaccgatgccgccaagcaccgcggcgacgaacgctttcaagcccagcatggcacccatcatcggagagacctgcgggtaggaaatgcagtacataagcgccgccaccgcagccaggccggagccgatggcgaaggtcaacgtgatggtggagttcacgttgatgcccatcagaatcgacgcttccttgtcttcggacaccgcacgcatggccttgccctgcttggtgagggagacgaacagctgcaacgcgaccatgatggcgatgccaagcagcaccgttatgatggtcgctccgtcgattttgagtttgccaagcaccagcgttggaatttcaacgatggttggcacggtctgataatcagcgccgaacagcgcctgggagccgttttcaagcagcaggctcatggcgatcgcagtgatcagcgccgtcatattattgcctttttcacgcaccggcttgtacgcggccctttccacgataatacccaccgccacgcacacaagcaccgccggaatcacggcgaaccatgcgggcagaccgcaggcgataatgaacggaatggtaagcatcagcgcgtaggagccgaccatgatgaagtcgccgtgcgcgaaattgatcagtcggatgatgccgtacaccatggtgtagccgagggccacaagcgaatacacgctgccgattttcagaccgttgaagatctgaccgatgaacataatgaccgaatcgctcatcatccctcctttcttgttgtttcgtcagttgaagtcttgtttttcttgattcctcgcgttttttcgctattccgccggctggatggtgtctttgtatgtcggttcgccgtcgctcatttccagcacaatcaccgatttcttcggagaaccatgcttgtcgagcgtgaatgcgccggtcacgccggagaagctcatacctgcgatggcgttgcgaatatcggcacgagtggcgttttcaccggcttgttcgatggcccgcttgaacatgtagacggaatcgtaaccgagcgcggtgaaggtgttcggcgattcgccgttattggccttcttgtatgaggtgatgaactgctgcaccttcgtattggacttgtcatccggcgaataatgcgtggtgtacagcaccttgttgtagttcgctttgtttcccgtggttttgaggccgtcgtagccgtcggggcccatgatgtagccctcatagccgaccgctcgcgcctgtggcacaatgtacgggccaaccgtggaatagtagtacggcgcatataggaattccgcaccagaagcttcgattttctgcagctgcgacgagtattcggtatcgtcggcgctagaggaattctcttccgccaccacgtcgagtccgttcttcttcgccgccgcaacaaaagccttgcccacaccagacgaatacggatcgcccgtgccatacagcacggccactttcttgaccttcaatgtttcggccgcatacttggcggcgatctcgccctggtaggagtccttgaagcaggtgcggaacaggtatccgcccgtttccacggaatcggcggttgcggccggagcgatggtcggcatctggttctggtcggcgagcggcgcgacggcaccggaggttgacgaaatggtcggtccgagcacggcgatcacgttcttgtcgccggccagacggttaaaggcgttggatgcctcgatcacatcacccttgtcgtccatggattccagtttgatctgtttgccgaagattcccccatcggcgttgatttccttgaccgccagtttgaacccgttcacttcggcttcgccataggctgcggctgcaccggaattggtggtgaccgagccgatggtgatcacatcgttatccgcgatggtggcgctctcattactggtggcgtacatgttgccgcccgaacaggctgtaacactcactcccataaccgccgcaagacagagtgcggccagtttttcggcattcttgattttcactgccgttccttctcttcctgtcagcgcaaccggacgcctcatcttgtggatgcttccgcaaccggtatgcttaccgctgaactggtctaatgcaatggtcggacttccaactggaactctattgcaacagaaaaaccacgttcccctggaaaaatctcttattctgagacgcgttgcatcactgctttttcgcggtcatgtatcgcgggcgacctgtgtaatcgttatgcaccatcacattgctgaatccatatgacagcgcgaatgcagacaatcgttcaccttgcgtaatatcgtgttccattaccagcaaaccgccgtttttcagcagttttgcggcacgggcgataatgcgttccggaataagcgtgccatctgcggaaccgccgtatagcgcaagatcgggatcgtagtcgcgtacttccggttgctgcggaatatccgcaagaggcacatacggaggattggtgagcacgatatcgatcgtgccgtccagctggttcagcgtcggtgtttgcgtggcatcagcgatttccagatgatagttgctggcgatgctggggtacttttttgcggtttcgttgagattgacgcgggtccattgcgcggtttgctcgcttttttcgaccgcccacacctcgctgccgggcacttccgtcacgaatgacaggccgattgcgccgcttcccgcgcacagatcgaccactttcgccgaatacatgccgtgcttggtgatccagtcgacaccttcctgcaccacgagttcggtttcctgacgcggaatgaacacgcccggaccaaccttcagatcgaggtagcggaagggcgcgtggccggtgatatgttgcagcggttcacgcttggacctgcgatccaccatggtgtggaatcgcttcaacgcagcgtcttcaccgctctgcttcgcgccttgcttcgccagttcggatgtttcgcttcccatcagcatggccttgtcgacggtctgcaggtcgacgccgaatacttcggcggccaataatttggcatcgtgctccggagtgtcaacaccggacgcacgcaacatggccgaagcggatcgcacgagttcgaatacggtagccatcggccgcctttacttctgatgggccaagcgatcggcttcgtcagcctgaatgtcgctgtcgatcacagcctgcagatcgccgtcaagcacggcgtcaaggttgtacgccttgtagttcgtgcgatgatcgacgatacggttctccgggaaattgtaggtgcggattcgttcggaacgatccagcgaacgcacctgggagtgacgcatgtctgcggcctgtgcggcttcctcctcgtgcttcatggcgagcaggcggctcttcaacacgcgcagtgcggccgcacgattctggatctggctcttctcatcctgcatgctcaccacgatgccagtcggaatgtgggtcatacgaactgcggaatatgtggtgttcacggactggccgcccgggccagagctcatgaagatgtcgattttcagatctttctgatcgatttcgatctcatcgtcatcttcatcggcttccgggaatacaatgacgcccgctgcggacgtctgaatacgaccctgcgattcggtgacggggatacgctgcacgcgatgcacgccaccctcgtatttgagggatgcccatacgccgtcttccggagcgggagtgcccttggcgcggatggcgagctgcacgtctttgacgccgcccagttcggtggtgttttcgctttgcagggtgacggtccaaccgcgcttttccgcatatcgcatgtacatgcgtagcagatcgccggcgaacaacgcggcttcctcgccgccggtgcccgccttgatttccatgatcgtgtcacgcgcatcatcgggatcgcgcggaatcaacgcggtacgcagcttctcttccgccgctggaagctcgctctccaaacgtttcgcctcttccgcgaaatccggatcttcggaagccatttccttggctgcctccagatcgtctttcacctgcttgtatgcggtgtatgcggaaacgatgacgcccaactcggcgtgacgacgtcccagcttacgcatcttatccggatccgacgcgacttccggctcggccatctgctgttcgatattatgatattcctcaagtgcggtaactgccgcggggaactgctcgtctgccaatgtacgccttttctatctgcctataaatctgcgcttcagcgtgaacgcttcgctgaactccactcaacctgtccatcatataaggtgccttggaaacgctgccgaagcgcggtatttcgcaggcatcccacgcatcttacgaatatcccgatcgcatgcacgccagcgcatgcgcatccgtcgcataatgaaaaacgccagcccataatcggactggcgtttttcattgcctaagcaataagactcacttggccttcttgccgtaacgcttctcgaagcgtgccacgcgaccaccagtgtcgaggatcttctgcttgccggtgtagaacgggtggcagctggagcacacgtcgacggtcatgtgatcgccgctgtaggtggaacgggtgacgaaggtgttgccgcaagagcaggtgacctgcactgcgtggtaatcaggatggataccctgcttcatagtttgtctcctagagattcgggggacccgggtcgctgagcccctatggcagagcgtgaaccggataaccttgcagagtatatcagaagccttgactttgtgaaagagtggggcgtcacgggcttgaaccgtggaccggcggattatgagtccgatgctctaaccgactgagctaacgccccacgttgcaacatgcgaacatgccaacttagcaagtttagcaaatgggtggactagttttgcttcatgaaacgcagcggattgtcgataaagcgtcgcaaaccgatttccgcagcgcccatcaaggccggacgatcgacgatatccgccacaagcacgcttgcctcgacttccggatacgccagcacttgcgggcgtaccatgcgttcgattctgcgaatcagttcaggttcgaaacgcgcccacaagccgccgagcatcaccacgtcgacgtcacagacattgatggtcgatgcgattacggaagccatggcctccaatgctttttccacaacggccacggtctgcgcatcgcgctggtgccagcggtcgatcaattcgtcgatggcgctgcgggtcgcggcggcatcgctgctggcgattccggccgcgctcaccatggaacgcctgcccgcatacacttcaaggcagccgcgacggccgcaacggcagacgggaccgcgcatgtcgacggaaacatggcccaattcgccaccgaaaccgtgatcaccgctcaccacacgcccttcgcggatcactgcaccgccgatacccacgtcggtcgacatgtaaagaaacgaatccgtcggcttgatccgcccagaatccttacgctgcgtggcatagccgggaacctgtgccaacgcggcggcattggcctcgttgcaggcaacaggatcaagtcgcttgaccacatcgaactgcttgagatccaaacgttcccaaccgagattgcgcgcgccaagcaatcgcatatcatcggtgacgagacccggcaatgccaaaccggtaccggcaagcacataacctttcttggcaagcgcttcttcctgctgcaaagccagttcgtcgagacgggcgaaaatcgcccgctcgtcggcgttggccatgtcggcgtcgacccactgctcccccacaacggaaccgtcaagatcgagcaccaccacaccatagccgtcggtgttggcctgcaatcccatgccgcacaggcgtccacctttgatttcaagcggaatgctggggcgcccatacagcgattggccggaaggcgcgccttccgccagaatctcattgtcgagcatcaacgacaccaataccgacatggccgctttggtcaatccggttttcttggcaagatcggcgcgactcattggttcggtggcacgcaacagcgagtcgagcaccacggaaagattatggtttcgcaaatcgtcttgattgatgctccgcagtgaagccatggttccctcctctttgacgcgtctttgccgaaaaagcgcaccgcctcaatagttaaatcactttatgatggtacactagacattatagttcattcatctaactaaatgaggtggcgaacggtgcattttccttgcatcgtgttgcgccagctcactgcaaggaggcacaatgactcgaactctcgtggccggcgtcgacacctcgacccagtcttgcaaagtgcgcgtgaccgacgccgaaaccggcgaaatggtgcgtttcggccaggccaagcaccccaatggcacgtctatcgacccgaaatactggtgggacgcgttccttgaggcatcccaacaggctggtggacttgacgacgttgaggcacttgccgtcggcggtcagcagcacggcatggtgattctcgatcagcagggcagtgtgattcgcgacgccatgctgtggaacgacgtaagctcggcgccgcaggccgcggccctcatcgagaagatgggcgaggctcccgccgaagagggcgaaccggaagatgtgatcgcgcgtggcaagcaacgctgggtcaaggccgtcggatcctcccccgttgcttccttcacgctgaccaaagtggcgtgggtggctgaaaacgagccggaaaacgccaagaagatcgccgcgatctgcctgccgcacgattggctgagctggcgtatcgcaggctacggtccagtcgcagaaggcgaggacgcacacttggaagcgctgttcaccgaccgttccgacgcttccggcaccatctattacgatgccgcttccaacgaataccgccgcgatctgatcgccatggtgcttgaaccagcggaaggtgccgaagcggcgcgcaagcatgccgacgcgatcatgctgccgaccgtgcttggaccgcgtgacgtcgccgcagtcaaggcaagtccgaaaattgccggcaagaacgttgaaggtggttgcatcatcgcaccgggtggcggcgacaacgccatggcatccctcggacttggcatgagcgtgggtgacgtttccgtttcattgggcacttccggcgtggcagcagccatttccgaaaatccgacctacgatttgaccggtgccgtttccggcttcgccgactgcaccggccactacctgccactggcctgcaccatcaacggatcgcgcattctcgacgccggccgtgcagccctcggcgtcgactacgacgaactcgcatccctggcattcgcttccgaaccgggcgccggcggtattacgctggtgccgtatttcgacggcgagcgcactccgaaccgtccggacgccaccgcaaccctttccggcatgacgctggccaacaccacacgcgagaacatggcccgcgcgttcgtcgagggcttgctgtgctcccagcgcgactgcctggagcttattcgttcgcttggcgctgagatttcccgcattctgcttatcggcggcggcgcaaagtccgaggcaatccgcacgctcgcgccgagcgtgttcggcatggacgtgacccgcccgaccaccgacgagtatgttgccatcggcgccgcccgccaggccgcctgggtgctgtccggcgaaacggaaccgcccgcatggcagctcaccatcgacggcgtggaaaccggcgaaccgactgaagccgtgtacgaggcctatgtaaaagcacgcggctgatcaatcggccatcgtgaatcgcgagtgatccaacataaaaatgggtgccatcacagccaaaccgtgacggcacccattttcgtctcaaacaaaatcgtgcgatattccgatcaaatcgtgaggtcaaaactgaaatcgtgcgacaacacgtctagcagtagggcaacacgcgaattcgctctgagggaacaccgtaacccaacgtcagatgatgccctcgacatcggcgaaggcaggatcgcgttcgggaatctcgcggattacatgcgccggattgccgactgcgatcgaattggcgggaatgtctcgtgtaaccacagaacccgcgccgataatggaattcgagccaatcgtgacgccaggcgtgaccgtaacgttcgcaccaaaccacacgttgtcaccaatcgtcaccggcgaagcatgttcccagccagccagtcgcgttgccgcatccaaggcatgattcggcgtggcaatggtacaacgcgggccgatcaggcaatcctcgccaagcgttacatatccgccgccgcacaccatgaaatccttgttcaagaacgtgcctcggccaatggtcaggccgatgccataatccacattgaacggcggcgtgaattgtacgccctcccccgcgtcgggaacgagctcgtggaacaggcggtaggcctcgtcaggatcatcgaagaagatgcggttgatcgtggcgcaggtacgcatggcctcgccagtaaacttcggcagcgacttcgatttgcggtattgcgtcggcttgccggcgaacagcctagtcagatcctcgtcggacgcgatcagcgtctccgtctccttcgtcatgcccgtctccttcgtcacgatttccaccacgctatagtgaacgctcacactatactatattcatctacttgacctggcatacgacatactatccgatgtatcgtggcatccgccgagcagcatgtatcgttggccattgggtccgcatgccggacattcgggcaatccggaaccgttcggatcgcccgtcgccgcgaaattcgtccaataccgaatcatgacacgagacaaatcgtaatgcgccaacgggaaggcttggcataggggatgccacgaaacacggtaattacagagtccgtatcggagaatccatcgacgagtccttgtcgaagcgcgacctgtctacgcatgaatccccttatcatcgtccgtgggcaatgtcaggcggaacggcggaatcagcatgccgtcgccgtcgcatatgagtccggattccggattgttgctccacgcgtaccgcacctcatctggcctgcgcgccgtcatgcgcgccacgatatcacagccgtctagccatgcctcggcccgcgcggatgtggcgcagtcgcgccatagaaattcgatttcctggggagcgtcaccgtccaacgtcatcagccggcggccctccgatcggatccgctcgtccgagcgactccgccacacacagtgcatccgcaacagatctccgcagacctcgatggtttccacggccggttgaggctgagcctggcgaccgtataccaaatccatcgcggcattgaacacgcgatccgcgacgagcttcttgtcatacggatgcagatcgttgccctcgccggcgtcaagcgtcaccaccgtcgcaacgttttcaagttcgttcgcgacgttccattcctgttcgcggacgagtggccagcctccatcctcaatggcgtcaatgtcgaattttggaagctggacgatcagaaacggcatatccggctgatgccatttgacgcgccacaattgaatcatggccttcagctcgtcgccatatcgcatggcgcggtcgccggtgttcgattcgccttgataccacaacacagcgcgcaccgcatatggaaaacacggggcgagcatggcgttgtacaggccggtcggcttccatctgacgaaatcctcgaatgggcaatcgcggtcagcttcggcggtcacggcatactgccagatgccagacagatcgaagatatcgtctccgatggtcagagccatccgtttgccaggcgtcacacgtccgccgggacgctcaacaaccaggcgcatgcggatttcgttcgcgccggcgcgcagcacaccggatccgaccggataatcgcgcggttcgtacacattgcttcgcccaccgaccaacacaccattgacccacgtatggtcggcatcattcatggtgcccagacgcagtagagcgggcttgcccgcatccgacggaggcaggaacacggtttttctcatggtaatctcgccgcggaaaccggcaagtccgcgatccttgtaccatcccggcaggcgtatgtcatgccatgccacgtcgcgcggctcgatgttcttggattccggacagtcccacgcgatcaatggcagccattcatggtgggcatcggccacagcctcgtatccaagcgcttggtaccaccggtcccgttcggcaacggaatcgcggcttttcttcgacgccacgccatcgccaagatacggctcaagatcagcgagcgcttcagggaacgcccgcaatgcgtcggcatccatccaggattcaatcggcgatccacccaatgaaacgttcaacaggccgacgggcacattcagccactgacggatcctgcgtccgaagaaataggcgagcgcggagaaatctccaagggtttccgcatcgcacccctgccagaacgcatggtcatgatcgctgcggggaccgttgaagtcacaatcgggaatcgctttgtattgccgcagcaatgggtcaggctcacgatcccactccagcggatagtccgcacgcacccaagccatgggcagttccatgttcgactgtcccgaacacaggaacacttctcccgcatagcattggcgcgagatacattcggttccgtcctcataacgcaccgtcaaatcgtacggtccgcctgctttgattggaccgtacggcacgctccatgagccgtcgtcccccacccgcgtagtccgatccttgccatcgaggcgtaccagcacgccgcgtccaggatcgccggcgccccagatatgtatggtcgcaccggcctgcagcacgcaaccgttgtcaagcagtttcggcaattgcaaaaccatgctcgtccgctcctcattgcccatagaattcaatcccgtcgtgtatgccggctgacggcggacgctctgtcgccagccggcactgtctactggttatcggaaagctcccgatagtcgaagtagtcgaattcggcctgcgcgtcgtagccggacagatcgacgcaggcaagtcccacgaacgcgccggtaaagaagccgccgtaacgttggttcacgtaatcgtcggacaggatcttcgcatcgagcctgaccggaatctcggtgaaatgttccccgtcgaaggaatattcgtaggaatagtattccgtgcggaccttggtgcgcagccataccgcctcagcctcttcgggcactacgatggcgttatccttgaggaacgacgtatattggttgaaatcgttctgagccacttcgatgacccttgcgtgacgtttctcatcccaagtgataaacgcccatgaccagcataggtcatcgtaatagttggtcaggcctgccatctgcatgtaattcttcggatcgaaacgcaccttggtttcggcgtcgaaatcaaatgcctgccagcgacgagccacaagagacaagtcaaacaggttgcacagcgagccctgaccacgcaatgccagtttgccaccgcccaccgtgcccatggcgtcggtgaacgggacgcgtagcgtgttccaattcggaccgagctcgccggaatcgaactcatcatgttcgtcacgcgtcgttggggccaaagtctcgatggcatctttcggagcatcaacgtaacgctgtccgccgtgacctccgatcacgcgcggccagccgtcctcatcccattcgactttctggatggaggtctcgcgtccgagtgtgcaccatccgcgggtgccatgagccggttcggtatcatgacgccacggacgaccgcatagggaggcgtaataccactcgccggacggggtgtccaccaacgctccatggccctgcttctgcaaataggtgtcaggagtgtcgaagttaccgatgaacgggctattcggcataacttcgaaggagtactcgtcaagggtatgggaacgcgccacagattcctgatgttcatacaccgtgccgccttctgcggcgaacaggtagtaccagccatccttcttgtataggtggggaccttcggtgatcttcaccgcagtgccatcccagatggtgcgggccgtttctggcttgagcttcatggtgtcgacgtcgaattccgtcaatgtgataccgtcgaactggtggtggtattcacggaaatcccatgtctgctgcaccaagtatttgcggccgtcgtcgtcatggaacaggctggcgtcaaaaccgaccccgttgatgcgaatcggctcgctccatggcccgtggatgtcctcggcggtgaccaaataattagtgcaatccttgaatgcaccattgaccaccttgacatcagtgtagatcaaccagaatctgccatccgcatagcttaggtcaggagcccagatgcctcccgaagaggggtttcctctcatatcaagctggctggaccggctcaacgggcttggaagaatgttccaatgcaccaggtccttggactcatgcaggcgaacgcctgggaaccattcgaaagtggaattggcaatgtaataagtgtcaccgacgcgaatcattgaaggatcggcatgaaaaccggtgagcaccgggttggaaatcttcataatgtacctcttgcataagagatgaagcccggaagacggaaaggaacatcttccgggcgtgggttgtcacattccgtcagcccttgaccgcacctgtcaggccgccgacgatcttcttctggaagatggtgaaacagatcagggccggaatcatagccagagaggtgaaggccaacacctgtgcggtgtcaacggagtgttcggagctgaacatctgtacgccaagtggcaatgtgtacttgctggcatcactgagcacgaacagcggcagcatgtaggcattccagcttcccacgaaggtaaggattccagtggtggccacgccaggcatggacagcggaatgaccatgcgccagaagaagccaaggcgggagcatccatcgagaagacaggcctcctcaagctcattaggaatcgactgtaggaacggcaccaagatgatgatggtctgaggaagtccgaaggcaatttgcggaaggatcagaccccacagggagttggccagacccagattgcgaatcagcagatacaaaggtgtaatgccaacggtcatcgggaacatgagaccagcagagaacaacgcgtacataagcggcgcatagcggaatttgtatcgggcgatgacaaagctcaccatgatgctaagcaccacgacgcctaccatggtggcgatacccacgatggtagaattcttcagttccgtccagaaaatatcactttcgacgaccgtcttgtagttgtcggggatccatgggttcggcatcccggacggatggttggtgatctgcgaattggtacggaaaccgccgaagataatgtacaacaccggagtgatacagatggccacaagcaccagggagaagaagtagacgattgggttgccccatggcgtcttggatgacttacggtaaccattcttcttgctgtactcgcttttgttggaatgtcctgcgattgttgcggcagtcatcacttcacctcacttgccagggcagcaacctcacgatgctgcacttcctttgcgcgcttcctggcacgcttctcggcttctttctgctcagtaacagcaccgtccaagtcacggttcagcacgaacttctgatagacgagtgcgatgatcaaagagatcacgaagatgatcagagcaacggcggaaccatagccatagttgccggctccacgaccttcacgcaccatgtaggtggccatggtggacacaccagcggtggtcgacacatacttgccccatacgatatagaccagatcgaaaagctgcagagagccaatcatggaaaggaacacccagatccgcaacgtcggagcaagcaacggcaacgtgatgctcctttgcatctgccagaagctcgctccatccaccttggccgcttcatacagttcatcgggaatggattgcatgccggcgagcatcagaattacggcgaaaccgacgtatttccagctgatcagcaacagcagcgtccagatggcgattttcgggtcggccagccaatcaggaccattgatgccgaagttggccagaatctcattgatggcgcccttcttctgtagcaacaggctccatcctgtgccgacgatgacctcggaaacgacatacggcacgaagatgagggtgcggatgagaccacgccccttgaacttctggttcagcagcaatgcgaacaggatggcgagcggagcctggatgaccaacgagccgatcacgacctcgaaggtatgcagaatcgccgcctggaacgcgggatccttaagcgctgtgatgtagttctggaaaccaacgaatttacctgtcttggagggaagtccgtagcccttccactgatagaagccgtaataagcacccaagacgataggcagaatcacaaagcagacgaacagaagaatcgcaggtgcggacagtacgaaaatctcaacattacgacgcattttgccatcggacggtttcttggaccgcttagcgcgcagcgtcaccgcgtctttgcttgtacttgacatggttttctccactaccagatacgtttctcgaataggaaggagggcagatgaagatctgtctatccaccctcctttggccgtcaaccagccatgttcactatcagcccttggacgctgcgtccttcatcgccttgacgatatcggcggaagtgccctggcccgagagcaagttcaccactccggagttgagcgcgttgccgatgttgccgccgagagcggtatccatccacagctgcatgccatcagactttttcatagcttcgaggatagccttaagattttcatcggtaaccgcatcgtaagcttcggcggaagccggaatggtgctgaacgcagtggcgtatttctcctgatttgatttctcagccatgaaattgacgaaatcaacagcagcgtccggagcctcgggattgacagcgaaaccggtcacagcgcccatcaaagcaccttcctcgccttttcctccgtccacggtcgggaaggcgaagaagccaaggtcagccattggcttcttgtccggagtcaggtccttgagaactccaggctcccatgtgcccatgagctccatcgcagccttatgattggccagcagacctgcggacgagctggcgccctgctgggccgtcgtggtgaggaatccttcgttaaaagcattcgcatccaacaaatccttcagatcatctccggctttgacccagcaggagtcggagaagtccttgtcattaacgcccttggcgtaggccttcggagagcattcgcgcatggacaaccagtagtaccagtgaccgaccggccaagcatccttgccaccgagtgcaatcggctcgatgccagcgctgcgaagcttctgcacatcggtcttcagctcgctgaaagtggtcggcacggcatcgatgccagcctgcttgaacaaatccttggaataccagatgccaccaggctggacagtgaccggaacggcatagaccttaccgtcataagacacggattccaatgaggaagacatttgctttttgacggtatcgctaatcttatcagaaatatccattacctggccggcatcaaccatgtccttggtcttggcaccaccaagggtcatgtacacatccgggccggaggcgggatcctgcatagcggtggtcagcttgccttcgaaatcctcgttctggatggcctgaatctgaaccttgacaccggtcttcttctcaaacgctttggccagatcctcccaatactgcttgccgtcaccagctgtggcgttatgccagaacgtaatagtcttatcgtctttggcgccagcgctggagccgcaggcacccatgcccaacatggtcgccaccgcaagagtggcagctgcaatggttttgaacttcattgtcttctccttattgaccaaatcatcatcgacaaaatgatggcaacgacaggaacgacttctctcgagtgggtcgaatcgggaagcatgaccgcaacgaatgctgctgcagctcccctagcagacagagaatcagcctttgactcccttcgaaagtctccatttcgttttcgttgtacctacagactaccgaaacaaatcacacaaagttaagttttttgcaaaatcagaaaactaactatttttcgttgattttacaacgtttttaagcattgccaacatatcgaaagtttcgaaaaacgtaaaccgaaactttcgtttgcattttcggatatgatgaaaagaagaaggagtgactcatgcgcaatacgacaaagaaagctacggtacgactctctgacatagctaaagagaccggttattccctttccaccgtatccaaggcgctcaacggcagagccgacgtttccgaagagacgcggcaaaccatcaacgcggtgttgaaacggtatgggtattcccgtaaagcgacaggtgcaaaaagccaacgaattatcgaaatcgtgttccaagatttcgataatgtttgggcccttgaagtactccgtggcgccattcgcgaagccaagttgcatgatttgaacgtcatcaccaccgaaggcggcaatcgccagcacccggactcatcctggattgacaacatgctgcgtcggcagacggatggcgccattcttgtcttctccagtctgacacgtatcgagcggaacaaactgcattccagaggtattcccttcgtcttgttcgatccattcggtaatccagatccagacacgctgtcggtgcaagcggacaactggaccggaggcgtaatcgccaccaggcatctgctcgcactcggacatacccgcataggcatcatcaccggaccggaggagatgatgtgttccaaagcacgtctggacggatatacatcagcgctcgcggaacatggaatcgaagccgatcccgaacttatcaccgaaggcgatttcaccacttccggcggttacgcacagtccatctccctgttgaaacgaccgaatcgtccgaccgcaatcttcgccggcagcgatctgcaggccatgggcgtctacgaggcggcaaggcagctgggattacgtattcccgaggatttatccgtggtcggattcgacgatgtgcagactgccgcattccttggcccggcgctgaccaccgtacgacagccgctccaagacatggcaagggccgccgtacgcatgctggtcgaagcgctgtccaccgacgtgatccaaccgcacatcatcatgccgacatcgctagtggtacgcaacagcacacagcaactcgaaggttaatcagcggggcaaacctcacaggcacaaccggagggagaacacagcgctcctagcctttcgacccgttttcaactcgttctaagacggcccgtcggaacaccagcagtgaaccatcctgaaattccgtagaaactatgccatgaagccggccatgcaaccgacgaacccaccggcccattcggtgctgaggaaacgagcatcgacactcagcaggacctgcccctgacgcacgaacgtcgcagaatcaaccaaaccatgcatgccagtcacgatgaccgacaagcggttgtcgtcgaaaagtaccgccggacgcactccgtcagcctgtacggcaacagacccagcttgcgaatcgtctccattcaccatctcgtagcgcacatccgtgccatgcatcgaaaacaccgcgtaatgtgtggaattctgccggatcactaaagaaccggacatgggaatcggcatgagcgtcggcagtttcgctattctgcggtagctgacatcacgctcatcgcgcaccaccacatcgctcgtcgagccatcagccacatccaccagcgcaggttccacgtcaccggcgagcgaggatttcaccctaggctcgatggcgatgccatcgtcttcagtagtaaccgtgatctcgtcggccaagcggccaagaccagcgcaagtcactggccatccggggtcaccctcatgcgtatatggtgcaccgttgccgtccagcttccaatcggccggattatgttcccaggataccggagcgacaaagctctcccttcccaagtagctcaataattcgccgtcacgctttccccgtgtctctctcacgccgagacacaccagccaccatcccagttccggatgaagcaacaggtccgcatgtcccacgcattgcagcggttccgacaaacccagatgtcggtgggtgagaatcggattcttcttatccgcgtggaaggcacggattgcggtgccaagatagcagcgttccccgtcacgaacctgcggaatgcactcacccaattcggatacttcccgttcgtaagcttcgaacgcccgaagcagtccatgcggcgcatagatgcgcatggccatttcgctatgttcgaaactggtgcccccctcagcggtcatcagatacacataatcacccacgcgatagagatgcggcgcctcagcccacaccgattccataccgtatccgcgccatattaccgtcttgcccgatcccgcaggaagaccgtcatcgacaaaagtccaagtctccggattaatgcgttgggtccagacctcggtctggccttcccattgcggattgaccgcaggacgggtctgagtccagtacacgttgccatccccgtcctcgaatatgtctggatcgatgccttcagcgccctcaatccagaacgggccatgccatggcccttcgatagactccgcttcaaggataaaattgccctccgcggcgtggaaccgcatcagctcgctttctgtgcaaccaccttccatagcacggcgatcatcaagacgggcaatggtgcatgcaatcacatatttgccatgaatcctgcgcagcgtcggcgcatagacaccgcccgaatcatccacgaaaggaataagcaggcgccttgccaggtcagcatctaccacattcgacacatgcttccagcacgtcatatcctcggaaacgtaaatgggaagacctgggacaagctcaaaagtagaagtcaccaacacaattcgctggaactcatcatcccaaatccaactcggatcaggattcattccacgaagaatgggattggtaatggtaatagtcgcggtcataaatacaccttattcagaaacgttcgtgagcatcgcatcattgcgaacaatcgagactttcgtttggcccaaaaacgcaaacaagccgtacaccggcgacataaccggcagacgacttgcctgcgaaggaaattctaggaagaaggaaggaaagatgagtggtgtgccggaacgccgacgcttcggcacaccacatccggctctgtcacagccgagtctcactgcttgatccagcgatgaatcaggagccctaacggaaactccctattcggctcacgcctcggccagggcgtcgatcatgtagttgttgatcgtggccttgacggactcgaggtgatcggacttggtggcctcgatgagcttggactgcgggatatccagagcgtactcttcgagggaagccagcgaggcggtgccgttctcgacggtcgcgccgatgccggaatcgaaggagctgtagcgctcggcctgcaggttctcgatgaccttgtcctcgtgcatcttggccgcgaccagcaggccggccgcgaaggaatccatgccggcgatgtgggagcggaacagatcctcggcggcgaaggaggtgcggcgcggcttggcgtcgaagttcaggccgccgtgagggccgatctgaccctcggcgaggacctcccacatgacggtggaagtctcgtacaggtcggtcgggaactcatccatatcccagccgatgagcttgtcgccctggttggcatcgagggagccgagcacgccggcctcgcgggcggtgcggatctcgtgctggtaggtgtggccggccaggttggcgtggttgccttcgaggttcagcttcatgaagtcgatgtcgtaggtcttaaggaaggcgatggctgtggatgcatcgaagtcatactggtgcatcgtcggctccttggccttcggctcgatcaggaactgagcgtccaggccgatctcctgagcatactcgtggcacatgtggaagaacttggccatgtgcgcctgttcgcgcttcatctgcgtgttccacaggttttcgtagccttcacgtccaccccagaacacgtagttctcggctcccaggcgctttgcgatctccaaggagtgcttcagctggccaccggcataggcgtagatgtcggcgaacggggaggtggaggcgccggacacgaagcgcgggttggtgaacagggaggaggtgttccacagcagcttgatgccggtggacttcatgttctcttcgatcttgtcgacgaccttgtccaggttcttgtcggtctcgcgcagggtatcgccttccggagcgatatcacgatcatggaagcagaagtactcgacgccgagcttctggaagaactcgaaggcatagtcgaccttggccagagcctcatcctcagcattggagtacttgccgtaccacggacgctgggcggtgccggtgccgaacggatcgaccagctcctgatcgaacgtgtgccaccaagcgacgccgaaacgcagccaatccttcatcttcttgccggcgacaaccttgtcggcatcgtagtaatggaaagccagaccctcctgcggtcccttttcacgaccgacatacggaatcttttcaatatcccacagacccatgggttgctcctttgctattggtttttactttcgtaagaccttgcttttcccgtcaagcggattcccgcctgtcttgatgtacataataaaatcaacttcctaagtttgtcaattcagtgaactattcggcgtttccattgaaaaatagtcaattgtcaactcagtgataaggtgaacatgtttgttgcatcgcagcgctacgcaacgaagcgcgcaatcgaaagaaggaatccatgagcgaaaacgtcgacaccatctgcgtgcagggaggctaccagcccggcaacggcgaatcccgcactcccccgatcattcaggcgacaaccttcaaatacaagtcaagcgaacagatgagccgactgttcgacctatccgaatccggatacttctacactcgactgcagaatccaaccaacgacaccatcgcagcgaaaatctgtgaaatggaaggcggcgcggccgcaatgctgacctcatccggccaggcggcgaacttcttcgcactgttcaacatctgcaacaacggcgaccacatcgtcgcatcctccgcgatctacggcggcacgttcaacctcatcaacgtgaccatgcgcaaaatgggcatcgaatgcacgttcgtaagcccggactgcaccgaagaagagctcgaagcggcattccagccgaacaccaaggcggtcttcggcgaatccatctccaatccggcactcatcgtgcttgatttcgaaaagttcgcgaacgcggcgcatcgtcacggcgtgccgctgatcgtcgacaatacgttcccgacgcccgtcaattgccgaccgttccagtatggcgtggatatcgtcacgcacgccaccaccaaatatatggacggtcacggctcctgcgtgggcggcgcgatcgtggattccggcaacttcgactggatggcccatgcggagaaattccccggactcaccacaccggacgattcctaccatggcgtgacctatgccaaggacttcggcaaggccgcttacatcaccaaagccaccgcacagctcatgcgcgatttcggctcaacgccggcgccgatcaactcgtggatcatgggcatgcatttggagtcgctgggcgtgcgtatggagcgccattgcgcgaacgcgctcaaggtggcgcagtggctgagcgccgacccgcgcgtcagctgggtgagcttcccaggccttgaggaagacaagtaccatgcgctggctgaaaagtacatgccgaacggcacttgcggcgttatttccttcggcgtgccgggcggccgcgaaaaggtgtccgcgttcctcgaccacctgaagatggtgtccatcgccacacatgtggccgacgcgcgcagctgcaccctatacccggcaggcatcacgcaccgtcagctcaccgaggagcagctcgtcgaagcaggcgttggcattgacctggtgcgcctgagctgcggcatcgaaaacgccgacgacatcatcacggatctcgatcaggctctcgccgccgtgcagtgattctcactcaaaatcacatcaggaaggccgtatctcccactcagaggtgcggtcttcctcctatccgagtggactcgcacgccatactcatcttgcacgggcacaccaatcatctgaaatcccttatatgtggcagattaaggcatcttcaaaatccgatttgcgctatatgtggcagattcacactacattcgagggtataaatctatagaaaaatcccgttaagaaatctcaggtctgccacatatagcgattttgacttttccagcaccgtggaatctgccacacataacggtttttattcagcctgttggtacgtccagcgaccggcaagcatagtgccaagcacatgctcgggcatggcacgcatggcctccggagaatcgattatgctcggatcacagtccagaagcaccaaatcggccgcgtctgcgtcccgcaaagccacgcgtccgaccgcggtggacgaagcgagcgccgtttcaaaatcaaggcactgctcaggttggaaaggctcgcggtcggaactttccgtaccgaataccgccgcggagatggccagccatgggtccagcggcgcgaccggcgcatccgaccccatgagcagtttggtccccgccttatgcagactattgaatgcgtaggggattccggcgggggtgccccagaatcgcgcgatgacgtcacgatcgtccatggcgtgctgcggttggatgcttgcggcaagtcccagctgcgcgagtcgcggaatgtcgcactccttgagcatttgggcatgctcaatggaaccatgcgcatgggtgcgttcggcacaatcaagcacaatggtgttcgcttcatcgccgatggcatgacaggcgatgtcgaagccatgttcgacggcgagtcgcatgtacgactcgatttgctcaggggcatagctcaatgtgccgtaggtttccggtctgatgcccgaatatggcatagaacagtaggcggaacgggtgttgagcgagccatcggagatcatcttcatcgcgccgacgtgacccaaaccatgacttccgggcaattcgtctccggtgtgccagccgtcgtcgatggcttgtcggagtctctcgggatatatgccagcctcgacacgcagaccatcaagcccttgcgagaatcggctaatccacgtgtcgatgttctccgccatctcatagtcgcgcacgccgaccacgcctttactcgcagcgtcgtgttcggcgttgcgcaacagatgcatcagctcattggccgcaccaggtcctttgtccagcttgcagtaggcgtcgaaccactcaagctcgccgacgagtccggattcgtccacatctacgccaagcttgcgcgcggcggcagagttcacccaaccgcaatgcatatcggcacttgacagcgccaccggctggtctcccgccaccgcatcgatcgcggccagggtcggctgggcgtcatcggaccacagggaatgccggaagcgcatgccgaccacatattggttcgggtcgagtgcgccgctttcacgacgctcctccaagtgtcgacgcaacatgtcgagcgcttcgccggcactgcgtgcatcaatcagatcgagccgtcccaacgtgtacgaccactgcgtgaaatgcgtgtggcagtcccacaatccgggaatcacccatatcttcgaagcagcatccgttggcctttccgaaggtcgcaccgaagctattcgcccgtgaccgacagcaatgtcgaccggcttatccgaacctacgaaacacacgttttcaatcacacacggctcgcccatacatcctcatttcaacgtgatgttctacccgtgccatggtatcccgcagcagcgcagcagcgcactttcgtctcaatcaggcatgccggcggccgactgtttatccacatttttttgcgcataacctcggttatccacttatccactgtttttcgaatgcgaatagacaacgtcccatccgaggaatcagaaaaatgcaacatgcgttacagttcatgcgcgaaggcacggattcctcgcaggaaagccgttgcaggattgctctgattcgcaatgggctaccatgtccgaaagtcaactggaaggttcgactgaacaatgggaaaatcgcgcttttggatatggcctatccagatataaaagtggccatcgaatacgacggaagacatcacgccggccaatggctcgccgacagcaagagacgtgaagccttagaagatgacggttgggcatacattcaagtgaccgccgaaaaccttatgaacgacttcgagaaaacgggcactcgcgcaacgagtggccgaccggatgagccaacgattaagcaagcccatcatgctctgtcaaagaatgccctcgggaaggatacacatccgcataacgtctctcgccaatggaagcagaaagattctcatctgaaagccactatatgtggcagatttgccatccccagacaaaccaaaaccgctatatgtggcagaccagaccggtttcaagcctcaaaagaccccaatcagtaccccctagacgagattttccttgggagactgccacatataacggaaatcatttttctgaaatgccaaaaactgccacatataggacatttcaaactgaaaacacggcataggcatatcacctttttcgtcagatcgaagacagcattccgaaaacgtcgtcatcatcgacgacgaggctatcgattttgcggcggccgagttcgcgcagccattcgtcgggttccgtatcggcgagcgcacggatgtcgagatgcaacggcttgtgccttccgaccaccacctcgttagcatccacagcttggaccggcccgtcgaaatgggcaaaggcaccatccgaaacatccagccgatccgcccgacccggaaggcgtgcggcacttcccaccgatccttccgtaccgttcgaatcacccggggcacccgcacggccaccagtcggacatatgcccaacaccgccgcatacgtgtcatatagcccgcgtcgacgtacagcgtattcggcatcagattcctccgcatgttttctgccgtccacaatgtacggcattcctgtggtgatgtagcggaagaaatggcgattgatggcgtcgcattccgcccgcatcacgtcatataccacttccacaccgttttcctcaagaatgcgaagtcctttgccggccacgatgggattcggatcgatcgaaccgaccacgacgcgcgttatgccgtgcgaaagaattagatcggtgcatgccggctgcgatccgacatggcagcaaggttcgagagtgtcgatgaccgtggctccatgcatgtcgacaccatgctcgtcggcatagtcgaaggccatgcgttccgcatgcggtccgcggtagcggtcgtggtatccggctgcgagaatctcgccgtcgcggaccaccaccgtgccgaccaacggattcggattcacccaaccggctcccttatgggccagttccagcgcctgcgtcatgtatttccgatattgaggcatgtcatccacggttccaagcatattgcgtcgattgcggtcccacatttcaaaatcgccacgagacattccgtaaatggataggcgcgaaccggtcatccgtcccatcgccgtacggcgtcgcacaataacgccatacaatgttggcagaccagcaaaggaaccagcgagaggaaacatcacatgcagcgcgaaatcatgacgtccattccgtttttgagccagccgtcgacggaggcgctcaatatgcccgaggatcttgccgtcgcgcaggatctcaaagacacactcgacgcacaccgcaacggctgcgtcggcatggccgcaaacatgatcggcgtctcgaagagcatcattgcattcgtggacgaggatttcggcggtcgcatcttcgtaatgttcaacccgacgatcaccgcgcaggacggcgcctacgacgcctccgaaggctgcctgtctctcaaaggcgagcgccgcacggtccgcttccagcgcattgaggtctcgtatgcggatcgcaagttccgcgagcgccatgccacattcactggtttcaccgcgcagatcatccagcacgagatcgatcattgcgaaggcattatcatttaacgactttttcaggcatggcacctagcggcttttcgggcgctccatctagcgacaggcttaggaaaaatcgtttgatgtaacaatcgtacgtaaccgccttacgttacagtttccgtaatgcaccgtagggcagtgtcaaaggagatttcatgggtgccatcgatatgttcaacgatttcgtcaaactcattgaaagcgagtccctgcccgtcgaagccgttgcgattgcggatggcgacgccattatcgcggaacgtcatttcgttcccgaccaggatcgcaatatttattcccatacgaaaagttatgtttcgacggctattggcattgcgattgaagatggcttgctgtcgctcgattcgcgattggtcgactcgttccccgagtatgttccctccgatgcgcaactggagttgggccagatcacgctgaggcacttgctgactatgtcgagcggtttcaatcatgcgtatttgatgaaccctgaccggcgcagtggtgttggtgcgcctgattatttacggtacatgttctctcgcagggttgaggtggagcccggcagcacgttctgctattcgtctgcggattctgatttggcgggccgcatgttggagcaggctgccggcatgcgtcttggcgagtatttgtatggcacgattttttccaagttggatcagggttggcctgtttgggaatgtgatccgcaaggtcatccgattgcaggcggcgggatctacatgtcgcttgcaaatatgttgaaacttggccaggtctatttgaatgatggcacttggcatggcacgcgcattgtcagcgaatcgtgggtcaagcaggcttccggtaagcagatcgacactccgtatagcaatatttggacgtgcggttatggctatcagttctggatgtcaccttatgagggggcatatcgtgcggatggtgcgtacggtcagattactacggttttgccgaagcagggtttggttgttgcgattcaatgcccggaatctggtgatttcgacaatatcgttcgtcctgctttgcatgagcatctgctgcttccgcttactgcctgagcgcacgactttcgcccataccgtcgtgtagatggggtatgggataattatgcacggtattgtgcgtgggttgcgttccggaatccttgattgagtttccgttgaccgctcatgcaacacgctggaattccaacgtttcttaaggatggaacacaacattggctgaattcatttaccagatgatcaaggcccgcaaggcttacggcgaccgtgtgattctcgatgacgtgactttgagcttcctgccaggcgcgaagatcggcgttgttggcccgaacggcatgggtaagtccacgctgctgaagatcatggccggactcgacaccgtgtctaatggcgaggcttctttgactccgggttataccgtcggcattctgcagcaggaaccgccgctggatgacaccaagactgttggcgagaacatcaagatggcgttcggtgagatcgctgaaaaggtggctcgtttcaatcagattggcgaagagatggccaatccggatgccgatttcgatgctttgatggatgagatgggcaagctgcagaacgatatcgatgccgcaaacggttgggatcttgattctcagcttgagcaggctatggatgctctgcagtgcccggatccggatactccggtgacggtgtgctccggtggcgaacgccgtcgtgtggcattgtgcaagctgctgctggaagctcctgatctgctgctgcttgacgagcctaccaaccatcttgatgccgagtcaattctgtggttggagcagttcctgcaccagtacaagggtgccgtcatcgccgttacccacgatcgttacttcatggataacgtggctgagtggatctgcgaggtcgaccgtggtcagctgtacccgtataagggcaactacaccacgtacttggagacgaaggccaagcgtatggagatccagggcgccaaggacgccaagctcgccaagcgtttgaagagcgaacttgattgggtgcgttcttcgccgaaggcccgtcaggctaagaacaaggctcgtctggaacgttacgaccagatggagcaggaggctcgtaacaataagaagcttgacttctccgagattcagattccggctggtccgcgtctgggctctactgtgctggaagccgagcatattcacaaggcgttcggcgaccgcgtgctcatcgacgatttgagcttcacgctgccgcgtaacggcattgtcggcgtgatcggcccgaacggcgtgggtaagtccaccctgttcaagaccattgtcggccttgaaccgttgacgtctggctcgttgaagatcggtgagaccgtgcagatcagctatgtcgatcagaatcgtgctggtcttgacccgaataaaaacctgtgggaggccgtgtctgacggtcttgacttcatcgaggttgccggcgttgaagtgccgacccgcgcgtatgtggcgtccttcggtttcaagggttccgaccagcagaagctcaccggcgtgctgtccggcggtgaacgcaatcgtctgaatcttgctttgactctgaagcagggcggcaacctgctgctgctcgacgaaccgaccaacgatcttgatgtcgagacccttgaatcgcttgaaaacgcactgcttggcttcccgggctgcgctgtggtgatttctcacgaccgttggttcctcgaccgtgtggccacgcatattctcgcgtgggaaggcgatgatgagaatccggccaagtggtactggttcgaaggcaacttccaggcctatcaggagaaccgtgtggcccgtctcggcgaagacgcggctcgcccccaccgtctccatcgcaagctaacgcgctaagccgttaagcagacagtcctgtggactgtctgtaggcttggcctgagtgaggcgacagccgaacgaaggcaacaatgagccttgcgaagcaagaccataattgcagggccacaggctagccgttaagcagacagtcctatggactgtctgtaggcttagtctgagtgaggcgacaaccgaacgagggtaacaatgagccttgcgaagcaagaccgtaattgcagggccggttaaccccatatttcagtaaagcgccgtgcttcgttacgaagtgtggcgctttgccgtatgtgaatcgtttggcgattacctgccgttcacgcttctcacgcattcgttacaaaacaatccggcgaaatttaccgcccttgcgtagactcgtttccagaacgaagcgtttatcgtatgcgactcaaagaatcgaggcccgttatgacacagacagcgcagacagcaataactccgttacaacggttggcgaaggtgcttcaactgggcacgccgtccatgtaccgcaatcatatgtatgtgaatggtgaaagcctgtatttccccactggccgcgtgtatggcggtcaggtgattgcgcaggctatgatggccgcatccaaaacggtgtcgccgtctcgtctgccgaattcgattcatggctatttcatttctgccggtgatattcgtcaggatttgctgtttgatgtggagaatctgcgtgatggccgctcgttttcggctcgtcgcgtgaatgtcacgcaggctcagggttcgattctgacggccatcgccagcttccaggagcagggtcaggatggcattgagttcgccgatcccatgccggaaggcgtgccggagccggaaacgttgaccagtgcgaagcagctgatggagccgtttgccgagaagtcttcgtttgccaaatattatgcggaaaagtcgccgttcgacattcgtcatgtgacacgcacgattatgttgggtgccgataagaagagcgccaacaatgattctggtaaacagatggtgtggatgaaggctgatggcacggttgatgttccgcaggttatgcatcgtgcgatgttggcgatgggctgcgatcaggtgatgctggagccggtgttgcgtcgtgccgggttaagtattgccacgcctggcatttcgttcgcttcgatcgatcattcgatgtggtggtatcgcgatatcgacatcaatcagtggcatttgtatgtgcaggatacgcctaccgcggctcacggccgtggcttggggcaggcgaaggtatacacgcaggatggcgaacttgttgcctgcatgactcaggaggcgatgatccgtgttcccgaagaggatttgaagaagtaaggacaatcaggctttcgtttgggttgccgatttggttgccgcggccgcgtaacggtttcgttgcgtggccgttttcattttcggactttccgggccgtcgattggtgggatttggcacagccactcccccgcaatgccaatgatcatatcgattatgcatacgattgccgcgatcgcgcattcgaggatggcttggctgtagaacgttgcttcgccatgcggcaggctcatgatgagctgcccaccataccagccggccaacgccgctcctgccacgcccaacgctttgcatgacaccagcgtggcgaacgctttctgcgggtccaaaggtttcagctgcgcgcgtttttcggaatctgtggtggtgtatttgtggatctgcaatgccatataaagcacgacgaatcccagaatcgccaacaccacgggcacaatccatggagcgccgaccaatgggaaacctgaaatctcgccatattttgccaatcctattccggcaagcaatcctaatgcggcagcgagaacgtagcaccaccaaggggttctgcgcgctttcatagcgtacctccgataatccaattgtcggtcagcagtcccacctgcgcggcatcgggggccatggctagtaggaatgataccggatccttacccagtcgtgcatcgggatccatgtcgagccatggcgcaagcactgcggcatgattgcgtgcggtgggccacggcaccttgcagtcaggctcatcgcattccacgccttccatgtcgatcaggtcgagatcaaggtcttcgccgacggaggcttccacattgcctaatgcttcgattagatcctgagcgcccatgcgcgtggaaatctggattaccgcggccattttgtcggggagtccgtcgagttggctcacatggtagaggggtgagatgccctcgacttggttgccgggaatgccgtccaacgtgacgatggccatgcggaactgctgttcggcatcggttgctgggctgtcgagtgagatcaccgcgcgtttcgatgcgggttctggctgtgcagaagcgagtgccgccgctttggctgcggcggttccttccggcaaatcgctggaatcgatcgcaccatacgcttcgtccatatcatccgcatcgcccgcattattggcatcgcaggcaaggtcgtcgataccgcagccggtcggttttcccaccatccaatcatcagcgatttcgtcgatatggtcgcggtcggatgcctcgtgcaatagctgggccacggaaccggcatgttcgcccggcagttcagcgtccggctcgagcgccagccacggacccagcacgaacgcacgctgccatgcgcgggggtgaggcagcgtcagatccggatcatcgctgctctgcccgtcaaaatcgatgatatccagatcgagtgtgcgcgaagtccaatggtcggtacgcactcgaccatgttcggcttcgatacgctgcagtcctcgcagcagttccattgccgacagtttggtggtcacggaaacaaccgcattgtaaaagtcgggggtaccatcgggcatgccccacgcatcggttcggtacagcggcgaaacgcccgtaacctgagtggatgccagtccgtcgatcgaacgcaccgcgtcacgcaaggtggccgccacatcgccttggttaccacccatggcaatgatggcatgatgcacttgcgatgcagccgaagttgtttcacgggaacgttccacggttacgctcacgtcgtcgaatggtacgacgattggcgcgctcggcttgtgcacggtcacctgcgtttgcgccacggctggatattcaagaatcatgctggcgatgcgatcagcgagtttttcgatgagatcgacatgttcgccttcgatgatggcgactattcctttggcgatggcaccgtaatcgacggtgtcccgcaggtcgtcggaatgcccggctggcgcaagatcaagaaacagcgtggcgtcgacgacgaacgtttgcgcacgctcatgttcgaaatcaagcactccgtgtttgccgaccgcgcgaacgccagtcaatcgaatctgatccatgccagcctttctttgcatatcccaaggttttagtgatgtgaggcgttgccgtgcctacgcagtcaagagcatacgaacgtatgcacccaccgcgcgtatcagacgttggcgaaggcacgccacgcgttgccgatcgccaccgcgtcacggcttttctccacgtcatgcacgcgcacggcccacgctccatgttcggcacatagggcgctgatggcggcggtcgcattgtctttgctatccatgtttggcttgtcaataccagcatcggcaagcgccgcgccgacgaatcgtttgcgcgaggctccgatcagcaccggatacccggtagcattgaacctctccaatgccgtcatcagcgggaagttatgctcgacgctcggtttggagaatccaagacccggatcgatgatgatttgtgacggtgagacgcctgcctgaagcacgtcgtcgacctgcttcatgagttcgtcatacacgtcatccaccacgccattggcgtacacggacgtatcagcgtcaggcacgtcgcctgcggagccggcaagccagccgcgccaatgctgcacaatgtaaaggctttccgaatgctcggccaccacatggggcacttcgcggtccagccgaccgccggacacgtcgttaatgatctgcgcaccgtgctccaacgccatgcgagccaccgatgcgcgtgtggtgtcgattgacagcaccgcaccttcctgaatcaacgcatccacggcacctagcacgcgggtttgctcgtcttcctcgctgacgcgtttggctcctccggggcgagtggattcggcgccgatgtcgatgatgtcagccccatctttcatcatcgcctcgccgtgcgctttcgcattcgcgggatcgagccataaccctccatcggagaacgaatcctccgtaatgttgagcacgcccatcaccagcgtacggtcactatcatgaatcgatttcatatcaatggtcatccggtttcccctcctatatccggttattgttattggcgattcgacttgctgcagtcgcgccgatcacgcatgctgcgacagaatcagactcatggcttcggctcgcgtcgtcgcgtctcgcatgcaaccgcgcaccgccgatgtgaccgtgcgcgattgcgccttcttcacgccacgcatggccatgcacatgtggtcgcattcggtgactacgatcacgccacgtgcttcgatgccttccatcagcgcgtcggccacctgttgggtgaggcgctcctgcacttgcggacggcgggcatacagttccaccagtcgtgcaagcttgcttaggcccgccacttggccgtttgacggaatatagccgacatgggctacgccatggaacggcagcaggtggtgttcgcataccgagaagagttcaatatcgcgtaccagcaccatttcgtcagtatcgactttgaacttggttttgagcacttcctcggggccgtggccaaggcctgcgaacagctccttgcaggcacgcccgatacggtctggggtgtcgagcaggccttcacgatccgggtcttcgccaatggatttcagaaacaggcgtactgcctggcgcacgccttcctcgtcatagccgacaggcccggccgcatgggcggcacgggccttgtcgtcgaagagggtatcgaattcttcggtatcgctcatcagttggtcaatcctgcgcttttcttcagggattcgggaatcggaaccggcggaatgtcggaatccgggcgcttgctgtcactcagccacacttcacgcttcggtgccttcttgacattagcgaagatttccgcaagttccttttcgttgagtgtttccttgacgagtagctgacgtacaagctcgtcaagaatctcacgattttcgttgatgacgttccacgcttcggtatgcgcggtttccaccagtttgagcacttcctcgtcgatgatttcggcggtgcgtgcggaatacttgtggttcagcgatccaaggtcgctctgctcgtcatcagaccacttgatggcacccagcttgtcggagaaaccgtagtcgagcaccatctgacgtgcgatgttcgtcgccttttcgatgtcgttggaagcaccggtggtcggatcgtggaacacgacttcctccgcggtacgaccgcccatagcgtacgccatctggtcgagcagctggttgcgcgacatggaataacgatcttcggtaggcattaccgcggtgtagccaagcgcacggccacgcggcagaatggtgaccttggtgaccggatcggtatcgttcatggcggctgccaccagcgcgtgaccaccctcgtggtatgcggtgttgcgcagttcgtcgagcgccatgcccttggaacggcgcttcgggcccgcctgcacgcggtcgatggcctcatcgatggcacgattgtcgatcagctgcgcaccggcgcgggcgcacaacaatgcggcttcgttcaacacattggccagatcggcgccggtgaagcccggcgtacgcacggcaatcatatgcagatcgacgtcaggcacgaacggcttgcccttggcatgcaccttcaaaatagcctcgcggccttccaaatcaggcgcttcgacggccacctgacggtcgaaacggcccggacgaagcagtgccggatcaagcacgtcggggcggttggtcgcggcgatgatgatcagattggtatcgttattgaaaccgtccatctcaactagcagctggttcagcgtctgctcacgttcgtcgtggccaccgctcataccggaaccgccacgcttacgaccgacggcatcgatctcatcgatgaagatgatggccggagcgttcttcttggcctcatcgaacaggtcgcgcacacgggatgcgccaaggcccacgaacatttccacgaagtcggagcctgccatggaatagaagggcacgccggcctcgcctgcgatggctcgtgccagcagcgtcttaccggtacctggagggccatacaacagcacgccacgcggaatacgggcacccaaagccttgtaacgagatggatccttcaggaagtccttgatttcttcgacttcctgcacggcagcctcttcgccggccacgtcggcgaacttggtggtcggggtctggccttcgagcagcttgccgctgttcttcttgccgcccataccgaacatgccgccggcaccgcccatacggctcatcatgaaccagaacagaccaaagataatgaggaacggcagcagcgaggtcagcagatacgtccaaatgctgctctgctgcatggtcgccgtccagcccttgaccggatcagccttctgcacggccttgaccacggttgcggactgcgcgtacgtgtagtagaactgcacgttttttccgtagttcttcatacgcccggtatccgggtcggtagcggagtagtcgctcttaagcttgagcttgacctgctgggtgttgtctacgatctgcgcgtattcaacattgttgccgttgaggatctgcagaccatccttggtgtcgatggtctgggaaccggttccggcgaaaatctggaacatggtcacggcaagcaatgccacaaccacaacccacagccatggggactgccagaacggacgcggaccgccattggatccgttgccgttggacttgtcacccttgccgttggaatcattgccattgccggcgttattgttgcgtccaaatggattggtgaacgggttattgccgccgccgttgttattcggcgactggcccggaccaggaaaactcatgcccgacctccttcatacacttccggcttcagtaccgcgatcgaatcgaggttgcggtatcgctcgtcataatccaaaccgaaaccgaccacaaattcatcgggaatctcacgtcccttatatttcacaggaacatccaccttacggcgcgccggcttttccaacagcgcaaaaatctccacggaagcggcaccgcggctcttgagctcatcgacgagccacgccaacgtgacgcccgaatcgatgatgtcttccacaataagcacgtgacgaccgcgaacatcggtggacagatcctgccgcacggtgatcttgccgctcgattgagtgccggaaccgtagctcgacaagctcatgaaatccatctccgcgtggatgctcatggcctgcgagaacgccgcaagcgtgttcactgcacccttgagcacgcaaaccagcagcgggttcttgccacggtagtcctcactggcctgggccgcagcatggttgatggtgtcggcaatctcttctttactgatcagctcgtgatcaatatcttcttgtacgtcagcgattcgcatgcccaccatcttggcacacgcgaatgacgtgtttctggcgatatgctgaatatccgctgggaagattcacacctttctggccgtgccagtcgcagatcagcctgtcgatcccctcaacctgccgtgccatgcacgaaatgcctgcttctgcaagcgagagcacaatcacccgtcttctgatggcaatgtcttgcgattgcaacgcacgcacgtcgatgattatctcgccgttgttcacggttacgccttgctcgcacacacgttgcgccacactgtcaagatatgcgcgatcgtcttcggcaagcctcgctccaagcgcaagtttcgacacgacgtcacttcccgcaaatgattcaagatatggcatgagatcgtgccgtattcgggatcgcagtggatagttcgcgggaagggactcgtttccatccgaattccccacatctggcccatttgtgggatcgtcccaccaggcaagccgcagatcctcgcagatgccggtggtttcttcacgggtcacattcagccacgggcgtagaaaacgcaccccgtctcgtatgaaggaaccgttcataccgcaaaccgcatcgaggcccgcagaacgcaacaaaccgatgattacggtttccgcctgatcgtttttcgtatgagccagcagcacggccgaagcgtcggagcatgcgtcgacaatcgcatggtagcgtgcttcacgtgccgctgcctcaacaccgatgccgcgggagtcgggtacgtcaatcgcacgaacacgaactgggtcaagacccaacgcaacgcaacgatcggcggttgcccgcgcaacaccggcagagccttgctgcaactggtggtcgatgataatcgccccgcatcgcaatcccaatgaagcgcacgttttcgcagcaaccgcagccaacgccatcgaatcgcgcccaccggaacaggacaccataatcagcggagcgtccacatcgggcgcgtgctcgccatgacgggcgaaacgggcatcctgcaatcccaaaccggccgattccaacgcggcgcgcagttcgccgattcccttgcgcaaacgtgacgaatacaccatggcgtcacaacttcggtagtgctgccacaaatgtgtcgatagctgatttcgcggcttcggaatcatcaggatcgttgacgatcacggcaaaactcaacgcaccgccattatggcgcgacacattgccggtcatggaagtcacatctcccaaactgccggttttggcacggataagaccagcttcgtcagcatcgttcaaacgattcgcagcagtgcccacaaatcctacaatcgacagcccctcagtggcggcggaaccggacccgctcgtcagattacgctgctgcacgtcaagcagggtatgcgcggtgagtttggaatcctcagccagtcccgagcagttaaccatggtgaggccttcggtggaaatcccccgctgagccagtacctgttcaaccgactgcaccgctccggccggtgaattgccggcgttaaggtgcaaagccagcagtctgccgaattcctcggccagcgaattgtcggaatgccgaagcatgaacgccatgatctcgttcagcgatgcggagctcaccgtcgcaatggggctggtcccgtcgggaacggctccctgtttcacggaaccgttcaccgcaatgccccgctcagtcaggcgttgcgcgaacaccagcgcggcctcgcgagccggctgcgtgctcaaaacgggatatgtgctgaacgtatcgggatccgtaggattagcaccgttccagttgcgcccgccatccacggccatggatgcggtcggcgcgtagtacacgtggtccggatcgagttcggcgatgccgttgggccaacggtcgttgccgaacagggaatcatcgtagacgagcgtcacggaagtgatgccccgctgccgcaacgcttgggccgtgtttgccgcaagcgttcccagcccggcacgcccattgatgtgcgccgaatcagattcgccgacgccgagcagcatgtcgccgttgcctttgagcaccaatcgcgaagtgccatcttcgcgctgctccaaataagtctgcgtctccaacgtcgaccccatgtcgagcgtggccgcagccgcatacgccgtcagcgttttcatggtggacgccggcgtatacggcgtgtcgagattctgctcggccaccacattgccagccgcgtcggcgatggcgatggcgtattcaccgccaaaatcggaggcagccgtctcaaactggctgatcagagcctttgccgcaacggcatccacggttttcgaagcgtcaagccctccgaccatcgtcgcggccgcaatggcattgcccggcgttttggctgtggcatgctcgacttcctgcaatgtgagaacacccggcaacttgtcgaaaatgtcggccacgacatagccgacgcacaacactgtggtgagcgacacggaaagcgccaccgtgatgtatcgacggcgtttcacatgccggtattcagccgaatcatccatggaacaacaacactccagtcataagaggaaatcgaaatgaaaacgaaaaggcaggaacgcgcaagccagcgaacgaacgtcatcccttatgctcgatcggcttccattcggacttggcgaacatcgcctggaacgagatcggcacataactgaacatgtagatcgggaagctcagcacatacgcgaacagctccttgttggtggcgccaatctgatcgcgttccacaataatcgtcaacgcggccaacgccatcatgccgatcaccgacgtcacaatgccggacgtccaaccggtcaacgagctcaactggctctgccatgtcacgaatccgcaggtcgcgaacaacagtcccagcagaacgcgcgcaataccgatcaccgtgaacggacacaacagcagcgtgaaatcaacggcggaaaaatcgcgttccctgatggcgcgtttgaccaaagccggcccgtaataacggaacacttgcaggaagcccttgctccaacgcaaacgctgacgccagctctgcgcgaaggtgacaggctgctcgtcatacagaatcgcggtaccgcagtagccgatgcggtcgccgtgcagcaaggaatccatggtgaattccaaatcctcggtcaaaaggtggaatttccaaccattattgcgacgcatgatctcctgcgagaacatgaagccagtaccccctacatgacagctgttgccgagccacatgcgtgaggccgacaggaatcgagattcacggatgaaccacaatgcagaaccggaagagacccaattgtcagacaaattcacggaattgcggtagctggtgagaatcttgaatcccgactggaacgccttgttcatctcttcgacgtaatgcttgtcgagcttgttgtcggcgtcgaacacgaagaacgcatcgtacgggtcggatgcaccggaatcgttcatctgatcgagcagatacgtcagcgcgtagcctttgcccacaagctccttgttgaagcgttcgatcacatggcagcccatattgcgcgccacttcggcggtattgtcggtgcaattgtcggcgacaagccaaatgtcgaccagttcggtcgggtaggtctgcgtttggatgcaggtaatgaggttgccgatgacgttcgcctcgtttcgtgcggaaatcagcaccgcgtaacgcttgtccatcggcgcgtcgggaaatttgatcggcttggtgaacagggagatgagaatgcacaccgcctgatagaccacccctgcgccaccgacgatgaccagcagaatgtcaagtacgctcagcagtaccattaacgccacctacttcttggattgtcatccgcgtttttcgtacttccttcagcttcccgcgactcgccgttcttccgttcattgccggattccggattttcgttggattcctgagatgtgttttcactctcaagaccctgcaatggcttgcgttccgttttgtccaacacgtgcttcggaatggcgacggtttcgtccgattccagcgattcctcggaacgggtgatattgtacgcctgctcctgcaactgccgcacttcgtcgggaataggcacatgcgcactggatccctgcaccgcgcgaggcatattgtgcagatgctcgctgagcacttcggcaccttccaccagcttcgacttcttttcaggcaccggatcgtccatcagcggggaatcgaccagctcgtaccgctttgtataggtgcggaagatcgtctgcacggacgcgaccaccggcaatgcgaggaacgcgcccaacgcgccgaacagcgaggtgaacgccagcaccgcgaggaacgccacggcatcgttcacatccatggtgcgctgggagatcttcggcgcgaaaatcagattctcgatctgctgatacacgcagataaacaccagcaccgccacggcctgccacaatccgcagctaccccatgcgaacagcactggcaacgcgccgccgatatacgtacccaacataggaatgaactgcgaaaccacaccgcagaacagcgccaacggtagccaatagggcacgtgcagcagcatcagacagattcctgtgaagaacgcgttcagcaacgcaagaatggcgcgggagaacaggaacgacgagatctggctctggctcaccgtccatacgaacaggaatcgccgctgagccgccggagccatccactggcatgcggcacgacgcagtttcggaccagccgctgaaatgtaatacgtggtcatgattatcgtcatgaggttaatcaggaacgaaaacaatcccgacaccgtattcagcgcggtacccgcgaaatcagtgacccacgacgtttgaatgttcttcagaatctcattgccgagattattgatctcaggaagctggaaattcgcgtattgactggcgaactggcacatctgctcatacaggtcgggcagaccgttcaccaaggcgatcatctgctgcacgaacaggttgccgaacagtgtgaacagcacgccgagcatcacggccagcatcagcagtgagaacaacgacgcgaacgaacgtttccagccatgcttgaccagcggcaccaccaccggttccaccgcgagcgcgatgaacagcgagacgatgatgtcgatcaccaggtattcgattttgccccagctgcgccagcagaaagtaaaccccacaatggctatggcgatgtatagcagcgcacgccccagccattccggtggttttcggggatctcctttggctggaaacagggtgccgaggtcccatcgctgttcgctggtgttcgcaccgttttcgctctgcgtattgttcattcgctgttcgctgtcgctcatggctccctattgtagcgataggcgtcgtgtacaggctgagctattgtggtagttatgctgaacgtttcaattgtcatccccgcttggaatgaagaggagcgtatcaacgattgcctgttgaatgccactaggcagaccgtgatgccccatgaagtgatcgttgtcgacaatcgttccaccgattcgacggtggccatggtggagcagttcatcaaagaccacccggaggcacccatccgtctgctgcatcaggatgaggagcaggggctgattccgacgcgcgattatggtttgaaccacgccaccggcgacattctgggccgtttcgacgccgattgcatgattcgcccggattgggtcgaagtggtgtccggcattttcactgaggacccggaggccatgggtgccactggtccggtgatgtattacgatctgccgagccgccattttggtttgcgtggggataattccacacgcaagcgtatttacaaggccgatggcggccagccgttgctgtttggctcgaatatggcggtccgcgcttcagcttggcgcgaaatttctgacgaagtgtgccgagacaaggccgatgtgatgcatgaggatatcgatatttcgctgcatctgctgggcaaggatctgaaaaccgtgtactgcccgcgtatgatcgccggcatcagcgcccgccgtatggacacgtcgctcacgtcgttcaacaattacatgcgtcgtttcaagaacacgttcgacgcgcatccacagcattcgcgcaagcataagccggagattctgctcaccgcgctatatccggtgatgcatctgctgtatccggtatggcagaaggtgcttgacaccgccgatatcaatcctgcggaggcggcgtggatcaacgagcagatggaattggccgagcaggaaggccgcgaatggtacgatgacactcccaccgatgaggagtggagcgaaaagcacgagtaattccaatacttgcgattgataatcacggattattgtttacattatttcgattaatccgtaatttatgtgcagatataaaaatcgtggtgcgaatgctttgtgaagtttcgcaccacgatttttaatgctttcagcgatgttctctcacaatcgggtttcactgcagattcgctgcatgcgattgccgattcgtgagagttttcgcattacatcaggctcttgtagatggcgaggatgtcttcttcggtggtctgacgcgggttgcccggggtgcacacgtcgttgaaggcgtcgtgggccagtgcttccagatcggcttcggttgcgccgacttcggagatggtggtcgggttcttcaggtcgacggtgagcttgtgcacagcctggacggcttcttcgcgaaccgtctcgagatcgccggtgtaggcatcttcgacaccgaaggcgtcggcgatgtcacgatacttctcgccggtgaagtccttgttgtattccatgaccggtgccagcagaatgccgttggcaacgccgtgggcaacgccgaggcggccgcccagcgggtgggccatgccatgcaccagaccgaggccgacgttggagtaggccatgccggtgatgtaggaggcgtaggccatctgctcgcctgcaggaacgtcgccgtcagcgctcttggcaaggttcttggcaatcatgcggatggtctgcatgctcaggcagtcggacaggctccaggcgcccggagtgatgtagccttcaatggcgtgggtcagggcgtcaagaccggtggcgaccttgaggccgcgcggcatggagtcggtcagatcaggatcgacgaaggcgacgatcggaatgtcgtgcgggtcgacggccacgaacttacgcttgttggcggtatcggtgaccacatagttgatggtggtttccgaagcggtgcctgcggtggtcggcacgccgaagatcggcacggacgggttcttggtgtcggcaacgccttccagggagagcacatcggcaaactccgggttggcggtgatgatgccgatgcccttgcaggtgtcttgcggggagccgccgcccagaccgatcaggaaatcagcaccggatgcggcgaacttggcaacgccatcctgaatgcattcgaccggcgggttcggcttgacattgtcgaagacctcgtacggcatgcctgcctcatcaagcacatcggtgaccttcttgacggtgccggtttccagcagtaccggatcggtgacgatgaacgccttggtgaagccatgggacttggcaacgcccgggatctccttgatggcgccgcgaccgaagtatgcagtctggttgaaaatcatgcgatagaccatagatgtctcctttaagcgactgtgcttgttcgccgtgtcatagcaaccgttgccatgaccaacgattctcatcatagaccccatgttgcgattcggctggaaatcgacacaaccttttctgtgagcgttctcacaaaatatgcgaacgcatcacacaaaaacgcataaaaccagacaatacggccttatgactcgaataattccagctcgacctgcggcagatcatccttggagaacacccacatggtctcgtctttggaacgtcgatcggcgaaaatcgtaagcaggaacttctctccgtcgtttcgcgtgtacccgtactgcaacacgccgaccgactcgacgcgggcatgaatgaagtcgtaatccataagcagggagaaactgtctttgcagaacggcgccaccaatcgttcgcaatagtcatgcagcgcgcttttgaacgaaccgtcatgcgcgtcaagcatcttctggaaatagtcgggcaccatgatcgcacgctgtgagtcagtacgcagattcaccatgcatgcgattgaatagcgtccgttcaaatgccgcagcaacgattccatatcctgattacgcaccagaatgtcctcaagttttttgttgagtccgcgcagctggcgtttgccgccgcctcgcacgtagtattccttcttttcgcggcgcatctcgttttcggcctgttcgatgattttcggcagatcggaagtcgactcgctcgacgctacgcccactgatatctcgcagccttgcgtatgcaagcgctcacgcatgtagttcagctgcttgcgtgtctgcgcttccgtatgcgcggaactgattatcacgaattcgtcgccgccgatgcgatacaaccggtcatcgccgaagaacgcgcgcgccgcgtccgcgaactcacacaacatgcggttgccctgcttatgcccgagatggttgttcacctcgtgcaggccgatcatatccgcatacacgcacaccaccgccccgatgtcggcgctccgcagctgctccacatcgctgtcgtatgcattgcggttgagcaatcccgtcaaggagtcctgccgatagatttccttcatgttcttgacgattaggtcgagcgacaggtcgaatccgatcagcaccacggcccacggattggcctcactgcaatcagggggtaccagcataccgaatgcgatcacgctggttttcgcctcgacctcgcttctaaaatatgtgaattccgattttttcttactgaatagttggtcgcgcaaatcagacaatcgcgtgtgtttcaggaattctccggcatcatctggatgaatgatccgttttgaaaccaatgcatggcagtaatcatgaaaatcatccgcatacacgtccggaagtttcggatcgcgtttgatggtgcgatattctcccgtgatgagattcagtcgggacagttccgcaacgcccttgttaaggatttcaaaaatatgcgccgacaatgacgacgattcgagcatgctgcggccgttcgtcgacatgcggtagtcgcgatgcatcagatctttggagatattccagaaatgctggtcatccgggcggtgttccagcaaatcctccatctttcccacagtgagcggacggtagaaataatatccttggatgtacatgcatcccagctcacgcagcttgctcacctgttcggcggtctgcgcaccctccgcaatgatcgacagtctcagctggtaggccatgtcgatcacggattcgatgattttcaaacctttcgccgcattgtcagcattcaggtcaacgaatttcatgtcgagtttgatggcatcgacgttgatgtccttcaacatgttgagtgacgaatacgccgacccaaaatcgtccatcagcacggcaatgcctcgcgcatgcaggtcccgaatggtctcttcgaccacatccatgttatgtgcgatcgcactttctgtgatctccacctgcagcaggcgagcatcgatgcagaaccgatcgagcaggtcgccaagcactcgcgccacatcgatcgcctcgatatccgtcatcgacacgttgacggacaccggcaccagattgcgcccctccccatcccaacgcgacagcatttcacacacggaacgccagatgaacaaatcgaaccgcgtgaccattgactcacgttcaagcagaggaatgaattcgccgggagacaccaagccatattccggatgattccaacgcaccaacgcctccgcacccacgattgcgccggtttcagcattgcatttgggttgcaggtagaagcagaattcgttgttgtcaaacgcctggttgatgtcgtcaagagagaatctgggtacgatttcgtcgttgctgggcgccctgcccgtggattccagccgcgcgcctgcggcaacatcgaattgattacccatgatactcaccgttgtactgtatcagcgtcacgtcttcgacaccctcaatggcgcgaacgcgttccgcgaacgtcatgtccttatcatcacagaatacttcaaccgccatttccgtgcgttcgccacgcatggttttggatttgacgaagaatttggtgcgtccgaacgcgcgcgtgatctcatctcccactacatcgcccacatagtggatcaccgcaatgtacacgcgccccttgtcttgacgcgagtagaacagcgccaacatgccgatcatcaccaatccggcaacaatcaccagcacatacatgccggcgcccgccgcaataccagacgtgatcgcccagaacaaatacaacagatccatcggatccttgaccgcggtacggtagcgcacaatcgataatgcaccgaccataccaagcgaaatcacaatattcgtactgatggccagcgtgaccatgcaggtgagcacgcacatgcccaccaacgtaacggcaaaactgcgcgaatacaccacacccgtgtagaaacggcggtacacgcagtaaatgacgatgccgacgatcaacgccaccagcaacgccagcgccattttgggcacattgtattggccgaaggatttcagcaccgactttttgatcatgtcattgacactcatatggtttctttctctcctgcttccttgattcgtaacgtttgtttttgctggaatgccagtcaacatgccagctggttacagacttggctttacaggctcggcacgctccaaccttcctgccagtagccgaatccccgcaaatacgaggctttgtcataacagagcacgtatttcgaagccgatgtcaactcctgcgccttgccgggcagcagatcacgcaccacttgcggcaggaattcggtgaatttgacctccatcaccagttttcccggctcaagcacgggcagtaccggcagtgtggagtcgaaaacatcgaatcctccaaccgccgcacgcacgttcatatcgaaggtgacgcgcacggtaccggcgtcaagaatccacggttcgcgctcataatcgacgatcacgcgagggcgcatcacattgcacatgcattccacataaaactcacggcacaactgatactcgctgtcacgcagaaattcataatcgccggcaagaatacggtcgaactgctcgtgcgtgagcggtgcatcctccttgtagatccaactgtcgcttttgcgtttgcgttccagtttgatcacacgatcgctgtaatcgtagatgcgaatacggtatttcctacgcagcagcacaccgtcgactttttcctgatatgcggtgttccaataatcgtcgaaatacaggctgcgaatcatatagccgccgtttttcgcatgcttgtcgaggccaagcagcggcgccatacgcacgttcaagtcggctttttgcgcgtatgagatcagatatttgagctcatgacggaaccgttccttggctgtgcgcggtggaacggataattcctcgccgacgcgatgtttgatacgttgcagcagcgacgttccgcgattgccaccatcactgcacattggcatcctccacaatgctgccgtcggctttcacatagaaacacttggtgccgtagaccttgttgccgtcggtgacgtagtagtcaaacgcgtcctgcgtctcgcctgatgcattgcgcacgctcaccttgatgaagtactggccttcaccaggcatatccatcacggcttccggcaatacgaggtcgctctgtgtgaacaccacgtctttgccttcgtaatccttggccacggtaacgctatagcgcagatcctcatcgttgaaatcataggagacatcccagctgagtttgagcttgccgttggtaggagtcggcttgccgatatagaacggcatgggcttattgaacccggttcggtacgtctggtagttctgttcgatttcgctatgcaattggtttgccaccgtgtcgtattggcttgacgtcagaggctcatgcatgcagtcgggcatcttccgcacgtatggttcaacgatggaacggtaccgccgcaccatggaattgatgcgatcggcgctcatatacttgtattcgtctttcacggccttgccgagcgcggttcggaacgacttggtttgcagacaacgtcggaacagtatgttgccccaatagttgctgacaccgttctcccagctttggccctcggaacgttgcctgatctcgtattccttgcgcatgagcataccatcgttatcccagtcgagcaggtaaaacgtatccgaattcgtgggactatacaggtacatattgcggctttgcgtatcgatattgccggtcagcaattggaatgccatccaatatgcgagattttcggtatcgaaatatttgccgaggatttcgcccatcggcactgaataatcattgagatcgttcagcatggcgatcagtttggtatggtcgttgtcgcctttgatttccagtttttcttcgaatttcgcttgatcgtagtcaggatcatcggcgagtttgatcacgtcttcgtctcgatagaattcgaaataattgactttgtacagctgtccgtttttatcgagtccgtgcacctgcaatgcggttttgttgagctgttcgacttgcgtgtacagaccgtaatcgtcgaaggaatccgatccgctggtctcgtctttcacgtacaggtgcacgaattgcgtgcgcagtcccatcatctggtcgatgcctttgatgagatcgtacgccattttgttacggaaacgcagaccttcgcccatatgcttgttcaatgcgatggtacgctgcccacgccacttgcctttgccgcttttcaactcgatcttgtagttcttctgctcgtttttactcgatgactggccacgtatctgcacggtggcgttcggcgcgctttcaccaaaaccaagctccccggaaaccggtccttgttcgtcgccgacctgcagcaaaccattgaccttgtagcggtcaacgcccatggccgcatagtcatcaacagaatactggttgatttcactccagctatggtcggtgccttccgacgaattaccgcgcgataccgtcaaatacatggtttcgacaccgctgtcgtcatacaccttgtataacgattcgttgtcgcgcaagtgtgcgccgtcgatgctttgttcagcgcttttcttgacttgctcatgcgtctgtgacgaatccgatgattgcgattgttcattatcgttgggtgatgaagtcgcacatccggcgcaggaaagcaccgtcagcattgccgtcaatgccgttatttgcttgacaagcgtggtaatggcttttgtgttgcgtcggttccaccatgtcatgatttacgattcctcccgattatgacatccgtttctgcaatattcgccttgtcagaagaccgtgcatgccctgagcgatgcaatgattggtcgacccgctgttcgccatgttcaagcagtatgcccagttcggtgaaacgtccacgtttcgtttgcgccacaatcggctgctgccccagcactcggtatggcagattgtcggtgtatgaggcgagccggaatgtcgcatatatggcgaacagcgatgcccccatcagaaaaccgaaaccgaacagcgacgtagtgaagaactgtccgattactgtgaacacaaccgtcgaacccgcaaacaatgccgacgccgtcaatgcaccggaataatcggtaaaatacagcagaatcagcatcacggtgttgccgaccgcataaagggcataccccacgcagagcacacggaaatatccgtgcatcacatcgctgaatcctaaaggaagcgcgttcagcaccgttttttccaatgaaatcacggcagcggtcaccaacaattgcttcaacgccgtgtaatgcaattctcgattgagcacagccaacatttcgttttcggcaacggtaatgtctttgaccgtgcctccatcattcaacagactgtaatacgaccgatatgttgggtagaaattgacctccaccgacaccacaaaattcaccgtggtgatcagaatcgtcaaaaacgccagcatggcgggcacatcgtaatatggcgcgccataaaacaggcccttcaccttgatgccgagcggcccacaccaagtgatcaccaaatgagcgaacaggccgatggtggtcagcaatccggtcaacgccaacggcagaaactgatcgacccactgcaaaaacagccacggatgcttacgactttgcggaaaataacgatgcaacaagagcacatcccacaccagcatcacaccatagccaagcaccaccgcaaacaacagcgactccacaggagggcaggccaacgcaagcaacacgcatgacgtaacgaacgccaccaacaccgcagccacgaaagaatacagaatgcttttgtaatccttgatggccgtcaaatagctcatcgcattccagttgacgatcatttcaagaaacagccacaaacacaacgcgccctgcatcaacgtggcaccggaaaacagcaggaaaaccgtgtacaacaccgcgcccaccaccagcatgatgccagtagacccccagaacgacggcagaatcatcttctcatcgtgatcaaacaacatatccgccagaaaacgggtgaccggcatcgacagaaaactcgtcaacaccaacgaggcaagcagcgtgtaggtgatcatgcatacgagcagatcgcggtcggggcggcccacctgccaccagctgctcacgatcagcacgccgaactgcaggagtacacccaacagcatcggaccagcgcaaatcacgccggcatagccgtaggctcgcagcatcgccatcaagcctctacggtggaacagtttcttcagttcaaatccaataccggccatatcagcgctccaatccgaactgattcaatccgaactgatccgcggtatcgctatacagcttgcgataatcgtcaagcatgcgctcatgccggtaataggcgttcacacggttacggccaatctgccccatggtctcacgcagcgtgcgactggaacacatgcgttccatggctcggctcaggccctcgcggtacatcgggggcacgtagaagcctgccgtgccgaaatcgtcgccttcctcgccttccaaaagctcacggcagcagccgacgtcagtggtcacgcaggggcgtgcggctgcgaacgattccagcaccgacagcggctgaccttcggaaatgctggtcaacacggtgaaatcaagcttgcgcatgtattcgaccacgttcacacggccggtgaactcaagattgcgcacacccaactgttccacaagctcatagcattcgtcggcatactcctgatcgtcaacaccgccgagaatatgcaagcgcacattgtcaacgcgagaggaaagctcatggaacgcgtgaatcagggttttcacatctttgatgggcgccatgcgcaccaccgcgccgatatcaacccaaccgtcgtcgggcttcaggggaatatcgcagaaacgttcgtattgaatgccattgggaatcacttggcaggcatcggcgggcgcacccatgccaatttggataagacgggcacgaccgaacaagctggtgatgcgccacgcacgatggtagatctgttccgaaagcatgtagaagaagcggatccaacgcggccggaacgctggcgacacccattcggcggaaatgatttcctcttcgcgttcacgcgtataaatgccatgttccgtaagcaataccggcgcatggttgatgccccccccccaaacaagccaacaatccgccatatccagtggaaatcgcatggtagatctgcgcttccggcacttcgcagcccatcaagtacaacaccggcagcaacatggagcgcacggtatggaaagcgtcggcgtaggccacatacggatattcttccatgcagatttgcgtaaacaagtcgatgaattcacggctttgcaggaacgacagcggatgcacgcctctggtgtggaacaggttgaacagcacatcccagtccgggctgccaagattcaccagttcgcgcaatgaccgcaattcctcttcggtgaacgacacttgcgctcgttcaccgctcagacgcaaggcgtcgtcgaggaacacctcatgcacttccaccacattgtcgggcaggtcatatacgaatttgccgcggtcttcggctttggcgccgatcacccacaatacgaactcgtgctctttcatcgcttcgatataactgtgcatccacgtggacacgccaccatgcacgtacgggtagcatccttccaaaaccaggcagattctcatgcctctcccccagtcttgcgttcgatatgaaccgtggcgttcgtggctttgagcagatacaagttgccggtcagcttggtgaggcttccgccacgaaccctgccaggcgtgccattgttggcacggaacatgagccacccttgatcggtgaggttgccaagtttcagatcccaaccatcgtcggacgtttccatcgaaacagtcaatcccgaaaaacgttggatggctgcggcacattccgtgcctgtccgcatacgaatggacggtgccgacgattccagccagtcaagatagttttccaatccctggtagtacttcttccatccttctttcgctccacgatcttcatcaagcaaatcgtcgggatgcatgaagtgcgtgctcacatagtgcatgttcagttcggaaaccgcggcaagacgcatgtacatgtcacccaccatgccgccggacacgatacgtggagcctccaccacgccatcggccgcaacaccgaactcctgcacgtacgtcaaggaactgtcggaaggcatgtacgtactggcgatggcgcgaatctgcgacacatcctcgcctatgatctttcgtccttcttgggagaggatattcgacggcggcacgtataccgacgatgttgcggcaggcaatacgtctttctggaatgcgatcagttcgttcaacgaatcgacgatggctttgcgattcggccactgcacatacgcgtattccttaccgtaatccgtattcggcaacaccaacggctgatggttgtacccgtgatatccgatttcgccgttttgccgaagcagcaatcctccgtaatactcgaattgtgcgccgtccgtctgccgtaccggatcatccttggtgtcatcgccgtaattctcaatcatcacaccggtgaaacgaataccgtaccgttccgcaagacgcaccaaatccggccaccatacttgagaatagaattcagcaatactcatgttgtagtcacgtttgatgtatttgccattgccggacggtaccggagagggaaaatcatccaagtagaacgccgcgctgttgatcaccggataggccgtggcagaaccgagcaggctgaacgccgaagcgtaaaatcctcgaagcaccttgccgtaaataccgatattgcacaccaccgccgaacctgaattcacgaacgtgctccaaatcaacggtgtgcgcccattactgctgacggccttgacctgtgcgcgatcatgcaatgcgacactcagcgacgattcaaacggatcgctgaacgtgtatgtctggccgccgcccaacatgaaatccttggagggtgtaatgcccttagtcagcacatattcgtatgcggacgattcaatgccgatctgcgggccgatcacatccaaatagccggttttttcgggagtcatggcaaacatgactcctccgccttttttggcccattgcatgatttgcagcacatgctcgcccagacggtcgagattaggcatggccaccactatggtgctgtagtgagtcaacgctggaaattcagcgttttcgtcagccacgtcaaccgtagtggtggggactttcatatcaagcagaatctggtcgagcatggcttcggcatcgctgacgccctcttgcgaactgtcgaccaccaacagattcgtagctttttcgccagcgatggcattggctgcaggaatggctttgtttcgatccaaatacgtgatgtcgaaccgcgtgacaccgtaatgcacgcccaagctttccaccagcaacaccaatgcgatggccatgaacacggcccacactttgaccaaaccttgccagcggaatcgtttccacttggccaacacgtctgacaggaatcctctgatcatgcgcgttcagcctccttggttccggtccagaaccgcagcacacgtcttccttggccaccgagataaatatgcttgctttcgatctgctgaacagtgtggcgcaacgcatcgccatcattgcgtgcggcatcgagtcgtagacgcatcagccatacatcgccttgatccggccactgttccatagcgccgtcaatggtgtgcgcggcatcatcaaagagtccaagatcgatttgcatttgcgcaagacggcacgcaacgtaataatcgccatgttggcgaagtcgttcctgcaatacttcggcatatcgctgcttctgcaactgcaatgcgtatccttgcgcaataccggaattgatatatcgttccagcgcatcgcaatagcgttccaacatcgtttcggaatttcgatgctgcagataatcgttgcggcagcgctgcaatgcaagatcttccttggcactgatctgtgccaaggcggtagccgcgtaatgcacgacctccacatcctcattcagtcgggcctgcgacagcacatcgatataatggctgggattgtcgttgagaatggacatcaccagactgcgacgctgactcgaatcgttgacgatcaacgcctcttccagcggcacagtattggcgaaatcggctcgttcctcaacgagaatgcttcgacgttcctcatcgtccacgcgcatctgttcgagatctggagccgtatgctcgcccgcacgaatcagcgtacgcacatgcagcaagagcacgcataacggcccccacagcggcaccaacagcataaaaggaagcagacgcccttccacacgaagcacgccaaaacgagacaatacgcacatcagcacgcataccagcacatgtatgacgataagcagcatcgtcactaccgttgtgttcatgccgtgccgccttcgtgcgattcggcggccacttgttccgaagcctcatccagcagcgcgtcttcctcttgcccggaaacgcgtgtcacatgcaatccagcttgggccaaacgcttgttgatgataggcagctcatgcttgccggcctggttcatcaacacatacacgttgccgtcttgcagtacacccgcctcgtccgtctgacgaatggcccccatgagacggctgccattgtcttgccaagcatcatccacacgcagcagcaggtgatcgcccatatggtcgtgcttgagttcgttggcggcaagcactttgggtagaaacgcccgagtgttcaggaattcggtgcccggcaccagcatcgcctgacgcgccacattctcatagtcgaacgcacgcaccatcgcggattccaccaagccgcacatgatggtgaacaggttctggaagtacagattcatttggtcgggctgcgctttggcaagcacaatcaccacggccagcttgccatcggcatgcacgcctgccgcatacatcggaaggtccggttcgagattgcggttcacccacaatccaccatgatccaaagctgtaataatgttggcataattctcaagcagcgtcgacttgctgaacagggattcggtttgcggactcgcagccatcaaacgcgcgaatcgaccgccgctgtcaatgcggtaaacaccgaaactatcgccgcccaatgtgtcttgcataatgcgaatggtcgtgtgatacagcttttgcggctgcacttcgtccaattcacgtgtcatcgcatacattttgccgaaactgtcacgcctgccgataatctgcccgcgcagcatacgacgatcatcgagcacatcgtggtacaggtcacgcaggaacgcaagtcgttcacgcagcaaactgttttcgtcacgcatgaatcgcaggttttcgcgattacgcagctgcacatacccgcatactgcgccggcaacgaaatacaccacaaacgcaagccagttcgacgtgtcgtaaaacagcggagcgaatgaagcgcccttcgatgcatacgacaacgccatgccgacacatgcgagcacggccgcgaacacgcctgcgttcagtccgtgcatcgtgccgacgatcaccacgaaaaacaggcgcaaatccacggttcccaactggctgttgccttgtaccgcggtgcgaagcagttcttccaatatgaacgcgatgaagatttcgattgcgatccatggttttgaatggttgcgtagaaaatcccagaccgggtgcttcttggattgttcctgagcacgcgcttctttccagcgctgaagcacagggggaagatcctgtttgagcgaatatcgcggcgaccagccatagcgcaatcgcagcacatgatcgtctgctgggtaatgttgtggtctgtcttcgccaaaagtcaccgataatccgggaaatgccgcgctgatcgcatcagccaaatcaccgtatgtgaagtcgaacacgttgggcacatggaagatttcgctttcggcggtccaatcgtcgaacatgcggtagatcagttcggcaagatcgtcggcgcagagaaagcatgtctgttgctgtttgcgttcgcggaatgagatcgaccctgccgatgcctgttcgaacagtctgccgaaatatgcggttgctccattgcgctcgggtgcatacaagtatggacagcgaatgattttcgcttccagacggtaggtgcgcgcgtaatacaggcagagttcttccgacgctcgagacatcagacttttgctggtatcacgtacgtcggcgttttccggataggtgaattcggattccggtccgcataccatcagcatttgcgtggatctgttacgtatggcgtgcagcaatctgcgaagatatccgagatcgccgtcacgctcacttcgcggggtgaggccttcggaaaagaatacgatgcgatcgaattcgtatgtggtaagagtttcggcaagggtgttggcgtcagacatgttgacgattctgagacggtcattgccgtctacggtgccttctcgttccgctatcaccacatggtctcggggaaaggaatgctgaatccactgcttggtaatgaagtcggtgttgccgaccagaagcacttccatgccgccaccccagcgaatactcccttaacggggttacggcataactctgcccacaaacccccattgttactgccttacggtgttccagtgtagccaaacagcagacagactccccctctaacggaggttttcttagtcatttctcagtaactcgcaagtcaacatgacttgcgtcgaccattttagggggcttacccgcaatgcgagcgcgtattcaaccaacagccggcatcagtggcttggcgctagacatacggccgcaatcgtcatacgtgtgggcaaaaacaaagaaacctcggatgtttccgaggtttcaaagccatggtggctccgagcggcatcgatccgctgacctaacgattttcagtcgttcgctctaccaactgagctacagagccatgaacaggaatctgttcgagcgaccccggccggacttgaaccggtgacctccgccgtgacagggcggcgctctaaccaactgagctacggggccattgccaccttgttaccaaggtaagtaccccctgagagagtcgaactctcgttgtcagattgaaagtctggtgtcctaaccgttagacgaagggggcgctttcagcgtttccgcgtgacaactcgcttaactatacgcgaatcctcagaacatgcaaatctcggcgtgtcgcagcgtcgcaaaatcgccatcaacccgttgccaaagtgctgaaaatcgttgaaatcaagccatttcagcacttcaacaacagaccaaccggcactatacgcaacgataggtgaggtcatgaatcacacgaccggcagcaagtccttttttctcaaaattcgtgagaattcgtccggaaaaacgctcggattcggtgaaatcggcgtgtcgcagaccggccgcttcgtcggcatttcccttgccaacatgctcgaccggcaaactcaccgtaagcatgccgtcattatggaatccttcaagaccatccatcacctcatgcacatgcaatgcatagtcttcgatgtcggtggcgatacgccacactcccccatcccgcaacgtgcgatgaatctcgccggcaagctccggctgcacgatacgacgcttgtggtggcgcatcttgggccacggatcagggaagaaggtccatacttcagcgatcgatccatccgccgcggctttgaagagctcaggagcgttgacctgcgcgatgcgcagattggtcaggccctgcttgcctgcgagcagcatggtatgcgccacgcccggatcatagacctcaagcgccaggaagttcatatcggggtgttcagcagcggccgcaacaacgttttccccctggccggtaccgatttccacaatcagaggattgacattgccccacacatccgcgatatacgcccgatcgaacaccagatcgcctcgcacatcaagcgacccctcgcccgcgttgattttcagcagatacgtatctgcataggcatcccatgcacgctgcaagcgtgcgtcgagcctggcggaacgacgcacgaaggacaacaccttgcgcccatacaaggcaggacgctggccagcatcagcccgttgttcatcttgcgtttttgacatgttttgtccgttttcgccgttaacttgattttcagtcggcgtgttcacatcttcttgcataccctaatttatagaggaaacgcaggaaagggtcgattatgtgcgttactgttcatgtgttatactcaaattgttcaaaaagtaacaaactagagcaaaagtgaacaacgttcgttgaacgttcgtttttcgaacaaagcgctttatcgctcatttggaggaaaggccagaacatgacagttctcgtcactggtgggtgcggctacatcggcgcccacgtcgtccacgctcttcaccaggccggcgaacaggtcgtcgtcgttgacgatctgagctacggcaagccaacccgcatcgaaggctcccgcctgtacggcatggatatcgccgcaccgggtgccggcgaacgcctcgccgaaatcatgaaggccgaaggcgtcgactccgtcattcatttcgccgcccgcaagcaggtcggcgaatccgttgagaagccgctgtggtactaccagcagaacatcaacggcatgctcaacgtgctcatcggcatgcgcgactccggcgccaagaagctcgtcttctcctcttccgcagccacctacggcgttccgccggtcgacgtggtgccggaagacgtcgttccgatgctgccgatcaacccgtacggccagaccaagctgttcggcgagtggatggcacgcgcctgcgaagagccatacggcattcgcttctgcggtctgcgctacttcaacgtggccggctgcggtccggtcgagctcgaggatccggcaatcctgaacctcatcccgatgctgttcgaccgcctgaagaagggcaaggctccggcgatcttcggcgacgactacccgactccggatggcacctgcgtgcgcgactacatccacgtctccgatctggccgacgcccacatcgccgccctgaagtatctggaccgcgatgaacgcaagtacgacgccttcaacgtcggcaccggcgaaggcacctccgtgcgtcagatcgtcgatgaggtcaagaaggtcaccggcctgccgttcgaagagaccgtcatggcccgtcgcgcaggcgatccgccgcacctgatcggctccccgaagcgcatcaacgaagagatgggctggcacgcacagtacaacgtcgaagacatcgtgaagtccgcttgggatgcatggcaggccaatccggaacaccacatcgacgtcgagacctggaaacagaccgactgattccaccagcaattcgtagtgtcgtgagcgacaacacggcaccgcaacggtaacggccggtcacatatgagaagttttcccctcatatgcgaccggccgttgcttttcttccctactactgccgcagtttaagcaaatactttctttcagcaattcatacgaatattcatcgatgacacgccgaaatttgcacgatagcgactttgccgtaatatatctatctgttgccagtcgcaaggctgaaacaacggccccgtagctcagttggttagagcgccgccctgtcacggcggaggtcaccggttcaagtccggccggggtcgctttttttatttttcatttctatttttctctgatttacatcaattgcgcaatattacttttgcaatctcttgcgatttcttaagatctttcgaaatcattgaaatcatacggatacaagaaagcccggctcttgcgaaccgggcttttcgacggaaaaatcgtatgcaatcgtcaaagctgccgctcaacccaatcaacgatgaacggggccacttcctcaatctggtcaatcgccacttcgaattcgcgggcgccgccataccaaggatcgaccaaatcaatctcactttcgtagcctgcgacaggcttggcaagattcggatcgaaactacggtacatatgcacgttctcacgcttggcctgcggcagctgacgcagtagcgcacgcatatgcgaagcggtcatcggcagaaacaggtcggtacgctcgatctcatcgcgggtgatgcgatgggcgaaatgatgtgccggcagctcatatccacgctcacggagcaccttgacggcacgacgatcgatcggattgccatactcttcgtcgctcacgccactggactcgacgttgaccttgtcggcaaggccacgacgctcgaattcagtgcgcagaatgatttcggccatgggagaacggcagatattgccggtacacacggtcatcacggtatacatacggttactcctcgcgattcttcgcatacgtcatgaaacggaatccggcgatatctccggaacccttccgcgtgttctgccacacgccctcttcaagcaccttccaagcgccggattccaccagcgacttcacgtcgggcgcgtaggtatcggcatcggcatgcatgctgatctgcgtcacatacgccttgtccgcaaatggcatggcctcgcggaacagctggccgccaccgataatccagatttcgctgcggtcaagaccgtcatccggaatggcttcctgtcgtgccagatcaagcgcatcatccagactgtcgaccacggtcgctcccggcgcagtgtaagccggatcacgcgaaaccacgatattgtcgcgattcggcagcggacgatacttcgggctcagggactcccacgtcttacgccccataatgaccggatgcgagacggtaagctccttgaaacgcctcatatcctcgggcagatgccatggcatgccacccccgaatccgatggcgccgtcatgaccttccttgtcacaggcctgcgcccaaatcagattcaccgagaacgtcttggggaaatcatcgccccaatcctcctcgtcctcaagcccggcaagtccgggctcgggttcgtgatagccactgcggctactgtcatgctccatttcactcactccttgcagtcgaactagggtcagtagtctaacgtctggcgacgactctcagaccgccaccggcgccttgatggttggatggtgctggtagccgacgatttcaaaatcactgtaatcgtaatcgaacagcgaatcggctttgttaatacggatctgcggatacgggtatggatcgcggctcaactgctccaacacctggtcgatgtgattgtcgtacacgtggcagtcgccacccgtccacacgaactcccccggctgcagtcccgcctgctgagcgatcatcaacgtcaacagcgaataggatgcgatattgaacggtacgccgaggaacatgtcgcaggaacgctgatatagctggcacgaaagtttgccatccgccacgtagaactggaagagcgcgtggcatggcggcaacgccatattctccacttcggcaggattccaagcggacacgaccatacgacgagaatccgggtgattctcgacaagatcaagcacattgctgatctgatcgatggtacggttcggatcatcgggcgtgggcgccggccagctacgccactgcgcgccgtatacgggacccaaatcgccgttctcatcggcccattcgtcccaaatatgcacattgcgctcctgcagccaacgcacgttcgtggaacctttcaggaaccatagcagctcataggcaagtcccttgaaaaacaccgtcttcgtcgtgagcagcggaaaatactcgctcaggtcgaatcgcatctgctggccgaacaggctgacggtaccagtgcccgtacgatcggacttcaacgtgccttccgtcaggatcttgcgcacaaggtcttcatatggcatgggaatgtcggtttccgggcgtgccggaatacgggtacggatatctgcaagttgttcaggtgtcaaagccatggttgcaagcttaacagtacagaacggcaggtcaagcatatgccacccgcgcgttgattgtttacgcttttcggaatgcctcctagcgaacaggcatcaatggattacattaggtatgtaggcgaggagcgaacggcgctcccggcaagacgatgaggagttcaccatgggcaaaagactgtgggtcgagcgtaacaaagacggttcttgggatgctttcggcgaggatggcgcgcatatcaagttcggcaagggtcgtggacagttcacgccgggcgacctgatgaagatcgcgctggccggttgcgccgcactgtcaagccagttcgccatcgagcatacgctgggcgagggcaagggcgcgaaaatcgttgtggacggcacctatgacgccgacaatgacgcatacatcggtttcgacgaacaggtggtcatcgacgccaccgacgccggtctgagcgatgaggatgcggcaaagcttaaggaacgcgtcactcgtcatatcgacaagggctgcacggtgaagcatacgtacgtggagaagactccggtccgcatggacgtcaccatcaagcactgacgttttctttttttaaaaaaaaaggcgattgcaacgcttttcgcagtgttgcaatcgcctttttatatgtacctgttgaatttactgacgatcgggatcgatcttggtttcgatggcttcgaccacatccggctcggccttggaaaccggcacctcctcgacacccttgatatcgtcaagagccttcggcttgacttccgccggcgagctcggaaccgtgtcaagacgggtttccgcagcctcgacatacttgcggggcaccacatacaccgggccgaccgcgtgctgcagcaagccctggctggtggagccgagcagcaggccagtgaagccgccgcgaccacgggaaccgaccacgacgacgtcgtgatcatagctggccttggtcagcgcgccaaccgccgggccaggcacgatctgcttgttgatcttcaaatccggatgggcttcctcaagcggcttgatacgcacttccagatcatccttgaacgaggccatcacaccttcgtcgtcggaacccttcatgttcggcaccgcggaaataacatccagctcggcatcccatgcagcggcgaaattcgccgcgatctccagcgccttcaaaccccacttggattcgtcggagccgacggccaccttggtgatggtgttgttcaagtgcatcagattgccgtcatcgtcagtgtacggcaccactacgatcgggcagtatgcatacgccggcagactggagctggtcgtgcccagcagacgttccgccagaccgcctttgccgcgattgccgatgacgatgagattgtagttacgagacagttccacgaatacggaagccggatcgcccgtaacaataagcgtggtagcctcaacaccctgctcgtcggcgatggccttggccttcgaaagaatctcctgcgcgtcgctatgggccgcattgtcatcccccatggcggtgtatgtcgcgtcgaaggaaacagcggcatagctcggcaacgagtatgcgcatacgatctgcagcgtcagtcccgcatgcttcgcatagttcgcagcccaccaagtggccttatagctggcgtgggatccatcaacaccaacgaggattgccttgtcgttaatcatggacgacctccttgaatcacctcggcaacgcgaccatgcgtcgcctctaggctccaccataccgcgcgacatgcggttttgtcagtaacgactcggtcttttccatacaaaaaggcgtatccccgaaaggatacgccttaaaaaatcaaaccgtatgttcactcagagcacacgacgaatcgcatagccacctgagaacacggccagcgaagtgacctgcgttccctgagccggattcagcgcgttgatcaccatgccgttgccaatatagatcgcggcatgctgagtattgacgatgatatccccaggagctgcttcggcaatgcttccaactgccgttccaacgctcatctgggcaccagaataatgcggcaggcttaccccgaactgggcgaacacccactgtacgaaaccagagcaatcccagccggacggagtattgcctccggccacgtaaggatagccttggaactgcagagcgtagtcggccagagcctgcccagtggcactcgcgggagccgtaggaacgctgatggaagcacgatcggaagaacgactggcagcctgagattcagcctgtgcctgagcttgggccgcctgtgcttgagcttcggcctcagcctgctcctgagccttctggtccttttccgcctgagactcggtctggggaacatccaagctttcgatgccaccccaatcggcgttagattcaacatccgtggatgtgtgctcggcgagaaaatcacgcttagccgcggtggtcttcgggaaagaacgtgtagcggttaccgtggtatcagccatagcaccgcctgcgcttgcggcgggaaccgccgcacccaacaaggcagatacagcaacaacggcgaagatactcgtgaaacgtttagcaatattcatcgtgtctgaagctaccatacacgttcccccgcagcagaacagcaagataaccagaacagtgtcatatcacgcgacacgccgacgcaatcacgctacgccaaaaaagtgacggcaagcgcagattaacgaaaacagagaaatcagtaatggatatatgtcaactgcgaagcttcctgcgcagtgaacgtacgatcggaaatcacgccaagacccttgacgttggattccgaaatcttaatcgaaccgtcggcattcactccttcgacaatcgcgacatgcccgtaatagctgtccgcgcccatttggcctggagcgaataccacaatatcgccaacgtgacgtgccgtattgtcaacccaatagccgagagcgcgagcggaatcaccccaactccgcgcatcaccaaaatggcttccggcaggcaggccaagctgtgcacgacgggtatacgcccaccatgtgcactgaccgtatggatagtcattgccggtatcaccggtgccgtggttcggattgaagcccgaaggaagaagaccggcgtcctgatccatgagaacggcgacattgggattgtcggcaatggactttgacagaagattcgtgtccatggaggaactggtttcgccaagctgccaatcaccgctattgctggtggaggccagagcgtctagatcgctacgggactcggaacgggatgccgcatcgtcggagacacgcttcatctgcgtggtagtggcggcattgtcggcaaaagtcatttcagacgcattctgctggccgaccgccatggcagtggccgcggtgccgaccagcgcggccagcgatgcggaagccatgaatgcggagcgacgaccggccgcacgagcggcttcacgcatggcgcggcggctcatcggagccacttcattcagcttttcggcaaccgcaggctcaagacctacaacggcacccccaccatttgccagctggaccatacgaacggccttggcggtgtgggaaccgcggctcgaggtgaacagcgccttggcaacgctgaaacgctcattcgaaaccttggcagctttatgcgccgcatgcctcatatatcaacactccttgcggattacttcaaccacagcaggcttatgaccgcgtggttacagaaccgtcacggaagctcaggctacaccgacaccgggatatcgcagtcatcatcgccacgtcatggttccgaaaagcggtcatcaccacgcacaatccgaccatctgactaccctaggttgtcatgacgaacactgtgaccattccttccaacgtgcttccggaagacggacgtttcggctcagggccgaccaaaatccgcccggagcaaatccaagcgctcgataagggagcccgtaatcttctgggaacctcccatcgacagacccccatcaagcaggtggtcggctcaatccgcgaaggactgtccgaattcttccagattcccgatggctacgaagtggtgctgggcaacggcggagccagcgcgttctgggatatcgcctgcgcctcgctgatcacccgcaaggccgcattcggcacgtacggctcattcagctcgaagttcgccaagtcagcgcaatccgcaccgttccttgaggagccggagattttcgcaggagagccgggaacatatcgcctgcctgagctcacggaatacgtggacacttattgctgggcccacaatgagacttccaccggcgttgccgcaccgatcaaacgcatcgcaggcaccaaggagcagggtgcgctcacgttgatcgacgccaccagtggcgccggcgcgctgccggtcgacaccagccagaccgacgcctactatttctcgccgcaaaaagctttcggatccgatggcggactatggattgccgtactctcccccgctgcaatcgaacgcgcctacggcatcgccaaaagcgtggatcttccgggcgcacgccgctggattcctccgttcctttccctgacttcggccatcgagaattcccgcaaggatcagacgctcaacacgccggcagtggcaacgctgatcatgctggaaaaccaggttcgttggctcaacgacaacggtgggctcgcctgggcttcggcccgctgcgcaaggtctgcgtccctgctgtaccagtgggcggagaagtccgattacgcctccccgttcgtaaacgacaggaacgcgcgctccaacgccgtgatcaccatcgatatcaacgatggcatcaatgcatcccaagtggtggcggcattgcgcgaaaacggcattgtggacaccaacggataccgtaaactcggccgaaaccagcttcgcatcggcgtgttcccgtccgtggaacccagcgatgtggatgcgctcacccgctgtatcgactacgtggtggaacatctctgatgcaaggtaaggtgtggcgatatgaagattgctccgattattgatcccagcgtgaggaaaccttcgccgaaaccggtgcgcgtcgacctacgcaaggtattcatgtttggcaccgcgctatgggccatcgctttggtggtctgcatcgtacttatcgcattcggcatcgacgcggaacgcgcgcaaaccgtctgcgaagcgggtacggtcatcggcgtgctcatgctggtttgggagcatttcgaccgttgggattatcgccgtcttggcgagtaatcggcaatatacccccgaaaaatcctcaaaaaaatatgatgcccgtctcgccttatcgaaaacgagacgggcatcgcattatctccatttgagatatttgcaacatctgccgaatgtcttacatcattccccgcccaacggcagcaccaaggcgaacgtgcttccctgccccgggctgctccacaccgacgcggaaccatggtgggtcaacgcaacatgcttgacaatcgcaagtcccaaaccaatgccgtcaccggaatgctcattctgattgctgccgcgatagaaccgttcaaaaatacggttctgttcgccgatggcgatgccgttgcctcgatcgagaacactgattaccgcttccgtatgctcctcattggctttggcgacgacattcaccgtagaaccgtcttttgaatacgtaatcgcgttttcaatcaattttgcgagcgccgcctgaatctgatcggcttcgccattgatgcatagcgattcgtcaccgccggtcacgatggtgatgccgcgttgcgcagccatatcgagatgcgcctgcaccacggcttgtacctgttccatcacgttgatgcgattgtcggcggtcggcaggattggctcctgcgctttgatcagcagcagcagatcggaaatcatatgctcaagacgggaacaggattgacgcagctgcgtggcgttgcgttcgacgtcctgttggctggcaccgccccgttccacaatgtccgccagctgttccaatgattgcgtcggctcaagcaattgttcggaaacgttggtgatgaacgaatcgcgcacctgcgagaatcgtacgctttcgctcacatcgctgatgagcacaaccatgagattctcattgagtttgccgacgatgattttcagccagttgggtcgggaaacggttgcgccggaagtattggggtttgactgccctatcagtgcctggcgcgcgatttcacgtgtggttggtttgcctgccttcggcacttgctgggcgacatattgggtggtggtggtcaaatcaaattgtttgttgccgccacaggaacgcacctcatgcactgcgcgaagcacggtctcttccgcgatggcatcatcgcgcaccacgccaagcgcatacgccgacgggtgcgcgcgaatcacttcgtcatgctcgtcaactacgacggatgccaacggcagcatggaaagcaacgcgttggtggcatcatccaatgtgtcgtcatcggcatcatgctcatcatcgtcgttgcggtgcgtcagcgaacgccaccacgaacccaaagattcaaccatggtttcattgttgcacactcttgaggctccccaactcgcgacaccaccgctcgttcgtgaacacaaggtgaacgcgttggtgaactttgacggaacaacacgagcagtggttacgaatatggcgtttgtctaatagacttgtgagaggttatatcgaacccagatatatatgaagcattgaaaggcaagtcacatgcgcgttattttcaacgaggagctcaaggctgttgccgatgatctcgaccacatggtcaaaggcgtgcgcaaggcgatcaacggtgccggcgacgcgctgttgaaccagaatcttgaagccgcccaggccgttatcgacggcgacatcgaaatcgatgccctcgaagccagcgttgtcgaccagtgcgtgaagctgctggccaagcagaacccggttgccaccgatctgcgcgtggttgtttccaccatgcgtttggccaccaccttcgaacgtatgggcgatctggcccgtcacatcgccgaagccgcccgccgcacctacccggcttccccgctgccggccgaagcccaaccgctgttcgccgaaatgcaggcgttcctgaacgacgtcgccgaccagaccgtggccatgctgtctgaccgcgacaccaagaccgccgaacagatcatcatcaacgacgacaagctcgacgaactgcacaagaagacctttgaactggctcagtccgcggattgggctggcaccaaccagcagctcatcgacgtggtgctgatcggccgcttcatggagcgtcttggcgatcacgccgtgtccgcggctcgccgcgtggtgtacatcgtctccggtttcgacccgtccaaggagccgacccgcgacgaagacaccgacatcgcctgatttttttcttgcgatcttctttttcatcttctttttgagaaggcggcttccgttccccactgaagccgccttcttgttttgtttttgcaatctttcagcacgaatcgtcaagcactatctcccgcattatttcactttcgtcaagccgtaagaaaaattaaacaatctgtctattttttgcccatatacttttacgcaatgtcgcggcacaatatgtgcagtgacatccaaaggaggcagtcatgtattattccaacggcaattacgaagcattcgcccgaccgaagaaacccgaaggcatggacagcaagaacgcgtacatcatcggcaccggcttggccgcactcaccgcagcctgttacctggtgcgagacgcgcaaatgccgggcagccacattcacgtattcgaaaaggacgcggttccgggaggcgcctgcgatggcgcaaatattcccggcgttggctatgtgatgcgcggcggccgtgaaatggacaaccatttcgaagtgatgtgggacatgttccgttccattccatccatcgaaacggaaggcgtttccgtacttgacgagtattactggctgaacaaggaagatcccaacttctcgctctgccgctccacgaaagcgcgcggcgttgacgcaggcacgaacggcaaattcaatctgtcagacaaagcctcgatggagatcatgaaattgttcttcacgccgaatgaggaactgtacggcaagaaaatttctgattatttcgacgatgaggtcttcaattcgaatttctggatgtactggcgcactatgttcgcctttgaaaattggcatagtgcgttggaaatgaagctgtatattcgtcgatatattcatcatattggcggattgccggacttcagtgcgttgcgtttcacccgttacaaccagtatgagtcgatgattctgccgatgatcaagtatttggaaggattcggcgtgcagttccactacaacgcgaaagtggagaatgtcgatttcaagattggcggaggcatgggaccggtacgttcgcataccggcaccggtcaagacacgattttgaagaagcaggctgaatccggcgtgttcgtacgcaatccgtacagttcgccaaccaagaaaatggctacgcgcatcgacctgaccgaagcggatggcaccgcgcgaagcattgatttgggcgaaaacgacttggtgttcatcaccaatggtggctgcgtggaaaactcgaccatgggctcgcaaaccgaagcggccgcatgggctccggaaatcaagcccggcggcggctgggacatgtggcgtcgcattgccaagcaagacccgagtttcggtcacccggacgtgttctgcggcgatccggagcattcgaagtggatgagcgccaccgcgaccacgcttgacatggaaattccgccgtatattcagaagatctgcaagcgtgacccgttcaccggccatgtggtgaccggcggcatcgtaaccgttgaggattccaactggctgatgagctggacgttgaaccgtcaacagcagttccgcgaccagccgaaagaccagctgagcgtatgggtgtacggtctgttccccgacaagcccggcaactatgtgaagaagccgatgcgggagtgcactggcgaggagatctgcgaggaatggctctaccatatgggcgtgccgaccgacaagatcaaggaactcgccacgaaccatgcgaacaccgtgccggtgatgatgccatacatcgacgcgttcttcatgcctcgttccgccggcgaccgccctgatgtggtgcctgatggtgccgtgaatttcgcattcctcggccagttcgccgaaaccccgcgcgacacgatcttcaccactgaatattcgatgcgcaccggcatggaagcggtgtacaccttgtgcgatgtggaccgtggcgtgccggaagtgtggggttcggtctacgacgtacgcaacctgctcaacgccacggtgatgctgcgtgacggcaagccgattaccgacatgaaactcaaccccattgaaaagaccgtgttgaaacagattctgaagaagctcgattccaccgatattccgatgttacttaaggaatacggcgtgatctgagccgattgcgattgacgtccgtctgccgcacatctcatgttccgtattccatccggcagacggacgtaataacccaacaaagataccggacgcaaaaaggtggaaacccacatactgtggatttccaccttttcatatacgttccgtacgattgaacgcgattacctgcgtatcaatcgcaacaaactcacttctggccctgggcggcgacagcggcggcaccagcagcggcggcttccggatccagatactcgccacgcggcttgatcggcttgaagttctcgtccagctcgtacagcagcggcattgcggtcgggatgttgaccttggcgatctcctcttcggagaggttgtcgagcatcttcacgatggcgcgcagggagttgccgtgagcggcgatcagaacggtcttgccagccttcagctccggctcgatgtcggacttgaagtacggctcaacgcgcttgaccacatcggccaggcattcggcttccggaaccggatcgccggtgtagcgcggatcgttgttctgcgcatactcgtcgttcggatcgatctccggcggcggagtggcgtaggaacggcgccacagcatgaacttctcgtcaccgtactcctgacggatctcggtcttgttcttgccctgcagagcgccgtagtgacgctcgttcagacgccagctgcgcttgaccggaatccacagacgatctgcctcatccagagccacgttggcggtgttgatggcacgacgcagcatcgaggtgaagacaatatccggaaggacattcttctccttgagcagacgaccgccgttcttggcttcctcgacaccctgctcggtcagcgggacgtcgacccagccggtgaactgattggttttattccatgcgctctgtccatgacggagcagtactagtttgtaagtcatacctgccagtctaccgcctagcacgcccaacacaaccgtcgatgacgattatttggttacgttcatgcaacaattttcattctgttgcatgccgtttgcatcatcaggcaatcgccggtgctcaatgacgaaatcgtaaatgcagaatgcagctacgccatgaaaccggcctgacaggcattgagcacgaacgcgccggctgcgaccaacgaggtcatcgagcacaatggcaacgcccgacgccactggtcatgccggacggccgcgacggcacgagtagcaatcgccacacaccctgcgatggatgcgaacgccgcaaggctcatccaatcggcgtttccccacgaccagtcaccgcatatgccatattccgtgcatgaacggtcgcgatccacctccgcaggcagctttatgagcagatccagaagtttggcatacaccgataatggcatggcgaaaaccaccgtcagaccagcagcccatcccagcgcacgcatgcaccagcatttgcccttcccactgccgatgcgcaccatcagcgtgcgcttgccgtgcgcggcgtcatcttcgagatcacgcaggttattcaccatcatgacgctgacggacagcaggccgcagatcaccgaaccggccacccccgtcacggtgatcgacccgcttagcgcatactgcgtgccgagggctggaaccaacccgaagaatacgaatgccgcaagttcgcccagaccccgatatccgtaaggatgccgaccgttggtatatccccaggccgccaccagacaggttgcgccaagcgctatcagccaccagcgaccagttatgacgacagcgaccagtccggcggcacaggcggctaaagcagcgaccgcggcagccagcaacacgtgactgggatccactccggaagcgaccaaccgccgaggtcccgcggcgtcactgcctcgtcgggcgtccgtgccgcgtacaccatcggcataatcgttgagataattcacagcaatctgcagaccgaccgccaccacggcgcacaacatcgcaacgaccgcaaaccacggccgagaaaacgcacaataccccagcacatcaccagcatcatgctcttccagcaatcttcccggaaaagctgggcacgaccgcaggccacccaaagcctcccaccgccaactggcggcaacgccgaccagaaccggggcaagacccagcggcagcgtttgagggcgagcgccacgaatccaaatcgtcattcccatgaacgccattctagaatcacactcacgattcgccttccagccgcctacccgcattccagattcacaacctgaccatactcattgatatttcatctgtttccagaaatcgatacaataccggagaatgccccagaacgtcactcatgcgaaatatcatgaaacccgtgggatttcttttttgaaaacatggagagcttcaatcgcaccctgcgattcagcatcctcacgcccatgtattctgcggtaggcaagctgggtggtacgaaagggatacgggaaaaagggcattcgcgaacgaatgccccaaatctgcgaccaggtcacaacactacaggtcgcagattattcttgccgtgcactgacaagaagtccgatacggcgcaaagccttccggccttacagacctgcctgctctgccacaaaatcaccgagagccggcataaccatttcgcgatgcttcacattgccgaaaccatggtcgccatcctcgatgaccttgagctgcatattttcgccatacacatcctcgtaccgacgaatatagtcaacaggaatgaaatccttggtgccatggatggcaagcaccttaccgcgatatccgcaagccatgccgtaaggatcggtacgacccgcatcctccaccatggccggtcccatggcaacacccataaagtcaagatagccttgctcttcgatggcagacagaggcttaccctgaatatgcccaccggcaatctcatcaacatacgaagtggccgtagaacacagagcgatcgacttgggctgcccaggcaccttcggtgccaacagcgtgcaaatcaccgcgccaaggctcagtccagcgaaatgcagattatccggatcgcagccgctcatatgacgagcctgctccactacctgcaaggcgtcttcgacatcgccactaacggtggtatcgaagaaagtaccatcactttcgccatgaccagcacgatcgtaagtaacgaccacgagaccacgagaagcaagttctcgcgccatttgcacgacaaatccggaaaagtcgatgcgattgcccccgaagccatgaaaaagcaccgccaccggcgaatgtccgtcttccgaaaaaccttccggcagataacgggtacctcgtaacgtcaaagaagtaccgtcggcacgttccactgtgaaaacagcaggttccataacactcatgatgatttccttattggtttgtaaaacgaatgttccgggcttcgaacggaaaagggaattgggatcaaaccgtttcgaagcccgaagcgcgatacgcagggtgcgtttactcagcaacgacctgattacgggctgcgagttcctcacgaatagtgccgatctgatcatcgaccttgtacagcagcatcagcacagtgccgatagcgcagcaggcgatcggaatccacacgaagttgatgttgatggcgttcagagcttgcgccgtctgctcttgattaggcacaaaaccgttgatttccagcacaaaactggagagccagccggcgatgcccgcaccacaggtaacaccgatggccgcgcaggaagtaatcaagccctggctacgcacaccggtcttccattcgccatagtcaaccacatcggccaacatcacgaagcccatgctttgaccagtctggaacaatgccgaaaccgccatggatacgaagatcagcggaatggacatgatcttggcaccaacgtacagaccaagcagaccaataatgccgaatccgaagaacatgatggcgatattgcggttcttcatcttcttggcgaagaacggagcaagaatcataccggcaatcatgccagccgaattgatgccattagccaaagaggaaagagtttcgttgccgacgttgtacttgaagaagtacacgatggacgaggccttggttaccacaccaatgaacatgacaaggttgagggtgacaagaatccaccatggcccattgtgcagcatggccacgaaactcttgatgaacggcggctccttctccttaggggtaaacacacgttcacgcgtattggcaaaagtcagcagcaacagacccacgcagatcacgccatagatgatcatggtgacggtaaagcccaactgctgattgccaccaccgatcaggttgaccaacggcagagtaagcataccagaggcaatcacgccgatctgaccgccgacattacggaaagcatttgcattgacacgttcctgggcgttggtggtgaggttcggcagcagcgcggtgcacggcgtggtcaccgtgacggcgaggaaattcatcatgatgtacgttacgtacacataaatcatcttgattacgccgccgaagttcggcaccgaaaacgccatgacacctatgatggcaaatggcgcaccgaaccacaggaaccatggacgcaccttgccccacttagtatgcgttttatcaataagcgcacccaccaccggacctgcaaccgcgtcaagcacacgcaccaccaggaacagcgtaccgacagacagcaggctaatgccggccacgtcggtgtaatagaacatcatgtacgtggtgaccacgttgaacaccagattgtacgcgcaatccgacgttccatagctgagcttctccttaagggagagcttaacgtttgcgttgtccacaacaactcctttgtcgagaatcccgaacagcccgtgcaatacgagccatcatgccattcgcagcaacgcgatgacgatgcttcttatccctgacggccgattcgcacctgcgctcattgcgtatgctgcatttccaccgtctgatgtcaaagtagagaaaatgaaatgcaaattcttgagatgataaggaaatttctttcttgcaaatgtcaatatgcagcaaacaaacagcaattatcatgcactccaacgcaatgattacactacatagcaatcattagaagaaatttctctactatactgctatcatgacactgtcttcatcgcaaaccaatatgcgtaccgccagtcaacgaccgaaactgtcacacatcgccaaacttgcgaacaccacgccatccaccgtctccaaagtcatcaatggacgttccggagtctccgacgaaacacggcaacgcattgaagcgctgctcaaagacatggaatacagcaaaccgccagtcaaacacgcgctgtccacaaccatcatgttggtgctcgaatccatggaaaacccatgggtgctcgacatcatgcaaggagccaccgacgccgccgtcaaacgaagcatgaccgtgaccatctgcgcgaaaaacgcctccgacggcaatcccaacgacacctaccggcaagcaatccgccgagccagacccaaagcagtgattttcgacaacgcctacgtgccaatgcgagatcgaacactttgccaagaacttggagctcgatatgcggtaatcgacccatccggaacaccatgcaaagattgcatggacgtgcgcatcgacaattggacaggcggattcgaaatcggcagccatcttattaacttaggacaccgccaattcgcggcaattaccggcccaatgtccaccacctgctaccccgccagattggctggatttcgtgcggcattagcacagcatgacatcgttctcaacgacactcaagtgcgcgaaggcgactactggtcggaaaatgcacgcttgcacgcgcttgatctgctgcagcaaaagaatcgtccaactgcagtatttgcctgtagcgatacgcaggcattcggcatatatgacgcggcacatcagttgggactgtcgattcccgaagatctgtccgtcaccggattcgacgatatcaacagcgcacggcatctcggaccgccattgaccaccatgcggcagccactggcagaaatgacccgagcaacacttgccacattactatccaagcatcagtccgaagacgcgcagcgcacgctattgtttccaccaacgcttgtcgtgcgcggaagcacaggaccagcgccagaaattagggaataaaacagaattggagaataaaaaaacgcggggctgcctggctatacccaagcagcctcgcgtgaagccgatattgaattaaggctttgccttaattcagcggcaattttataaggatggctccggctggagaacagtccacaggactgttctcttttcagcctcgcgtgaagccgatattgaattaagactttgccttaattcagcggcaatttttatgaggacggctccggctggagaacagtccacaggactgttctcttttcagcctcgcgcgaagccaatatgaattaaggcttcgccttaattcagtggcttcactagtgggaaggtgatggtttcgcggatggtggcgccggtcagagcaatcagcagtcggtcgatacccatgcccatgccgcccgccggaggcatacccacgccgagggcctcaaggaagtcctcatcaatatcgcaggcttcttcgtcgcccgcgagcgcatccttggcctgagccacgaaacgttcacgctgcacaaccggatcgttcaattcggagtagccggtggccagctcgaagccgcgcacatacagatcccacttttcgaccacgccgggcttggaacggtggcccttgaccagcggggaggtttcgaccgggaagtcacgcacgaaggtcggctcgaacagcttgtcttcgtagaagtgctcccacaggtgttcgacgagcttgccgtggttctccacatcgtcgcgttccacaccgagcttgtcggcaatggcaccgagatgttccacggaagtacccggattgtccgggccgccattcggcacgatttcctcgccgagcgcttcggaaagggaatcatacatgctgatggtcttccattcgccgccgaaatcgtattcggaaccgtcgagcaacgtcaccttgtgggtgccgaacacgtccatggcggtgtcttgcacgagctgcttgacgagcgcgccgatggtgtcgtagttgccgtaagcctgataggcctcaaccatggtgaattccggagcatgggtggcgtcaacgccttcgttacggaagtcacggttgatctcgaacacgcggtctatgccgccgaccaagcagcgcttgaggaacagttccggcgcgatacgcaggtacaggtcaaggtcgaacgcgttcatgtgcgtggtgaacggacgggccgcagcaccgccgtgcacggtctgcaacatcggggtttcaacctcgaggaagtcatgatcggcgaaggtcttgcgcagggaagcaacagccttggaacggttacgcaccatgttgcggatcttctcgtcggcgatcatgccgatgtacggcttgcgggtacgagtgtcttcgttcaggtccttgtgcagggccggcagcggctgaagcgccttggcggcaatagcccattcggtggcgaacacggacagttcgccggtcttggaggcaatcacacgacccttgatgaacaggtgatcgcccaagtcaaccagctgcttgaaccgcttcaaggaatcggcgccaatctccttcttggaaatcatgccctggatcttggtgccatcgccagcggaaagctgcacgaagcacaagccaccggcgttacgcaggaagagtacgcgaccggcgatgccgaccacgtcttcggtttcgtctccggcttcaagcttgccgtcatacttggcgcggacctcttcgatggtggcggtgacgtcgagggtcaccgggtacggctgaatgccgtccttaagcatcatggcacgcttggccacgcgcatctgcacctgttccggatgcgccagcggtccgaattccttattgcctggatcaacggcctcatccagggtagcgccgtcattgatcttggcgtagatagccgcatcctgctgcagcagcatttcggcacgttccactgtggtcatagcgggaacggcagcctcttcgttctgattttcttgcgattcgatggtctcactcataagcccacagtgtaccgagaagccactacaccacacgcgacacgccgtatttgcattacctaagcaatcgtgtaatatttccaactgttgcaaaacgggctgtagcgcagcttggtagcgcgcttcgttcgggacgaagaggccgcgggttcaaatcccgccagcccgacaacttaaggcggaacttcggttccgccttttttatttccagcgcatcagcggtgcaaaacagcatatgcgagacgcaaccacctgaaaaatcaaaaaacacgtaatacacaagcgcgtaaacaagcgcacaccaacacgcttcacattcatggaggagagactgtgaaaagaagcattctggctttggcttccggcgcctttattcttggtgccgccgaattcgtgatgatgggcattttgcctcagacagccgccgccatgcaggtcagcattcctgcggcaggccattatatttccgcatatgcgatcggcgtgtgcgtgggcacgctgattctggtgttcggccgtaaggtaccgccgaagaatctcattattctgttcatgatcatcgcactggtcggcaacacgttgagcgcggtttcgttcaattcccccatgttgttggccgctcgtttcatttcgggcttgccgcatggcgcgtttttcggcacggccacgctgatcgccaagacgttggccgataagggcaaggaagcgcagtccgtgtcaatgatggtgacgggtcagacggttgccaatatgttgggtgtgcctgcgggcacattgctttcggaaatgctgtcgtggcgtttggcgtttgcgattcttgccgcttgggcgttgatgacgatgatgttggtgattgcgtgggtgccgttcgtcgcgccgattaaggacgctggcattaaggggcagttccgtttcctcactcacgccggtccgtggtttattctcatggcggtgttctgcggtaattccggtattttctgctggtggagctacgtttcaccgtggctgcagaaggtcggtggatgggattcttcgctggttcccctgttaatggtgcttgccggtttcggcatggtgatcggtggtattgcgggcggtcgtttgactgatttgtggaagcctggtgccaccgccgggctttcgcaggccattgccacgcttggcttgttgctggtgttctttgttcctggcaatcatgtgaccaccgctctgctgacattcctgattggtttcgcactgttcttcaactcgtctccacagcagctgctgatggtgcaggccggtgagggcggcggcgagctgattgcgggcgcggccgtgcagatcgcgttcaattttggcaatgcggttggttcgatcgttggtggtgccgcattgacggcaaacaccatgaactaccattacaccggtttggccggtgctccgatcgctttgatcgcggtgattatgctggtcacctattcgcgtcgttacgaaacgcatacgggcgctacggagcgtatgcgcgaagtgcatgtctgacattcgacagtcagttatttcgattatttctgttatgcaacgggatatctcatcacaattattgtgatgagatatcccgttgttctttgtacgacgtatcgcatgttccccatctttcgttgtttcgccgtctgcgatgccgtctgcagttcgggagatgatggaagtcaccgatgaagggattgcgatggcagacagtgatgtcaatctgaatatgaataattgcgatgacggatgcgcaacatttgatgtacaacgatttttgcgtggtcttgatgcgattttcgatgcgcataaggctcctgaacaggctgaaccgtatctgcagaaggcgcggaccgaagccgaacacagtcataatgacgccggtttgctgacggtgttgaacgaaacgatggggttttaccgttcgcaaggtcgccataccgacaatctgccgattatccgcgaatcgttaagcattgcggatcatttgcatcttcaggaaatcgacccgcaggcgtgggctacgacgctgatcaacgcggccacgggcatgcgagccgcaggccagtacgaggaggccgaacagctgtaccgtcaggcgcttgacgcggccacgtccgccttctcccccaccgaccgacgcctggccgcgctgcataacaatatgtccatgttgtacagcgaaaccggtcgtctcaatcaggcgaagcgcgagctggaacaggcgctggacctgttggagcaatcttcccccgatgcgagcgctgacatcgacgttgcctccacacacaccaatcttgcattgctgctcctgcagatggaccggtattgggcgagcgatgccatacagcatgcccagaaagcgttgacaatctaccgtaccgggcatttggaacatagtgcgcattatgcttcggcgctggccggctatgcgcaggcctgctatatggccggctgcctgcaggatgcggtttccggctatgagcatgcgttgagcgtgattgaggaatgctacggacgcaacaccgactactatcacacgactgcagtcaatcttgaagtggcaaaacaggcgttgcataagcacatgccatcatctcataaaacgcgggaatcgcaagaatatcaagaatcgcaagaatccttggaatctcagcattcaccgaaatcaatcgaatctcagcaatcaagtgaaccgcactatatgacggaatccggcgcatcttcgcttcctgcgatttctcaccatatttcgggacttgctttgtctcgcgcattctggaatgatctcggcaaaccgttgcttgccggcgcatattcggcatatcaggggcggattgccgcaggtttggtcggttatggttcggaatgtttcggtttcgacgatgagctgtcgcgcgatcatgatttcgcgccgcgtttctgcctgtggcttaccgatgaggattatgatgcgattggcgagcaattgcaggctgattacgatgcgttgagtcgcgatttcactgttgccgagcagggcaagccgcattttgcagggcatggttcggccaattccgacgctcttgccgcatctcaatcgccacttacgccgcgtgcgcaaggcgagttccgccgtgatggcgtgtttcgtatcggcgattttttcgagcggatcacgctgtttcgtgaggctccggcgcagaacgatgttgcatcttggctaagtttgcaggaagatacgttggccactgccacaaacggtcaggtgttcgctgatccgttgagggtgttttccaagactcggcaggggttcaagttcatgccggaagatgttcgactttccttgatttcccgccgtttgggcatgatggctcaggcggggcaatacaatctgccgcgcatgctgcaacgtggcgatggtgctgctgcgatgttgagcattcatgagttcgtgaacgccacggcttcgttgatgtttctggtcaatgagccggtgagcgttgggtacctgccgtattacaaatggcagtttgctgccatgcgcaagctgagccgccgtatggcaacaaggcttgccggcgtgtgcgaacagttggaagacatattgcgattgagttccgccgcatgtttcggtggtgtcggtttcggtgagggcggcaagggtgcgaagcctgcggcggagcgcattatcgccactgttgagcgcatctgcagtgatgttgtggatgaattgctgcgggagggattgaccgaatcccacgaaacgtttgtggaatggcagcggccgtatgttgagaaccatatcaagtccgacgcgagttgtctgcacagcctgtgacgtgcctgcagccaaaaaatccatcgcaagcattgcaaatcagagcaataatcagacgaaatcaagaatcgaaatcatatgaatagcagcgtaatttcagatgtaatagacggtcacgatacagcaaatcttgttgaatccattatcaaactggagtggaatcagtttcagcaaaccaataatgagggcggccgcgcgtcctgccaaggcaattggccgatgtttcatcagatgcgtgccagtcagttcatgacgtggccggaggaattgctgcgcagttaccggtcggacttgcaggaagccgaccgtgttggacgtaatttggtgacggaaaagtatggtcgcatgatgcaatccacatatccacaggagtattgtgcaaacattgcgccgtatattccccggatttccgcgaatcgcaacgtcttgcaggaaggcatcataacagttcaggtgtcgtgggcgcatgattttcgtgagcgttttcctcatctcggcgaggcgatgcgtgtgctgaccactgtcgaagatacgccagagaccacgtcgttcgaaacgtatctgcgcggcgaattgggcacctattccgaccgtaccgtggcgttgtaccacgattttgtggagcgtttgcggcatgagcggcgcaatctcaccgaagagacgattcgcaatacggttcgtttggctggatttgaggatttggcacaggctgaggccgcacagtaaacacagtgaaaacacaccgtgacaattactgaaaactgcagtaagccccgtacatcaccataaaaatgaccaccatggtacgaccaaaatccaacgtcaagatggaaaagcaagtgttggatttggtcatgccatggtgatcacgtatttgtttgcgatgtcagcctcgatttcgttggtgcggctgatatcaggggctattcagctgattctcacgatcgttccgaaaccggcgacttatccgaatcagtcgaaaaggccgtggcatccgagctatggggagcgtcgaatggatcgtcgctgtccgcatcgcctccattcttggatcggtttgaacgcaccgcgctgactatcgcccagatcacggcgacggcgataagcagcacgccgatgcctccgagcaggaatacgaagaactgtttcggatcgctggcccaccaccagagattcattggcacatgtatgccgcaaagcagcgtcaccacccccatgaagcacgtgaacacgccgagcgcgatggtcgaaccgcttcttccggaaggtctgatgatgtcgtctccagtctgccgattcttgcgcccatcattcgcaccggctaccgaagcggtataggtcggaacgccttgcgctggagcggattccacgcgcggcttatcatcctgcgttgcacgcccactgcgctgcgactggtcatacgtggactgcgcatccacggtatgcaacgtttcggtaggcatatctccggcatcagccatgaccggcatttcctgggtcttgtcgtcgctcatggtcactcctttcccgctttgcccaatgtgttgtcggacgcatactgcaccgcgacgctgccgccgaccgttgccatagtattgatccgcagtccggttggcatgaccggagccttgccatcatcggtgaagcacggccaatattgatgattgtcgtagatttcgcggtaggccttatctacattcccgtctttgaagggggaatcggtcctagtggaatcggcgccggtatccatgccatcttccgtatcggtctcatcatcgaaatcctcgatgccggattcgtctccgtacgagccgcaactccgatcgtaagttcccagcgcacgctttttcactaccgatttcgtggaatcgttgcccataagcgagacatagatattgccggaatccaacgtgagcccgtccgaactgccgacgaaatcggtgatgttgtagaaattaccgtcagacccgaacgcccaccagcagccgttcggcaaggtcaccacgacctgtgcgcttgaggccaccacattcaacgttcctgtagggcaggaagtcgtgccctgtgtgccatcctgaagatccactttgtgcggaccgttgtttttcgcgtaatcgcttaagtcgatatgcagcacgtcggtggcgtaatcatcgccttgcgcgacgatgccctgctcgtattcgctcatttcactggcggtggagcccatggtggtcattcccgacacattgacccttttgtaggatgagggaatgctcgtgtcaatccgatagctgaacagcgaataacccgccaaagccatcaccatgaccaacgacatgaatacggatatccatgtcagaggatgcaatcctcccgttcttctgcccgcgaatccgagcgcgacaataacgattcccgtcaccagacagatgccaccgacgaatgccgcgcatgcctgcaacgtgtattcggtgccccgctgcccgccttgaacgccgtacgtcataatgcaccatacgcatagtgcgcatgcgatcatcgtgagaccgaacatcatcaataccagcagtggaccagccggcttacggcgcccccttcttggctgcgtaggcgcctgcgccaccggggctaccggagcggtgaatgttggtggaacattggccgtggcaaaagcggccggaccattggcctgctgttggtaggcatgatactgaggctgttgaggctgagggcgctgaggctgaggcgattgcgattccggtgacgaagccgtgttggccaccccgttatatgcgccgctcgcctgcatcggctgagtataaggattcgattgcgctggagacggcgatgcaggaggcaccggctgtccgtacgaaggacttccatattgaggctgaccatattgcggttgaccgtacggagcctgaccatacgggggctgctgccactgatttggaggaacattcggcgcataaatctgcctattgagcagaagccacagcaccaacgcggccaacgcgaaagcaaaccatcctgcccccggcaaacagatggcaacaaggcagcacaacagcgcgccaatgcaattccaatcccacttgccgttaatcaaatcctcagcaagaatctgattgtcgcgctcatccggcagcacaaaccacgccaggccatagaacgcggcacccgcgccgaaaaacagtgtggcaaccatcataagcgcacgaaccaacgtggtattccaaccaagacgacgtgctatgccatcgcacacgccgccaatccaacggtcatgtccacgcttgacctggctggaacgaatccacgcgaagaaacggccgccgcgggaaggttgcggcgaaccgtacgcaggctgccgatgatacggctgtccagcagaaggctgcggccctgcgttgccgcgatcgcccagcggaccattgtttgcattgctcatggttccattacagcaactcgcgcatgccacacgtatcggggaacaccctgaatctgccctgaacactatatgaatgccctgaaacagcgtccttcacagggcacaatggaagtatgaaatccttaggaaaaccgtggtacacgcaaagccagtacgaccaggcgagcgccgtatatatgcgctactgctgcgaccaagccctgcatgagggacgtccgatgccgacacagccggccaaactgccgttgatgcgtcctccatacggacgcatgggagccggcgtatgcaaggcgatcagcatgcatttgggcattgccgtgctatgggtgcgcctgtttttcctcgccaccacatgtctgttcggttcagggctcatcgcttacattttcctgtggatggcacttcccgtaggagaccccatacagcagacgtacattattgccggcaagcgttcgccatggcaggcaccgctttcccggggcaacatgccgtacgggacatatcccgtttccctggaatatcaatcttttacagctacgcaagatggtcagcacacgcaaccaccatcttttgaagatacgactgaacgcaacgacgaaacgcatggtaatacgcaatcttccagcgaaaaccttgaacagacactgaagaaagcaccaaaacccgctttgcttgcattagctggtctgatactgctttccatctgtttcgtcatgttcgcaggcggtgttgaacgcactctgattgtgcccctgctgcttggtctggtcggtatcggcgtctcttggttgcgtttcaacgccgaagaaggtcaattatggacgatgcttggcggcattgcgattattttcgccgcatacgctttgtacgtcagttcctgcatgcattttgacgcgttttccatgattcgcatactgtgcgccggtttggcactgctgattggcgcattgcttgcgattgtgccatggatcatggcgctgattcgcgatttgggtacggaacgcgcatcgaaggaacgcgaagaggaacgtgccgacatgaccgcgcatctgcatgatggcgtactgcaaacgttggcgctgattcagttgcatgccgacgatcagcagacggtgttttcgctggcgcgttcgcaggaacgcgaattgcgtgaatggctgtatcaggaacgcaccacgtctgaccgttccgtgaacgccggcttgaaagaaatcgccgcacatgtggaagacacgcatggcaagccgatcgaagtggtgacggtgggcgacgcacgtccaagcgcgcaaaccgatgcgttgcttgacgccacgcaacaggcgcttatcaatgcggtagcgcatggaggagagccgatttccgtctactgcgaggcaagcagcaaactggtggaagtgttcgtgcgcgaccatggcaacggatttgacgtgaatgccatccccgcgaatcgccttggcattcgtgaatcgattatcggacgaatcaagcgtcgtggcggtacagtggagattgtatcgagaccgcaatggggcacggaggtacgcatgcatatgccaatcgcagacatgcccgcatccgcagccgccgacacgaatgcgcagcaatcgcacgagccgcaaagcaactcacaacaaaccgattttcccaatcaccataaccgtcaatccaacaatcaacgtaccaatcaattcagcaatcaacctaccaaccatttcgaggagcagcaatgaacgagcaggaacagcagatccgcatcgccatcgttgacgatcatgaaatgttccgtgcgggcgttatcgcaacgctgcagccgcatttcgacatcgtcgggcaagcggccgatgtcgagggatcggtggcgatgatcgcgcagacgaagccggatgtggtgctgcttgatgtgcatgttcccggtggcgagggtggcggcggtgccgagattctcgtgaaatcgcgcgcatactcccctaataccgtgtttctggcgctgtcggtgtctgattcgccgcaggatgtcggttcggtgattcgtgccggagcgcaaggctatgtgacaaagacgatttccggcgatgatttgatttcttccatcaagcaagtgcatgagggctatgccgtgttttcgccgaaattggcgggattcgtgctgtccgctttccaaaatggctcaccggctggcatgggcggctctgcaagcggaccgatccacgatgacgagctggaccgcttgtcgaaccgtgagcaggaagtcatgcgcttgatcgcgcgcggctacacgtacaaggaagtggctgcggaactgtttatttccatcaaaaccgtggaaacgcacgtcagctccgtactacgcaaactgcagctgtcaaaccgcaccgaactcacccgctgggccgccgaccgccgcatcgtataaccgaagaatcttccggcttatttcgtcatattctgcgtagacgttgcggacaggcgtacatagccggaatgatgcatggtgaatcgcatgcgatcagcgatatacacgtcagtggcacgctcgaacgggcatccatccgacgcataggcgatccggtgaatgcgcatcagcggagttcccgcctcgatctgcagcagctcgttctcctgctcgtcgccgaccaccgattccaatgtttcgtcgacattgcacggatacacgccataatcacgttcgaacatggtgtagaacggggtcgtcaaatcgcgtgtaaggaacagaggaaacagatatgccggcaaatgcgaccgttccaacgaaagcggccgattttcgatataccgcaatcgcgtaatgtcgtagatcatcggatgctcgcccggcaatcgcagcaaacgcacgtcggaaacggaagccggggcaatcaccgcctgcaatactttcgacgaaacgcgcatgccttgtcttcgcgcgatcgtcggcaatgattccaccgtgttgatattgcgttccaaacgtccgtccgatatgacgatgcccccggcacgaccgattttgcggatgatttcatgatcggattccaacacggtcaacgcattgcgcaaatcggaacggctgacgccaagactgtcggcgagcgcccgttccgatccgagtttctctccgggaagaagctcctgttcacgaatgcgagcgcggatacggtagaccagttcgctcgtagcgcttcgcgtgcgcccgatgccggtatgatcttccatatccgcgccctttctttatggttatctgtcgttttacagcttcaatgtttccagagtcttcatgaatccatccatgaaccaatccacatcggattcgctgaacaccagcggcgggcgcagcttgaggatattgccgtaacggccgcatacggaggtgaggatgtggttgtcacgcagggtttcgaggatatcgagcgctgcctgctggtcgggatccttggtgcccggcttgacgatttcgcagccgatgtacaggcccgcgccacgcacgtcgccgatgcaggggtgtgccggcataagcgacgcgacggcatccttgaatattgcgccgaccttcttggcgttgctcatggtgtcttcgtcacgcatcacgtcaagcaccgcctgggccgcggccatgcataccgggttgccgccgaaagtgttgaagtaaggaatggagcctgcgaacggttcaagtacttcgtgacgggcggccatcatcgacgtgggcagaccgttggccatgggcttgccggatgtgaccagatcgggaacaatgccttggcgtccgaatccccagaatgcgtcgccggtgcgagtgaagcccggctgcacttcgtcggcgatccatacgccacccagttcatgaacggtgtcgatcaccggcttcagatagccgaccggatcggggtacacgccgtcggaggagaagatggagtcggcaagcaatgccgcaaacttgatgccatgacgttccatatcggcaacggccttgcgcacttcgccagccatccagttgccgaattcctcggcggcgcattccgcggcaggcttgccgtcaatgaccaagcggtaagtgtccggcgtgggaatcatgcgcatggtcaagccaagcgtttgcgcggtgccgagcgctggggaaagcttggaggtgagtgccgaattgccatggtaggcctcgctggtcacgatcacgccttcgccgccagtgtaggtctgtgctacgcgaatggccagatcgttggcttcggaaccagtgcactggaacatgatgcggtcaagttcgtcaggcatggtggagaggatatcttccgcataatgcaggatgttctcatgcaggtagcgcgtgtgggtgttgagcatcgaagcctgctgggtaagtgcatccaccacgcgcgggtgacagtggccgacggatgcgacattgttgtacacgtccaagtattcctcgccgccggcatcccaaagatgcgagccacggcccttcaccagatgcactggattgcggtagaacaaacggtaggccggaccaagcacgtcacgctcttcggttagtttgcgtgtttctgggtcgagcgcggccgccatttccggacggaagctattggtgtccatgatggttgatcgagttgccatgattccttctttcgttggcttcctgtggcgttacccacacggtaacgcagtaatgttgagtggctgatacagcgcagaaacaaaccatttccgctgttttccacctatttggttgacctttttacatatttccgatgattgaaaaaggccgcatcccagatgaacacggccttggcaatatcgttttatttcaagaaaacgaaacgataatcgcagaaaatcagtcagtcttcagtcttatatgcgacctttccgccggaagcggcgaactcttcttccggagaaagcaccaggtgcttacgtccgtaaaccgcgaagaagatggtcgcgagaacgtagatgaccaccatggcgtagacggccagtcgataatccgggttcagcagcacggcaacgaaaatgcagaatgcaagcaaacctgcgattaccgcgcccggcacgccgaacgggctggtgaacggacgcttgatatcaggcatcttcttcctgaggatcacataggaaaccatctgcagcagatatgccagcaccgcaccccacacagcgatgttcaacaccaccgaaccggcgccatcaccgccgtacgcgatgatgaacagggctgcgaaaccgatgatcgcgccgacgaccagaccccagtacggcgtcttcttcttaccggtcagcgacaggaacgccggataatagcctgcacgggacagtgaatacaggttgcggccatacgcgaacataatgccttggatggaagcgagcagaccgatcaacgcgaatgcggacagcaccgcggcgagattgcccggcagaatcgcacgatagccatccagcaacggctcatcggaaccagcgagcgcttcggaaccgaccacagccgggttcaggaacacgatgatcagcgcggacaatcccagcgtgaaaatgcacaggcgggacgacttcggaatgttcttttccggctcacgcacttcctctgcagccagaggcagctgctcaataccaaggaacaaccacatggcgaacggcatggcgtagaagatggcacctgggccgaacggcaggaacgcggagttgccttcggtaggcgtgatattgagcagcgtggagaaatcggccttaccagtggcgaaagcgccgataccgaacagtgcgacgatggcgagcgcggcgatcgacacgacttcggcgaaacggaacgacgtttcggcgcccagccaattgaccactacgaaaatcgcatacaaggcaagccaccaaacccaagccaagccatgatcgtcaagcgaatatccggtcaggttcgacaggatcgcatcagcgtatgccgacgagaagtagacgatggtggctgcggtcatcacatactcgatggtttccgcaaggccggtgaagaagccgccccacggacccatggcggcacgcgcgaaggaatacgcgccacccgtgtgcggcatggccgacgccatttcgctgatggagttgagcataagcacgtacatgaggtacaccacgatggcggccaccagcatgccaccccatccggcttgggcgatgcctccgttccagccggagaagtcgccggagatcaccgcggaaatgccgatggcccatagaccgaacgctcccgcggttcgcttaagctgtcgttttgcgaaatagtccttgtcggtttcaacgtaggtcacgccgcctatcgatcgtcccgaaacagttgacgcagtcattgtaatcgccttcctctcttattgttcggcgagttatgccattgattcctcgtttggttggttgcggtcagatgttgttaagttataaaaattgagattttcgtaattgcgtatttttacgtgcttacgattggatttcttggattgtctggtttctgcgtaattacgcttgtttcatgcaacttgcctaatgcagcagccagagcggatcctcaagatagttttttgcgcacatcacgctgccgggagcctgctgtgcagcgagaccgtcgggcagggcatcctcacggtggctggtggtccagccgagcatctgcatgcgtcggatcatggaaagcgcggacatgatacgcagttcctcatccgtgaacgaacctgcgacgcgctggtatcccttgacccacgccttggcaagatcgggagcatacggttcatgttcgatgaaactcagcgatgaagcgtaatcgtagagataccagctgtatccggcatcgtcgaaatcgatgacggtcagtctcccgtcattgccgcgaatcacgttcgacgggcgcaagtcggcatggataagcccccaagtttcgttggttctcggcactttcatcaccacgtccatggccttccacagcgcggtgtcgcacagctgcttctcttcgtcggtgagattggcgttttcccaacgtccccaacgcggtgccggaccaaccatgttcgaaagatcccaattgaagcgggtgaaaccgtacggtttgctccacgtgcgcgactgctcatggaatttcgcagcccattcaccgatcgtctcgtaatacggtgcaggattctcaagatcttccagcacggttccttccacatatttcgtggagatcaccgtccagccgacaccgttcagatcagtgattttcgttacgaacgtgccacggatggtgggaaccggattgatcaggctgataccttcgatatcatgcaacgcattcaaccagctgatttccgacgccaccgcctcgggacctcccacatagcccggctgcgagacacgtaccacgccttggggctcgccgtccagcaacagcaggaacgtcgcgttctcggatacggtgatgaggttgagttgcgcccgctggtggtcgatgccccaagccgcgcaaacgccttggaaaagccagaatggtgcggggcatcctttggtgagcccactgaaagtgtctagactgaccgcttgcgtaggatcgtcaagcaagcgagtgatctgctgtgccatggtggcctcgattcatacatgggatttttcctgtgagagacatgtccgtcagtaaaacctcttcacgaaactgtcgatacccacgattgtgccggaatcgtccgttacaatcaccaccgcactgttacgccgcagttacaaaagcgcaccgcaagattaatggctcattaccgatgccagccgagcatcatccaagttttggcgcaatatgcacgacatacaaaaaagcggggcttgctgagcagaactcaacaaaccccgcagaatcaaagtccttacctatcctacgatggaatcagtatcagtgacggtgaccagcggcgtgaacaatgccatggcgctcaatgccatctgatggttttctggcgaactgcctgcacaagcgtcagcagcaacgcgtaccgctacaccattgtcagccgcggcgagcacagtggtaagcacacagcaatcggtggcgacaccacataccgtgatctttttagcgcctttaatggcttcgctcagcacgcttccccacttgccgaaagtgtcgcaactgaccacggcatggccttgcgccaattccgcggtatccgcggtgagatcgtacatcggatcgtcgggagcaaccaaaaactgcggccaatctttgaaataatcaacccaagcgttttgcggtgactcaggcgcaacatatcgcgtatagaccacacgatcgccgaacgccttagccaatcgtgcgaacgcttcatcagtagtgtgataggagccgtccgggcaagcccatgcggaccattcactttccgcaaaaacacgctgcctgtcgataactaccagccattcatcttccgcaatcatgacttttcctttccttgtattatcgcaataagcaactcatgcttccgaaaccggcagatcagcttcctgcttggcaatatcgccacgctggaacatcaacgatcccgcaagaccaataatcagcgcaacaatcacaccaagattggcggcagcccaactaccttctttgccaccgataaggaacagcagatacccctgccagttcagccagctggcggcagtgttgaccaccaatccccaaccaagcacggtaccgacgacaagaatggcgaaagacttaccgttccacgcaccgtaacgccccttcggatcatacaaatcagcggtgctgtaatccttcttgcgaatgatcacatcggccacgaacatgccggcccatacggccatcggcacaccgagcgtggtcagaaagccttggaacgggccaatgaacgtgtcggagaagaaagtcacgtagaccacaccaagcacagtcaaagcggcggtgagcgcggcagccacggtacgcggcaacttcacaccgaacgacagcagcgcaagcccgttggaataattgtccataatggagccggacatcaaaccgagcacggccacaatggtgtacggaatcaagtaccaggtcggcagaatggaagccatggctccaatcggatcatttccaacgttttccgccatgtcggcattggaaaccgcgagcagcagaccgtagaaaatcaggaacacattggcaatggacgcaccgaatgtggtccagaacacaatgccgccattggaggagttgcgcggcagatagcgcgagtaatcggcagcgatattcacccagcccaagccaaagccggtcatcacgaagaagcagcagccgagcatggccggcaatgatcccgccggaaccgagtcaatggcggaaaagtcaatatgtccccagccgaggataaagaaaccgacggtgatcacaccggtcacgatggtgatgacctgctgacaacgcataatcaggtcgtatccgaaaatacctgcgaccaccacaaggccgaccaccacaatggtggagatgatcttgggcgcgacaccagagccccaaccgattttttcgatggtgcttgataatgccaacacagcggtggtggtcagtgaaatctcccagcctaatgtggcgatccagctcagagccgctggcactttggcaccttccacgccgaatgtggcgcgggtgagcaccatggtgggcgcgttgccgcgtttgcccgcgatggaaatgatgccgaccagcaggaacgagatgaccacgccaataatggtcatggcggtggcctgccagaacgaaatgccgaaaccgagcgcccacgcgccgtacgacatggcgaacatggaaacattggcagcgaaccagggccaaaacagactggccggcgtgcccttacgctcctcttcggatatggtgtcgataccctgctcctcgatggagagggtccctttctcattgctcatgtgaaactaatctccttgaatctgccgagcaacgccgcgggcaagcgacatgcacgccgcgtcagcgcaatcgtgcacatgatataaccacttatagtcatttgtactataagtcttagaacgcccttcctaggagccgctcaacctcctttcgatcagggcaggtagccggccctgatcgcgttacagacaacgccgaagcagcattggcgcaacgtacagcctcctccaacggcacgccttcgcacagcagggcgcacaacacacccgcgtgacaatcaccagcgccattggtatccaccgctttcattggaaaacctggaattcgcagcacttcgtcaccgggaatcgccgaccacgcaccatccgcgcccacgcgaacgattacaggagattgcaatcgatcgcacagccacgcaaccgtctcctcattgacattcgcactctcaatctcttgcagcatatcccgcgaaaccttgcaatcgcaagaatcgccactatcgagcgccgccaaacgttgcgcaatcaacgttgcctcgcgttcattgcacgaccatatcggacgatatgcgagcatcacacggaaaacgtcatcatcaactgccgagatcatcggagaaggatcgaataccgcagtgaactcacgatgttcagtcgttcttttcacaaaagcaagcagcgcgtccgcagtgtgatgcaccaacgtgtatccgctcacatgcacgacatcccgcttttctggattcacagaatcgaacgcatcggcactgccgtacgcttctgcgcccctcgtcgaaatgaacgtccgttcagcattcgcgtcggtcaacgccacgcaaaatcccgaatcgtgcacggcatcccgcttgccgatatgctgaatttcctgattttccaacgtttgcagaatctgcgaagcccacggccccgtaccaatcacaccagcatgagacgccttaacgcccatgcggcgcacggcatacagcgtgttgaagctggcaccaacctgcgtttgcacattgccggcgaacacatcttcacccgcacgcggcaccgcgtccacattcatggtcagatcgacaataacctgcccaagagaaataacttttccagtcattgcgatgcctttcgcacttccgtcatagtttcgctaactacggttcctgcagatcaaacgatatttacatcattaagcgcactatcatcgcgtaacgcgcgtagcgacgtaacagtgccgaccaaatcaaggtgattatcttcagcaagttgtgaaagcacctgatcaagcatggttttgtcgaaaccttgcataccatgccacgcccccagcatcgcgcccgcaatagccgcaatggtgtcagtgtcgccaccgatagaagccgcgaaacacaaagcatgcgtgggatcgtcaaaaaagcgcgccgcaatggcgaaagcggcggccacggactcgttcgattccacgctggtaccgcaattccgttgcagcacagcagcgaattcgttgtcattgagcctgcatccatcagtttcggcccaattcatgaaatattgcacacgcgcaagcaccgaagcctttgccgaccaattgccacgctgtggaagcttccgtacgaattccaccgcgaggtgcaaaaagtcacgttctccttcaatggcaaagctcaccgccgcagccaccaaagtggtcgcttcaatgccctgcaccgtgttatgcgtcaccacacaggatcgccaggcggcgtcggcgagcgcttggcctggacggaatgcgatgcccaccggcgtggcacgcattgcaccgccgttggtggtgccgaatcggccggtctcttccagacttacgccttcggtaagtttttgcagcgctgctttggtggaaggtcccagcaggtcaagcgatcccttggccttcatcgcagcttcccattgcagcagatcgtgggcgtatcgggtgttatcaatgcagccgttatcgtcgataagtcgccgtgcgagtacgaaagcctgttctgtatcgtcggtgacggcaccagctttcatattcggtgcgatcggctgctgcggcacggcattcataagtttcgtgatcggaccgtcgtaataccggcgaatctgcttgtccgacatgctttgcgtaggcattcccaacgcatcgcccaacgcaagcccagccatagctcccatcgctcgttccttcatttgcatcccattctcacgcatagtcacagcagcctttctcacaactcagcctgatcgtacaccgaacaacatcacaatccctccccaatccttccagtcactggaagaaagtggacatttacaagcctctcaacgacccaaatcctccacccactggagaaaaacagacgcccacaagccccccccccagcgggaaaaatcccccagtcactggaagaatcgccccgccacagaccatcccagcgacccaaatcctccacccactggaagaatctggacgctcacagggccaacagcgggaagattgttccagtggatggaagaatacggactttcacgcgctccctagcggggagaattattccagtggatggaagaattgagacttggacggtgctgagccgaacttgggtggagtttacccggattgcagcaacaaaaaaggcttaccgagtgcttagagcgctctcagtaagccttataggcgggtaaggcgagattcgaactcgcggaggcttgcacctcaacggttttcaagaccgtctctttagaccgctcagacacctacccatgtgcatcacgcacgaaacgctaatatagcacaacccaaagaacgaggggaagaaagcgagcaaggacaaaggaaagaacgcggcgaaaacaaaaaagaagggacccgctcaccgcgagtcccttcctataagccagaaaagccagaaatcggcaaatgccaaatgccaggcatcctcagacttccatatttcgtattgcagaagtccgtttcagcagtttagtagctcagcaactcagtggaaccgataaacaaacccgagttaccaaactccacgagcaacccaagctatcagactctgccaagcaaacccaaattctatcaggcttcccacttggtcggctcgatgacttccttgccacccatgtaggcacgcatggcctgcgggatgacgatggagccgtccttctgctgatggttctcaagaatggcaaccagccaacgggtggtggccagcgtaccgttcagcgtggaaacggcgcgggtgccaccatcttccatacgttcgcgaatgttcagacggcgagcctgatattcggtgcagttggaggtggaggtcagctcacggtagcgaccctgggtcggcacccaagcctcgcagtcgaacttgcgggctgcggaagagcccagatcgccggcagcggtatcgatgatgcggtacggcacctcgaccttgccgagcatttcctgctccatggccagcaggtgctcatgctccttgtaggagtcctcctgcttggtgtaaacgaacatttccaccttgtcgaactggtgcacgcggatgatgccggaagtatccttgccagctgcgccagcctcacggcggtagcaggagctccaaccgcagtaacgcagcggaccgtcagacaggtcgagaatctcgttctcgtgcataccggcgagcgccacttcggaagtaccgaccaagtactgctcgtcaggttcgcgcagacggtagatttcgtcggcgtgggagttgaggaagccagtgccgcgcatcacttccggacgcaccagcgtcggggtgatggccagcgtgaagccgtgctcttcggcctggtccacagccatggtgagcatggcgatctgcatacgtgccacctggccgcgcaggaagtagaagcgggaaccgccgaccttcacgccacgttccatatcgatgccggcaacgccacgaccgagggtcaggtgatccttcggctcgaaaccttcggctgcgaaatcgcggatctgtccaaccttcttgaccaccacgtaatcgtcttcgccaccttccggagcttccggctcaaccacgttggagagcttccacatggcggtggtgtattcttcggctgcggcgtccgctgcggccttgtattcggaaaccttctgggagagttccttggtttcggcaatcagcttggccttttcgtcggccggagccgcggcgaccttcttgccgatttccttctgctgcgcacgggcagcctcgaattccttcagagaggaacgacgaacctcgtcggagcgcagcacctcgtcgaccagttcgaccgattcgccacgcttgcgctgggattccttaacaacgtcagcatgttcacgaatgaattggatatcaagcatgcctcctagcctagtgctgaaagccgacacccgccgcagtcctctcatttttgtatacaacgtgcaggaatcgtcgaataaatcagtcttgattcgcttttttcgcatcttccgtgaacaatagatgacatgcctatgcctgttatcattctgattgtcgttcttgcggtcgcagcggtgtgcgcggccgcctttttcgcagtacgcgcgtataagcatcgcaaacttgcggaacagctcgacaagcgcgacgatgatcaggtgcattacgcgtttgtgatcaatccttcgaaaccgcaggcggaacaacgcaagcagcatattcaggagttctgcgaggcgaagcatctcacgcaggttgaatatatcggaacgcagcttgataaggatggtcgcgcctgcgcgctggaagccttggagcatggcgccgacgtggtggtcgcggtcggcggcgacggcacggtgcgcacggtggcgagcgcactttcgggaaccggccacgcgctgggcatcatccctattggcaccggcaatctgtttgcccgcaatatgggcattcctgtggatgatatcgatgcggcactgaccgtcgccacatctcatggttcgcgtttggtggatgtcggccgactgacgctgctcgatgatgaagccgccgatcacggccatgcgttccttattatcgcgggcatcggctttgatgcggtgatgatcgacgacaccgatcctgagttgaagaagaacatcagctggctcgcctatttcgtgtcgggcgtgaagaacctgttcgccccgaagtacaagggtgatgtgaccattaccagcgccgacggcagcacgcacaccacgcacggattgaccttccgcacgttcatggccggcaattgcggccagattccggtattttcgctcatgcccgacgccgtgtacgatgacggcattctcgattacgagatcattgacacatccggcggtttgatcggttgggcgaatctgttcggcgatgtgctgcatcagacgatcaccggcaaggcccagcagagtccgctgtccacgaattccacggttgaccagattcagggcgtcagcgcggaaatcaagttggagaaacccgttttggcgcaggttgacggcgatatgcttcccgaaacgcagcatattcgtttcagtgtggagcgtaagtctttgtgcgtgcgcgtgccggaagcgcccgaagccaatacttccaatgtaaataactattatcgtaattattaaattatttattacgatgattatgtattttatgcagattatgcattggtatcgtcattctcatgcgattccgtcgcatgagaagtcactcgtgcgacatgcaaggtgagataggcgatttccgcttccgaaagactcacgttcaatcgcattttgacgatgatcgcaagtttgttcgcacaatccgatgctttcggatatgaggttttgatggattccacgattggttcaggctcgtcatcaagctgttcatgttggtggatgcgcacgaaaagatagcgcagatgcgtgatgaaacgcgccacattgacgctgttctggtcgagagtgatgccgtaatagccttcgatgaccgtcagcatttgctggatgacgccggtcatggtgtatgtggcggaaagatcgccggtagagaagcccgcattgaccaagtgcagggccaaagccacggcttcgcaatccggcagcgcaccgcccagatacgtgttcatggcatcgaccagagctttgcctttggcatattcgctcgcgtagagcgaacgcacttcggcttccagcggatattcgatggtctgcttgttttgcgatcggcggatcgcaccgcaaatatggtcggataatgccagcaccaatgcaggctgtctgtcggcctgttccttcagaccggtgcggttcatggcgtccgtaacgagacgaatgatttcgggcggaatcccggccacctgttgggccatatggtcgggatccttgccatctgcgggaacgaaccgacggacgatcttcgcgtcgtcaacatgctggccgggcttggcttggaaacctatacctcgaccggtgagaatcacctcactgttgccgtcttttgccagtacgacattattgttgaatacgcgaagaacgtccacgtcggccccttccgactatgcgattggtcagcgctgaatgtcgatcaccgactcaccggccttgacgtcgacgccggtctttggcgtgacggacgcgaaggccactgtgttcagcaccgtcatcaatgtggtggtgctgtatccagcttccttaaccttatcaaagtcgacgacaacgaggttgtcccccgcgttcacgtgttcgttggccttgaccttcacatcgaagccttcgccgttcatcttcaccgtgtcgatgccgacgtgcacgagcacttccacgccatcatcggttttgatgccgaatgcgtgaccggtttcggcgacggtctgcagcacgccggataccggcgcgacgacggtgctgtctgccggctggatgccgacgccttcgcctagtgcgcgggatgcgaacaccggatcgccggtttcatccagggaaatcacatggcctgcgactggagcgttcaccacggtggtggtggcggcagcagcagccggggcttcagtcttggtggcggcaacagtggcagtcgcggtggcagcagccggagcgactcccttggcttcgaccgacgagacagcggtcttctgattggcagccgcgcgggccagcacttcggccttctgttccggagtgcggtagtcgaaggtgatgatcagaaggaaggaggtgaggaaggacacggcgatggacactgcatacacccacatctgattgaagaccggaatggtcagcaacgaggtgaatgcgaaagcggtggtggtcacgccatgcacggtctggccggcggcggtgacggacgggaagagccaaccgaggatggcgatgacgacgccaccgagaccgcagcccaccagcatgcgcttgtagatgagcttgtaacgcaggtgaatgccgtacagagacggttcggaaacgccaccgagcaggccggccgcaagtgcgcccaaagcggtctggcgcatgtccttatccttgtcacgcacagcaaggaagagcacgccagcggtagcgccgaagcaggcgaagttccacacgcccatcgggccttggatgaagtcgtagccgagagtctggatgttcatgagcatcagggcgttgagtggccagtgcaaaccgagcggcacgaggaacgggtacagcatcggaatgatgatggcgaagatgaacggggcatgggtgttcatccaggccaagccgacgccgaggccgttgccgacccacacgccgatcgggccgatgatgaaggcggtcagcgcgccaacgatgatcatgcagaagaacggcacgaagaccagctggacgctttccgggatgatcctcttcaatccgtggtagacgagagcaagcacggcggccatgagcagcggcacgaacacgttgccggaatagtcgctcaatgccatcggcagaccgaatatgttggccatgcaagacttggtgcccagagcggcgttctccacgcacgtggtggtcttggcgtccatcaagccggtgaactgcggggtcatgagcatggccatgatggcaccacccagccatgggtcgactttgagcttcttggacgcgttgtaggcgaccatgatcggcaggaagtagaatacgcccttccagatggctttcacgaatacccagcctgcggaaacctcgtcattcggaatgacgttcagcgaaataagcaggttgaccagcgcgatgatgatggaagcgccgagcagcacgcccagaatcgggcggaaggaatcggagagatactcgaagaaggagtccagccaagccaccttgccgcgggccttggaacgggcttcggccttgacgtcggcattgctcttctgaccatcgtcggatgcggaggcaccgccgacaccggccatttcgggcagatgcatgatgttttcgtacacggtggcaacgccaccgccgatgaccacctggaagcggtcgccgctctgcggcaccgcgccgagcacgccctgcatgtgctcgagactattctgatcgaccttggatgcgtcaaccagttcaaagcgcagtcgagtggcgcaatgcgtcagactgcgaacgttttcaggaccaccgattgcagtgatgatctgcgatgcgagtgagtcagccatcctgatttcctttctttcccttacaaccgattcgatccgagcaacaccgcttcgggcaacaaaaaaagacctgagatatggctatagttcagccacatctcaggtcttgcgtctttatgttgactagcaaccctgcatcagtcgaatagcatggaactatacaccatcgtttgacattgcgcaactcggctaagcgcagaatccgccattttcgaaaattcatgtacacacatccgaacatgcactaaacagacaacgtattcatcgcgcataatgggacaattacgcacatctgacgcaaaagcgtggcagaatagtgactatggttgcaaacaatgcgggaatgcccgctaccccagcagatctgatcaatgtcgacgaggtcatcggcaagtactatgacgtcgtccccgaccccaacgttccggaacagcgtgtctccttcggcacctccggccaccgcggatcgtctctgaagacctcgttcaacgaggcccatatcgtcgccatcacccaggccatcgccgaataccgcaagaaggccggcgtgaccggcccgctgtacatcggccgcgacactcatgctctgtccgagccggcttggaagaccgccatcgaagtgctcgtcgccaacggcgtgaccgtgcgcatcgattcccgcgacgacttcaccccgaccccggttgtgtcccaggccatcctgacccacaaccgcgcagcggatggcacccagcgcttcaccggcgaaggcctggccgacggcatcgtggtgaccccgtcgcacaacccgccgaccgatggcggcttcaagtatgacccggtcaccggcggcccggctccgtccgacgtcaccaacgccatcgcggatcgtgccaacgagctgctcggcgatttcaagaacatcaagcgcgttccgttcgagcaggccgtcaagtccgacctggtcgagcgcttcgacttccgcgagcactatgtcgccgatctggagaacgtcatcgacttcgatgtgatccgttcctccggcgtgcgcctgggcatcgacccgctcggcggcgcttccgtcaactactggccgctgatgaacgagaagttcaacctgaccatcgacgtggtgcgcccgcaggtcgatccgacctggagcttcatgaccatcgaccatgatggcaagatccgcatggatccgagctccccgtacgccatgaagggtcttgtggactccctcaacaacggcgcttgggacaagtacgacctggtcggcggcaccgatccggacgccgaccgtcacggcatcgtatgcccgaactggggcgtgatgaacccgaaccactacatcgccgtgtgcgtagagtacctgttcggcggcaaccgcccgggctggccggaaggcgccggcatcggcaagacgctggtgtcctcctccctgatcgaccgcgtggccgcttccatcgacgccaagctcgttgaggttccggtcggcttcaagtggttcgttgacccgctgttcaagggcgaagtcgccttcggcggcgaagagagctccggcatgagcttcctgcgcaaggacggccgtgtgtggaccaccgataaggatggtctgatccctgacctgctggctgcggaaatcaccgccaagaccggcaagaacccggcccagctgcatcaggagcaggtcgatcgctttggcgaaagctggtacaagcgagtcgacacgccgaccaccttggagcagaagcagaagttcgccaagctttccggcgacgacgtcgcggccacccagctggccggcgaggacatcaccgccaagctcaccgaagccccgggcaaccacgccaagatcggcggcctgaaggtcaccaccgagaacaactggttcgcggcccgtccttccggcaccgagaacatctacaaggtgtacgccgagtccttcgaatcccccgaagccctcgacaaggtgctcgccgaagccaccgaagtcgtggacaaggccttggccgagtgatcattgacgaatcggcgtaatccagccattcgccaatcattcgcaaactcactgagaagcccgctttcctgaaaaaggcgggcttctcgcatatccgcccgaatacgaatcgcaacgaacacgaatcgtgcgatatggcacgaaacgccgaattctggcatgacacgccgaattctggcatgacacgcacgctatcaccctcctgccggccccgcttcgcattacgcttgaatgatagcgacacaacactcagtccagcggtccccgccaatcttcatgggaggtgaacgatgcgcatcgccatcgtcgaagaccacgccgccgaacgccaactgatggccgtcatgtgcgcggaatatttcaaacgcacccgcgatatcggcgtggaatgcgtgaccttcgccgatgcggaatccttcatcgaaagctggaaagacgcccgatacgacctgctgctgctcgactgctatctgtcggacgacgaaaccgccacgcatgcggcgaccggacttgatatcgcacggacgctgcgcagacaaaacgacgattgcccgatcgtgttcatcacgtcaagcactgatttcgccgtgctcggctacgaggtgcaggcaagcggatatctgttgaagcccctgaatcacgacgcgttccatgcgaccatggaccgcgtcgcagcgcagctcgacacgaaaacaccggtcactcatctgaaaaaacatcaatcgacgggcaatgcacaaagcagcacggacgccgcatggcaggtggcgttcggcaatcccgccatcaccatggaccgtcgccttatcgcctacgcgctttccagcgcgcattatgtggaattcaccttcgccgacggcacctgcacgaaaatccgcaccaacttctccgatgtggaacatcgtctcaccgtattcagcaacttctaccgcaccgcgcgaggagtgctcgtcaacttcgactacgtgtcaggcatcagcaacaatgaattcgtgatgaaaggcggcaagcacattcccatcacgaaaaccgcggtgaccaccacctgcagaaaatacgcggaatacacgttcacccgcatgagaatggaagactagccatgcttgacgcactcgcatcgatcgcgccatcatgcatgctcttcgccatcggcgagcagctaaacgcgctaacgggcctgcttctctgcctgtacatgacctggcatcatatggagaattccaagcgcgacggccttattctcatgatttccggcgtgattgtcttcttcctgtgcggcatcgcatgttgcctcgcccacgtcccctcgctctggtccgtgattccttcggctccggttgtggtattggctttacgtaagatgacgaatcttccttgggggcagcttcttttcgtcgtttcaacagtcgcatatatcgtcgcgatcgtttattacctgtctttggccgtggatttagctgttctgaatgagcagtccatgaatttacgtgtcggatggccgggaatgatcagtctgctgatttttgatttgattgcggcgactacacttttccatccgttccatcattcattttccgcaacattcgattcaccttccatcagcaggaatttttggagggtcatctggctttttccgttcatttccacagcaattgtggtgtggtgcatgcccgccgacaacgcatcgctgctcgacacccgcgtgcttagcatcgccttcaccgtatccatcgcatattccggtttcatggccatggcctacttcctcatctggtatatggtccagcaggcggaccgactgcgcgaagccagcaaacgcgaacattacgaagccatgcagaccttgcagctgcagcatatgaacgaacgcatcaacgaagcgaggcagatcaagcacaatatccggcatcatattcagacgttgcaggctctcgccgcggccgacgatatgcccggcatcacctcgtatttggaggagatggccaatcataggctgttgcaccccatccccatgcagtattgcgaacatgcttcgttgaacgcggtgctggtctactactgtgactggatccgccatataggggctgaagtcgatgtcaaagcgtcggtgccgcaatatctcaacatcaataatgccgaattatgttccatggtcggcaatctactggaaaatgcgtctgaggccattatgaaacaacaggatggggagaaaaaactcagggtgcgcatcaaatatcgcactgggccgcccgcatcactgttcattgtggtcgacaacacgcacgattcctccattatgcaggttggcgacgctttcgcctcaaccaagcatgggggtgaaggtttgggcaccgccaccgtgcgcgaaaccgcggaacggcatcatggcgcgacctcgttcgattatgacggcacgctgttccgcgcttccgtcatgctgtgtttggatgattgagattcccgttcgacgtcgcccgatcacagttcgcagttcaccacgtatggcagcgtctcacggctttcgtagggtagagatatgacgattacggtttctacagacggttccgctttaggcaatccgaatggtccgatgggttggggttgggccgatcatgagcttgccacaggcggcaagccggggcatcaccatgacagcgactgcgatgccggcggagctacgaacggcaccaatcagattggcgagctgtgcgcggtgctggaggcgttgcgcgcgcaccccggctccgaaccgttggtgatcgaaaccgattcgcagtatgcgatcaactgttccaccacgtgggttcacggctggaagaagaacggctggaagaactcgcagaagaagccggtaaagaacgcggatctgattcgcgcgatcgatgccgaaatctccaagcgccccggaccggtgaaattcgtatgggtcaagggtcatgccggcaatgccggcaatgagaaggtggacgagctggcgcgcacctatgcgggcgattgccgttcgaagatccgtgaaggatatcttcctttggagggttggcagtcgctgctggcttccgaatattcgcaaggtaccgatgttcccgatgatgcccaaatgctgcttgacggcaaaatcactacggacgaataccatatggggcgcgggcaaggcaagtccgctcaaggatcgttggccgatgatctgatgggcgcggccgatccggagccgcgtccgcgttccatcgccgatatgctggtggagccggaaggctatccagcgcccgacgaggcgacattgccgttgacgtccaacgaaatgtcggtggaatccgacgacatgccggaaccgaccaccgcgcttgatacgaccatgcctgatggcacgacgcctgacgccgaggcaccgcgcaaatcgtatgccgaaatgctgctcaagccggactgttttccccacgagcatgacgagcggcagccagccgacgatgcacagaacgaacaatccgcgaattcctcggaaaacacgccggcgccaacgagcgaatcagccgaatccgcaaacgcgtcggcgccaacgaacgccgtcgccgacttgccgaaactgccgcatcgcgccagtccttcgggattggcggtgtcgggcaccattcgcttcactcccccgccaaattccagtccgacgttcgacggcaagccacgcctgatccgcggttacatcgcggtggaaggctacgtgcaaggcgacggcacgctcgtcctcgacgaagcgccatttgcagtcaagcacaactaacgagccagcactttcgaccttaacgcctcgaaagtgcgtgaaacatcctgtgaaaacatttgctgaccaccaatggcacaccttcgttcatgacatgtccgcaaacgcacaaaaatcaacacatccgataatatggagacggtcttaaccccatatcgaaggaggatcatggacaaggcacagcaggacgcattgaagaaggcagccggcatcgaagctgccaagctgattcagaacggcatgatcgcaggtctgggcaccggctcgaccgtgcgcttcctggtcgacgagctcggccgccgcgtgcaggaggaaggcttggagttcaccggcgtgaccacctcccgccgcactcaggagcaggcagaaggctacggcatcaagatcgtcgacatcgatgacgttgatcacatcgacgtgaccatcgacggcgccgacgaggtcgacaagaacttcaacggcatcaagggcggcggcgccgctctgctgtgggagaagatcgtggccaccaactccaacaagatcgtgtggatcgtggacgagtccaaggttgtggacaccatcggcaagttcccgctgccggttgaggtgattccgttcggcgcaggccaggtcgtcaagaagttcgaatcccgcggctacaagccggtgcttcgcctcgacgccgaaggccagccggtgcgcaccgacgagaacaactacgtggtcgatctgcacctcgaatgcatcgaacacccggaggctctggccgacgatctcatcaacaccgttggcgtggtggagcatggcctgttcctgcacatggtggaccaggtcatcgtgggcgatcccaacggtccgcgcgtgctcaccaactccaacaagtgagtttgaagtagcgtaagttccgcattttccgcagattttcgcgaacctacacgaaaccatatgaggctgtgcgttcaacttcgaacgcacagccttctttttgcatctattgattttcgattctcgtacttttcgtttatttctttgcaatatgcaaaaatcccgcatacctcaagaagacatacgggattttgtttaagcgacgcttcaaccgcgcctgaagactacttgcgctggtggcgagtcttacgaagcagtttgcggtgcttcttcttgctcatgcgcttgcggcgcttcttgatgaccgagcccatctcagcctccgttcttaaactcaaagggtaaaagtttgcaacttgcccaatactacactgcttcggggactaacgcacacaaccgcattcatatggtggaagcacgcacctctttatcggaagatcaggcaaacgcagtccgcatggtccacggctgaatcttacgtgaatcatgcatgaatcataggatcgcacaaccagccgtaggcagtatcacagcgggaactgctggtagaagcgctgcaccgaatccttggctcccgtggcttggaacaccacggtatcgttgcgccagaccgcgatggccttggtttcgtcgtccggatcggttttggcgctataggcgccggtcgcttcaccggaaaccttcacattgccgccgcccagctccttgccggtcatggcaccggtcagattgtcatactgactttgcgcatcatcagactgagaccattgcgccactttcaaggtgatatcctgaccgtccttgcccgtggaatacgtcaacgtgtactcctcgaccggggaagcgccgctccacgaagtgctggcatcggccttggtgcgcgcgaaattcaacacggaatcaggcatggccttcaacagttcgctggcgtcatccggcaacgccacagcgtcaatggacggcgtggtcggctcagaggcatcctgcgacgcgccctgcgaggtggtggtgccctgagtggacgcttcatcgcccttgttcagagcccagccgggccagatgaaagcggacaccaaggcgagcacgaccaccaaagcggcggcaatgacagccacgatcagtttgccatgagaagaggaagtttgcgtagtagacatggctgttattctttcatatccgtgagacgctcgaatccagaaaccgtgatctcgccatcatcccgcaccagcacccccttaatatctccgaaaacgattgtcccaaaatatccgtattgtcggcgatatggcaaagacgtcctcgcaatttgtatgttccgaatgcggctggagcgggccgaaatggctgggccgctgccctgaatgcggccagtggggcaccatcgaggaattccatgaagcgcgcccctccgcatcgtcacgcaccgccgctcccggacgcacatcgcgcacgctatcgcatgcagtgcccgattccgcggcgaaaccgatcacggaaatcagtacggaaaacatttccagaatcgacactgggttcacggaattcaaccgcgtacttggcggcggcatcgttcccggttccgtcacgcttatcgcgggcgaaccgggtatcggcaaatcaacgctgctgctggagaccgcaggcaatgttgcccgtctttccgcagcacagcccgaacgcaacacggtgctctatatttccggtgaggaatcgcaggcgcaggtgcgcatgagggcctcgcgcatcggcgcggtcgaaccgaatctgcttctggccgccaccaccgacctgtcaaccgcgctggggcttatcgaacaatgcaagcctgcgctggccatcgtcgattccgcgcaaaccatcgtctcgcaggaagtcgatggcatctccggaggctcgactcaggtgcgcgaagtggcgagcgcgctgatcgacaccgccaaaacgcttgatattccggtattgttggtcggtcatgtcaccaaagacgggtcgattgccggcccgcgcacgttggaacatttggttgatgtggtctgccagttcgaaggcgacaccgaaaccgcattgcgtatgctgcgcgcggtgaaaaaccgtttcggccctactgatgaggtcggctgtttcgatatgagcggcgaaggcatcgaagaggtgacggacccgtccggactgtttctttcctcgtccaattccgcagatccctctccggtggagggcacgtgcgtgaccttcacgttggacggtcatcgcagtcttcccatcgaagtgcagtcgctggtcaccaaatccgtactgccaacgccacgacgtgccgcgaacggcgtcgacgccaaccgcatcgccatgctggtggcagtgctatacaggcatggcaacgtcaatcttctggcaaacgatctctatatttccaccatcgccggaggccaggcgcgcgagcccggatgcgatctggcgatcgtcggcgcattggcgagcgccgcgaaatcgaaggcgatcagccgcaccacatgtgcgattggcgaaatttcgttgaccgggcaggtgcgcccggtgccgcgactggaataccggttgcgcgaagccgcccgtcttggcttcaccaccgctgtagtaccgacattacgtagagaaatcgcaattcccggattgtcgatcgttcaggtcgacacattgcaggatgcgcttggcgccatgttgcgatagcacacaccctacataccgttttcgcatgtatgcacgcgaagcatatacattatgttattttttaacctatacaagtggggctcttacgtaaatgcttacgtaagagccccactatttttgaatactgatacgtttttactggaaatatcagcattcattaatcactgtcattatcgtaattattattgcgattagaatcaagcagtaattcgcttggtttcctcgacattgcgcttcagctcgtcgatcagatcctgtgcggaatcgaacttgatttgcggacgcaggaatcctgtaaattccacgcgcacctgatgatcgtacaaatcaagccaatcgtcggtgatggcgtaagcttcgaccacgcgatcgttcattccggtcgcctcgttgaaggtcggcttggtgccgatggaaatcgcagcgggccaacgatacggcgaatgatcggcaaggcgcgcgtccacggaagaggaatcgaactgctgcgaaacaccttcggaagcgtcctgcgcatcatcgtccgccgtcttcgcgcccaagtccacaagccaaccggcgtatacgccgtcgaccggcagatagcctgccacattctcgctcagattcgccgtggggaagccgatggtgcgtccacgttcctcgccatgcaccacggcgccttccacggcatgcggatgtcccagaatcgcgtcggcgtctttgatgcgcccctggcccagcaggtagcgcacattcgtggagctccacacgcgcacggccttcgcctggtttttcttgctccatgcgcgacgttccgccttggacgcgccttccagcggatcggccggctcaccatggtcggtgggcataaccggcttcgcattggctggcacgcgggtttcgcccggtccacgatcgtcgaccacatcaagctggaacacgccggtggcgagcgccagattctcgatggccttcacatcgccggcacggttcgcacccatggccgcatcggatccgagcactagcgcgcgcatgcccagcttgcccaccatttgtccgaggaagaatcggtacgatttcgccgcgaacgccagcgtgtaacgcacgatgagcgtgtaatccacgcccagcttgttgatggcgcgcagacgctcctgcatgctggtgagcgcctgcgcgtcgatcatgcccgccggcggctcctggccaccgttttgcgccgcgtagccgtgcacgagcgctgggcgtggatcgaacagcaccaccacggagaaggactgttccttcttggcgagttccaccacgcggcgaatcaccgcctgatggccctgatgcatgccatcgaacgaaccgatggtcaccacggatttcttatcgttgctcagcgtaggccaatccaccatgccgctggcatcaggcgtgagcgtgattgtcttcatcatgtccttcttgtgtatgaattcgtatctgtagtctgattggatggttcagttgaataccgcgaccggtttagcctcaccgcgtttcgcacgttcgaggatggcgaccaaatcgttggtttcctcaacgtacgccgccgtggtcgtacgtatgtcatgcgcgattctgcgtccgaaacgcaagtcggccgcttcctgatcgctcacggccagcatattcatggaagccgcagcgctggccacgggatcgagcgcatgatcgagcgcatgatctgcatcgtcaagcactgcacgattgcgcgtcacttccatgccttcacgattggtgaatgttttggattcagcgtgggcgctcatgacgttgggcatattcactgaaaatctgccgacacgtgtgcgtcgcagcatcgtcagatggcctcccaacccgagttcctcgcccagatcgcgtgcgagcgcgcgaatgtaggtacctgcggaacaggtcacggtcacgtcgagttccataacgggctgcatatcttcatgcggtgcagtgtcggcaatccatccatctcctgccctctcggccacgactgcgccagcaagttccgtgccggcacgatcgctatgcgtgtagccgtaacgcgcctgccgcacgttgaactcttcgatggtcacaggacgtgccttaagctccacatccttgccttcgcgcgccagatcataggcacgctggccattgaccttaatggcggagtagacgttcggtacctgttcgatgcgcccggtgaaccgttctgtgatcagctgttccacggcttgacgcgaaggaaagttcactgcccgctcccccgccggcaacagctcgccttcggcatcgtccgtagtggtgcgctgtccaaggcgaatggtggcctcgtacgttttgttatggtcgacaatgtagttgagcagtcgcgtggcattgccgaaacccaccaccagcacgccggtggccatcgggtcgagcgtgccagcatggccgacacgcttcatatgcagggcgccgcgcacggccgcgaccacgtcatggctggtgaccccctgcggcttgtcgatgaccagcaggccggaatgttcaggcttcttcgtcatcatcccaatcttcgacttcgacgtcatcatcgtcgaaatcatcgtcgtcatcctcttccggatgcttgtacggatcggcttcgcccgcatactgggcggtttcacgagccttggcgagttcttcgtcacgcttgcgcgcgatggcgagaatgtcttcgatctcatgtgcctcgcccggcacctcgtcgaatacgaattcgagctgcggggtcaaacgcagaccggccttggtgcccacgagggaacgcagacgacccttggcttggttcagtgcctgctgtgcacggcggcgttcgccctgctcatggccttcacggccaagctgggtccaatagactttggcgatctgcagatcgttggtcacacgcacttcggtgatggtcacgtttgtgagacgcttatcgtgcaattgcgcctccatggaggatgcgatcacacgttggatcaacgccgcgatgcgtgcggcgcgaggattggttcctgccattgttgtcctttaatcaggtaagttctgttgtattacggaacgcccgcagccgtatgtcagctgtgggcgttcctttcttgttatcgattgctggttcgaatcaatcgactacttgcgttcgatttcctgcatttcgaaggtctcgatgatatcgccaagctcgatgtcgttgaacgaaccgaggttgatacccgcttcgtagccttccttgacggagttgacatcgtccttgaagcgacgcagcgaggagatttcgagatcattgacggtggcgatgccgttgcgcagaatacggcacttcgtaccgcgcttgacttcgccgtcctgcaccataacacctgcgatattgccgaacttggaagaacggaagatctcgcggatctcggagtgggacgtgacgacctcttcgaattccggcttgagcatgcccttgagggatgcttcgatgtcttcgatggccttgtagatgatcgagtagtacttgatttccacgccttcgcgttcggccatatccgccacctgacggttcggacgaacgttgaagccgatgatgacggccttgtcgacggtagccaagttgacatcgttctgggtgatggcaccgacaccgcggtggatcacctggatgccgacctcgtcagacacctcgatcttcatcaaggaatcttccagcgcctcgacggaaccggaggaatcgcccttgatgacgatgttgagcatgtcgacctcagccttggcgaactgctccttgaggctttcgagcgacacgaccttacgacgcttggccagctgggccgcacgctcggtggcctgacgcttttcggcgatctgacgtgcggtacggtcatcggaggccaccaggaacagatcgcctgctgtcggtacggaggtcaaaccaagcacctgcaccggagtggacggcgtggcttccttcatatgggtgccgttttcgtcgagcatggcgcggacacggccatacgacgttcccgcgacgatggaatcgccgatgtgcagagtaccggactgaacgagcacggttgccacggcaccgcgacccttgtcgagtcgggcttccacggtggcaccgcgagcgtccatatccgggttggcacgcagatcaagttcggcgtccgcggtcagcagcacggcttccagcagcttgtcgacattggtgccctgcttggcggaaatgtcgacgaacatggtgttgccaccgtactcttccggaacgaggccgtactcggtgagctggccacggaccttgtctgggttcgcgcccggcttatcaatcttgttgacggccaccacgatcggcacgttggccgcctgagcgtggttgatggcttccacggtctgcggcatcacgccgtcatcggccgcgaccacaaggatcgcaacgtcggtgagttcggcgccacgggcacgcatggcggtgaaggcttcgtggcctggggtatcgaggaacgtgatcttacgcggttcgccttcgagatcgacggtcacctggtatgcaccgatacgctgggtaatgccgccggcctcacgtgcgatgacgttggtacgacggatggtgtcaagcagtcgggtcttaccatgatcgacatggcccatcacggtgacgaccggcggacgcggcttcagatcttcatcttcctgaagttcttcttcgtccagatcgatgtcgaactgctgcagcagttccttgtcttcctcttcggcggacacgatcttgatgtcccagccgatttcctcaccgaggatctggaaggtggattcgtccaaggactgggttgccgtagccatctcaccaaggtggaacagtacggtgaccagtgccgccggattgacgttgatcttctcggccagatcggcaagggatgcgccctgacgcagacgaacggtctgaccgttgccggtaggaatacgcacgccgccgatgaccggggccttcatctcctggaattcctgacgctttgccagacggttcttacgagccttcgaggacttgccgccctgacgaccgaacgcgcctgcggcaccgccacgaccgcgaccgccgccgcgtgccggaccgttgctcggagcgctgttgccgccctggaagccgccaccattggtattggcgccgccaccgaaacggttgccaccacctgccggacgctgaccgccaccctgacccggacgatgctggccccactgacccggcttcgcaccggtgccttggcccggacgaccacggaagcctccacgctggccgccgccctgacccgggcgtccgccgcgacgaccttcgccgttgttattgttgttggcgttcggacggttcatcggatgcggacgcggaatgtcacccggagtcggggtatgcatgccctgcttgcggctgaacggattgttacccggacgtgggcccggagtgtgcggcttcgcaccattggcggcattgttgccattgccgccctgcggagcattggtattgttattgttgcgctgtgcgcgaggtcccggaaccggagccggcttgccgccctgacggcgttcgccctgcggacgcggagcgttgccgttggcacgattgccatgctggcgggaatcacccggacgaggcatgcgctggccgggcttcggggcttcggacttggacgctgcaggacgtgccggctttggagcggcaggctttgccgcggatgccgcgggagcagccggagtggcacgaggcgcaggagtaggcgaagctgccggggcagccggcttcttggccgggaccgcaggcttcttggattcggatgcgttgccctgcgcgttggaagcgaaagcattcctcagcttacgggcaaccggaggttcaacggtagacgatgcggacttcacaaattcgcccatcgcctcaagtttgttcaaaacagtcttgctgtcaacgccaaattccttggcaagttcatatacgcgtgctttcggcactcaatttctcctatcttgggccgcgcgcatacgagcgcgaccgctactgattcacggcgagcttgttccttctcatcgtgcaaccatgttcgtgatacctcgtcttttccctgggcatgacggcacgtacccccacgctttggattatcgagtccagcatactcaagcccgtggattgaacgcccacgggcttaccgctgctgaaagtgttggttattcggcggtttccccgctggtcgaagcctgcgcttcggccatcttcttggcgtgtgcctcggcggattcgatgccgatcttccatccggtcagcttggcggccaaacgtgcgttctggccttccttgccgatggccagcgacagctgatcatcatgaatgaaggcgattgcggtctggttcttctcgctgattacctgcacaccggtggcgaccgccggagacagtgccgccgcgacgaacttcgccggatcggcagaccagtcgacgatatcgatcttctccggcccaaggttctccatcaccgcacgcacgcgagcaccgccggggccgatcagagcgcccttcggattgacgccctcggtgttggcgcgcaccgcgatcttggtacgggcaccggcctcacgcgcgatggccatgatcgagacggcaccggaaaccagttccggaacctcacgttcgaacagacggcgaaccagctcgggatgggagcgggacaccacgatttccgggcctttgaggccacgtgcgacattcaccacatacacgcggatgcgctcaccatggcggtaacgctctcccggcacctgttcacgacgcggcagcaacgcttcgacgtcgccaacggccacgtgcacattggaggtgtccttcacatcctgctgcacaatgccggtgatcagcttgcccttctgcccggagaacgcgccgaacaccttgtcgtcctcggccttgcggaacagctggctgatgacctgacgcgcggtggcggcggccagacggccgaagtcgcgcggggtgtcatcatattcctcgcccagagtcggcgcagggtgcggattatcctcggtcggctcgacggggatctcatcctgagcccaaacggtaaagcttccggcacgcggatcaagctccacacgagcatgcttcgccgcgtgcggcgttttcagatatgccagtcgcaatgcttccgagagtgcggcatccagcgtctcgggatcgattccctgcccagctgcgagctggtgcattcctgccaggtccagttccatacttccaagacctcctatatgaagttattccgagcgctcggcccaatggtcacagtcgactactagtctaatgtttcatgcagacacgctccccgtttttccccttggccttgtcgactgtcagacgcgcctgcgtcttggtgtgcgcgagcgcccttgtggcatcactggccgcgtgttccgctcctcgaatcgcaggtcgcgccgaagccgaacagcagccaagtccttgcgaaagggcgtatgcagacgcgactgccaacgccgacatcatggcagacaggtcacgccatatcgtcatgcgctatcttgccgcgcaggaggcggtttcagattgggccaacaccgcggcatattgcccggcgcgattcgccgatggcacgttgcgcagcgcgcaggcccgtcacgccgtcagattgatggcctcacggcttgcgattgacatcgcacagcccacgctgtcacgatgcgatggcattgactcgcttgatgtcgatacggattcgcttgcagccatggctgctgcggaagatcaggtggggttcgcgatggaggtgttcgccgcgcgttccttcggtcatgcgacgcttgacatcagcgatcgtcataaaaccacttcgcaacgcctgatttctctttccggagccgaagacaatcgtgcgaaaacctatgatgtcacgcagctgctcgccaatcctaataccatcgtggattccgcaacgggcttgtacgcgccaaccgatgccgtcctggaaatgaattgcgcgcgcagcgaaatcgcagccgttgcggcaagctcgacttcgtcgaacgcctcgacgaagtcccaaacaacctcggacgaccattcggatgactcccgggaacagtcactgggcatgctcgccagcatgatcgccgaccgcgtggatctggcactcgactggggttatccggcattcgacgaagcgctattcgcatagcgcagacttgcgtacgctgtccgcgcaaccgtcttcacacaatgcgacgcagtgttcccgcgaataagacacgccgagcaatcgcagacatcgcaaaaaatccctcaatcggatttgacaatcgccaaagctgtggcaaaatgatgaagttgcttgttttcaagtagcacaatggataagtgtccgagcggtctaaggagcacgcctcgaaagcgtgtgagggcgaacccctccgcgagttcgaatctcgccttatccgcaagtagaaaaaccggagcaacggcgcttcggttttttattgcttacagccctgtggcacgtaggagcacataggagccaaggttattgctttagacgatctgcaacttttatgccttcattcatcgtcgcacacttcttctacccctgaaaatgcatgcctgtcttaaggccgctcaatcctcgatagaagacgtactggcgttcgattaccctaaaatgcaacgaattattacaattgcgtctcgatcacggactcgtgagaacgacgtaacgtcgtcatggcatttcgcatgattcgcgtgttcttttcgaactatatcccgtttttccgtttttgcgattgcgtgatgtggttttgtgatgcgatatttggtgcgattgtatagcgcaatcttctgtgtatccgtacagtatgtgctcttacaaagtacgtttcgcacgaatcgcttcggcacgaatcgccaactggtcgtcttccggatattcgatatgttccagcgtcaatccttgcggagcgatcggaccagtgctgccttcacgcaacggcgtcgtcattttttcggcgaaccaatccacggaacgtttgccgatgcctacctgcacacaaccattaaccagcgatcgcaccatattgcgtgcgaaagcgtccgcaacgatggtgaagcacagcagtccggattcgaccgcaggcgtgcgatatcgctcccccatcgtatttccgtcgtcgatcagcggatgctgcggtatacgacgccaatacgcggttttcacctcgcgtatggtggtgcctccaggattcggggttgcgaacgagccgaaatcatgcaggccgatagtcatttcagcagccttgttcatagcttcgatgttgagatcatcgtcgatatgcagcacgcaattgcggatacgtggatcgatttcgcttgatcggtcggcaatgcgatatacgtaagtgcgttccagtgcggagaaacgtgcgtcgaatccttcgggagcttcctcgatggaacgaatggcgatgtcattcggcagcatgcgttgcagccgtcgcttcaacgccatcaccggttcgacctgcatatgcccgacgcaacgtgcaagcgtctcctcattgatgtcgagatggcaaacttggtgcgacgcatgcacgccggtatcggtacgacccgcgacggtcaggcgcagcggctcgtcatcatcgccttccggtacacgaagaacggtatgcagcactcgttcgatttctccctgcacggtacgcatgtcaggctgtttcgcccatccgtagaaatcggtgccgtcatatgccaagtcgatacgtaatctcacggcaatgagcataacaaaaggcgcataacaacatatgacaacgcataacaaaaaggctgggaacctttcgattcccagccttttcatcagctagtcaagcctgcttgatgccaatcactcggcgttctctgcggtggcttcctgagcctcaaccggtgcctcttcgacaaccggagcttcttcagcggcaaccttggttgcggcttcggcttccttgaccacggcctgcttcgggctcaccggctcggtgacgagctcgatgatggctgccggagcggcatcgccacgacgcggagcaatcttgacgatgcgggtgtagccaccctcacgctgctccatctgctcggcaatctcggtgaacagcttgtgcacgacggacttgttgcggatgacacgcatcacgcgacgacggctgtgcagatcaccacgcttggcgagcgtgatcagacgctcagccagcggacgaaggcgcttggccttcggcagggtggtggtgatgcggccacgctggaacaggctggtagccatgttcgcgagcataagacgctcatgagccgggctggaggccagacgcggacccttctttggtgtaggcattgtttctccttgaaagccccgtcggactcaggtgggcagttgcccgaacatccgaatccgacgaagcggttaggtcaaaagcggcgaatcactcgtcttccggcgagaagaaagtgccgccttcgaggttgttggtatcgaagttgcccagcggggaagccttgagggccagacccaaggactggagcttttccttgacttcgtcaatggacttcataccgaaattgcggatgtcgagcagatcctgctcggtgtgggcgaccagctcgccgatcgtgtggatgccctcgcgcttcaggcagttgtagctgcgctgggtgaggttgagatcctcgatcggaacggccatctccgggttggtttcctctgccaccggggcaggtccaacctcgacgccctcagcctgggtgttgagctcgcggcacaggccgaagagttccaccaaggtggagcctgcggatgcgacagcatcacgcggggagattgccggcttggtctccacgtccaggatgagcttgtcgaagtcagtgcgctgttcaacgcgagtggcttccacgcgatagctcaccttgagcaccggggagtaaatcgagtcgaccgggatacggccgatctcggcgttatcctgcttgttcatctgggctggcacataaccgcggccacgctcgacggtgaactcgatctcgagttcgccatcttcagcgagagttgcgatatgcatatccgggttggcgatagtgacgccggccggcggagtgatatcacccgcggtggcctcgcccttgccgctcttgcgcagatacatgacaaccggctcatcgtattcgctggtgagcacgatgcccttgatgttcaacaggatctcagtaacgtcctcttcaacacccggcagagtggtgaactcatgcgggacgccggagatacgcaccgaagtcacagccgctccagggatggagctcaggagggtacggcgcagcgagttgccaagcgtgtagccgaaaccaggctcgagaggctcgatggtaaagcgggaacgctgagggttgagagattcctcggtaagtgtcggacgctgtgcgataagcactgtggttatcctttcagcttcaggccggtggtgcactcaccggccataagcggcgttggattgatgatttcttctagtgctcagacgcgacggcgcttcggaggacgaacgccgttgtgtgcctgcggggtgacgtcggtgatggaaccgacttcgagtccggcggactgcaaggaacggatagcggtttcacgaccggaacccgggcccttcacgaacacgtcgaccttcttcagaccgtgctccatagccttgcgggctgcggattcagcggccataccagcggcgtacggcgtggacttacgggagcccttgaaaccgacatcgccaccggacgcccaggacacaactgcgccggacgggtcggtgatcgaaataatagtgttgttgaaagtggacttgatgtgcgcctgcccaaccgggaccgacttgcggtcgcggcgacgcggcttgcgcgcggcttgcttttgagctgccattgaccctcgtttcctaataacgaatttgctttgttgttcaggcgatgaaacttacgtctcgtggtctgaactgacagccacctattacttggtggccttcttctttccggcgaccgtgcgcttcgggcccttgcgggtacgagcattggtcttggtgcgctgaccgcgcacaggaagtcccttacggtgacgctggccttggtagcagttgatctgaatcttacgacggatatccgcatcgatttcacgacgcagatcgccctcgatcttgtagttaccctcgaggtagtcacgcagcgtgatcagctgctcatccgtcagatccttgacgcgaatgtccgggttgataccggtcgcggcaagcgtttccttggcacgagtgcgacccacaccaaagatgtaggtgagggcgatctcgatgcgcttctcattggggatgtcgactccggcaagacgtgccattgcgattccttctgttttccgcaggtcttgcaccgagtcgtccggtttcccggcccgggcctgcgtacccggggttcataccgcttgcgcgatctgtgactcagcgcctgtacttattatgccgctggatctgctctcagccctgacgctgcttgtggcgcgggttgacgcaaatcaccatgacgcggccgtgacgacggatcacgcggcagttctcgcagatcctcttcacactagggctgaccttcatggttttcctttgcttgtgtaccttacttgtaacggtacgtaatacggccgcggttcagatcataagggctcatttccagcacaacacgatcctgcggcagaatgcgaatatagttcttcctcatcttgcccgagatggttgcgagcacgatatgcttgttctcgagttcaacgcggaacatcgcgttcggcagtgcttccactacctgtccttcgacttcaatcacaccgtctttagccatgagcctcgttccgttctttggcgattactatgcgtgcccgaagacacaccaacttgcaagaatacacgaaaacgggaactacggcacgttcggcgtgtcgcaattcccgttttcgattgatttgtggtattttattgggctttcttatcgttgcatacgatttgaatttgcccgattttcagctatatcagccaagctcagccacgatggtggcctggatctcttcgacggagccgacgccgttgaaggtcttcagcagcccgcgctcttcataggtggccagcaacggagcggtttccttggcatacacatcaagacgcttggcgatggcttccggagtgtcgtcggaacggccttcgatctcggcacgcttcttcatgcgctccataagcacgtcatggtcagcgtcgagagccaccacagcgtccagaggagtgttcagatcggcgaggatggcgtccagtgcctcaacctgggatgcgttgcgcggatagccgtcgaggatccaaccgttcttggcatcatccatggccagacgatccttgacgatcttgttggtcagctcgtccggaaccagttcgcccttgtcgatgtacttcagtgcctcaacaccgagctcggtcttgttcttgatgttgtagcggaagatatcgccggtggagattgccggaataccgtagtgctcgctcagcagcgcagcctgggtgcccttgccgacgccctgcggtcccataatcagcagtcgcatgttattctccgtttcattgagcctcttgcgaggctttctgattctcgattggttacatgaaaatcgtgataccgcttcacgtcgaaacggtatcacgattttgaggttttacttgccttccttgtggtcagtaccctcgaacaggaatccagcgtactggaactgttcggtctgggccttggcctggcgcagggtgtcaaggccgacgcctgcgatgatcaggatggtggtgccgccgaacggcaacttggtgttgaggtcaagcgccatgatgagcacggtcggaataagcgccacgaatagtaggtacacggcaccgacggtgttgagcctgttcatcacgtagctcagataacggctggtggcgctgcctgcgcggatgccaggaatgaagccgccgtactgcttcatgttgtccgcggtttcgtccgggttgaaggtgatttccgtgtagaagaagcagaagaacacgatcatcaacgcgtacagtgcgatgtaccacacggaagtggtgttggccaagttggagttgatccacttgacccaggactggtcggatttgccgaactgtgcgatcagggtcgggatggccagaatggaggacgcgaaaatcggtggaataacgccgctcatattgatcttcagcggcaggtaggtggaggatccgccgtacatcttacggccaatcatacgacgggtgtactgcaccggaatacgacgctgggaaagctcgacgtagatgacgaggatcatgatgaccagcagcacaccgacgaccgcggcaaacttcgcccaattgccatcggtgcctttggtgccccaaccgatctcccaaagctgcggtaggaagccggagcagatggacatgaagataaggatggacataccctgaccaagacccttatcggtgatcaattcggccatccacatgatgaggccggtgccgccagtcatgatgagcaccatgaccacgaggttccagacggaaccgtcaggcacaacctgggagcaccggtagttgaacagggcgccggagcgggcggtcaccagaatggtggtggactgcagcacagcgaggccgatggtcaggtaacgggtgtactgggtcagtttggcttcgccggactggccttccttgtgcagcgcctcgaagcggggaatcaccacacgcagcagctggatgacgatggatgccgtgatgtacggcataacgcccagtgcgaagatcgatagctgcaacattgcgccgccggagaagaggttcaccagaccaatgaagttttcggaggtgctatccatcgaaccgaggcactgctgaacgaccttatagtcgacgcctggggtcggaatgaacgaaccaatacgataaatgatgatgataccaagagtgaagaggatcttgttcctcaactccttggttttcaaggcctggattaacgtcctcacctgggattccttccatcgacgtgcgcgcctgcgcacccatgcaaaacagactctaccgatcgagtctagcgtacggcgtctacctacacgtggagtgttccatcctttgtcggttttttacaagatttcgaggcattgttttcgttttgttccccgtactggaccaaaacgaagtgaggcctcccccgtctaagcgggagaagcctcacttgcaagcttcagtcagctctacattccttggaatcagtcctcggagatggagccgccggcagcctcgatcttggacttggcggaagcggaagccttaacacccttgatggtgtaggctgccgaaacctcgccgtcgcccaggaccttgaccgggtagccgtcacgcacggcacccttggcgaccagatcggcaacggtgatttcgccaccctgcgggaacagttccgcgagagcagcaacgttgacgacctgatattccttcttgaacgggctcttgaagccacgcagcttcggaaggcgcatgtacagcggcagctggccaccttcgaagcccggacgaacctggtaacgcttcttggtgcccttgtcgccacggcccgaggtcttacccttggagccttcaccacggccgacgcgagtgcgatccttcttggcgcccggagccggcttcaggtcatgcatctgcagaatatctgccataatcagtcagcctcctcaacggtgaccaggtgacggaggaccagcagctggccacggagggccggcgtgtcttcacgggtcacggtcttgccaatcttgttcaggcccagagtccgagccgcagcacgctgcttcggagtggagttcaccagaccgtggtgcagcttgatgttcaggttagtcatcactcaccgtccttctgagcggccttggcctgtgcttcttcacgggccttacgagcctcggcgatgccttcggcgcgagcacgcagcagggagtcaggagccacctcttcgagggacatgccacgacgggctgcgatctcttccggctcttcgagcttcttgagagcgtcgacggttgcgcgcaccacgttaacggcggtggcggagcccatcgacttggtcaggacgtcggtgatgccagcgcattccatgacggcgcggaccgcaccgccggcgataacgccggtacccggagcagccggacgcaggagcacggtgccagcagcatcatggccgatcaccgggtgagtgacggtgcccttgatgcgcggaacggtgaacatgtgcttcttggcatccagctggcccttagcgattgcagccgggacctcacgggacttgccgtagccgacacccacggtgccgttgccgtcgccaaccaccacgagggcagcgaagctgaacgtacgaccacccttgtgggtcttggacacacggttgatggtcaccacgcgatcgagcatctcgttctcgtgagattcctcacgacggttgcgacgctcgccacgacgaccctcaccacgctggccacgacgggacttgcgatcctcgttggtagcttcagcagcagcctgagtgttctgagtttcttcagccacttgggtttccttttcgttgtcgctcacagtgccagacctccctcgcgggcgccttcagcgacagctgcgacgcggccatgatacttgttgccgccacgatcgaacacaaccgcggtgatgcctgcgtcctgagccttcttggcaatcagttcgccgaccttcttggcagcttcggtcttggtgccttcgaaacctgcgaaatcgctcatcagagtggattcgctcaccaaggtaatgcccttggtgtcatcgatgatctgggcaaccatgtgacggttggaacgggtaaccaccagacgcgggagctccggggtaccgctgatgcgcttgcgcagacgagcgtgacggcgctgaagcgcgaccttcttgcccttaccgaaaatctggacgctcattacttaccagcctttccagccttgcgcaggatgcgttcatccgagtacttgatgcccttgcccttgtagggttccggagcgcgaagcttgcggatgttagcggcgcactggccgacagcctgcttgtcgatacccttgacgatcacctggttcggattcggcagttcgaactcgataccttccggcggctcaacggtaatggtgtgggagtaaccgagggagaactcgatacccttgcccttcgcctgagcacggtaaccggtgccgatgatgtccagagtcttggcgtaaccctcgtgcacgcccttgaccatgctcgccacgatggaacgagccaggccgtgctttgcacgggtcggacgcagatcgtcagccggaacgaggatgatctcgttgccttcgacctgagcggtgatgccttccggaatctcgtaggagtcagtgcccttggcgcccttggcggtgaaggactgaccgtcgatcttgacttccacgccagcaggaatggtgacggggagcttaccaatatgcgatgccatgtttcagctctcctttctcaccaaacgaaagcgacgatttcgccgccgatgcctcgatcgaggcattccttctgggtcagcagtcccgagctagtcgagatgattgcgatgccaaggccaccgagcggcatcggcagagcatcggactttgcgtagcgacgcaggcccggcttggagatgcgcttgatgccctggatggaacgctcgccgttcggaccgtacttgagggtgacctcgagagtctggccgaccttggcttccttggcggtgaagtccttgatgtagccttcacgcttcaggatctcggcgatgttcgccttgaacttggagtacggcatatccacggtctcgtgctttgccgcgctcgcattacgcagacgcgtaagcatgtctgcgatcggatctgtcattgtcatttgggcttattgccctttctcgccgtggtttccgccgcccgcacgctccattgagcgattgggccgcggaccttcagcgtcgttatttaccaactggacttcgtaacgccgggcagctcgccgcggtgggccttctcacgaaggcagatgcggcaaaggccgaacttgcggtagacggagtgaggacgaccgcagacctggcaacgcgtataagcgcgcaccttgaacttcggcttagcggccgccttgttcttaagagcggtttttgccatatcagttctccttgaaggggaagccgaggtgcttcaggagcacgcgagcttccttgtcgtccttggtgctggtcaccacggtgatgtccataccgcgctggtgatcgatcgaatccggatcgatctcgtggaacatggactgctcagtgaggccaaagttgtagttgccctgaccgtcgaactggttgccgttgatgccacggaaatcgcggatacgcggcagagccatggtcagaaggcgatccaggaactcccacatacgctcgccacgcagggtgacgtaagcgccgatggcctgtccttcgcgcaggtggaactgtgcgacggacttcttagccttagtgatcttcggcttctggccggtgatcagggtgaggtccttgactgcgccttcgataagcttggagtcgcgagcagcggcgccaacgcccatggagacgacgaccttctggacgcgagcgacctgcatcgggttggagtagtggaattccttctccagctccggcacgatctgctcgttgtacttctgcttcaagcgcggagttgccggcgcttcgacagtggtatcggtcatgccagctcctttccggacttcttggcaacacgcacacgcacggtcttcaccttgccgtcgcgagcctcttccttttcgacgatgcgcacgcgggtcggctgcttggtctccggatcgatgaccatcacgttggagcgatggatcggagcctcgacagccacgatgccggcctgctggccctgctgcgtagcgcgaacgtgcttcttgacgatctgcacgccttcaacgatcagacgatcgtccttgagcacctgcttgacggtgccctccttgccgcgatccttgccgcgaatgaccttgaccaggtcgccgctcttaatcttggctgccatgtcagatcacctccggggcgagggacacgatcttcatgaagcgcttgtcgcgcagttcacgaccgaccggtccgaagatacgagtgcccttcggttcacggccagagccgagaatgacggcggcgttctcgtcgaacttgatgtaggagccgtccacacgacggtgctccttgacagtgcggacgacgacagccttgacgacgtcgcccttcttgaccgacccgccagggatggcgtccttgacggaggcgacgatcacgtcgccgatgccggcatagcgtcgcttcgatccgccgagcactcggatggcgaggagttccttcgcacccgtgttgtcggcgacatgaagccgcgtttcctgctgaatcattgattctccttagccgagctggttctccccaagcaccccgcctgcctgcttgaagcaggcggggtgactcacggagccttgccgaacttatttacttagcgcgctcgatgatggtatcgagacgccaacgcttggtcttgctcaggggccgagtctccataatactcacgaggtcgccaatgtgagcctcgttgtgttcatcatggaccttgaccgtacgagtggaacgcacgaccttgccgtacagcgggtgggtcgaacgctgctcgagctcgacggaaatcgtcttgtccatcttatcggacacgacgtaaccgcgacgaaccttgcggaagttacgctcttcagccattacttctcctcagctttcgtttcggtcgcctcgggggcctggctgatgccgagctcacgctcgcgcaggacggtgtacatcctggcgatgtcgtgcttgaccgccttgaggcgggcggtattttcgagctgaccggtcgcggactggaagcgcaggttgaacagctcttccttggacttcttgaggaagccctcgatctcctcgttggtcttctcgttcagattcttcatggtgtagtctgcagttccgactgccatcagatgtcaccgccttcacgagcaataacacggcacttcatagggagcttgtcgattgcgcggcgcagagcctcgcgagcgacatcctcggacacgccaccgatctcgaacatgacgcgacccgggtggacgttagcgatccagaattccggagtacccttaccggaacccattcgggtgccgagcggcttcttggtcagcggacgatccgggaagatcgtgatccacacgcggccaccacgcttgatgtagcgggtcatggcgatacgagcggcctcgatctgacggttggtcacataagctggagcaagagcctgaataccgaaatcgccgaatgcgatctcgttgccgcccttggacataccacggcggaccggacggtgctgcttacgatacttggttctctttgggataagcatttctcagctcactccttcgtttccgttgcggcaggtgcctcagctgcggccggagcctctgctgctgcgttctgctgctgggcagcgttacgctgaccacggcgcggacggcgatcgccgcgacgtccctggcggttgttgccctgctgtgcctgctgctcttcgaactcacgctcggtcatatcgcccttgtagatccagaccttcacgccgatgcggccgtaagtggtcttggcctcgaagaagccgtaatcgatgagggcacgcagggtctgcagcggaacgcgaccctcgcgatagaactcggaacggctcatttcggcgccaccaaggcggccggagagcttgatacggatacccttggcgcctgcacgcatggcatcctgctgggccttacgcatcgcgcgacggaaggtcacgcggttggtcagctgctcagcgatgccctgtgcgacgagctgggcgtccagtgctgcgttcttcacttcgaagatgttgagctggacctgcttgccggtgagcttctcgagcttggcgcgaacgcgctcagcttcggcgccacggcggccgatgacgatgcccgggcgagcggtgtggatatccacacgcacgcggtcgcgggtacgctcgatgacgatacgggacacgcccgcacgctcaagatccttgctcatggccttgcggatggcgtcatcttcgagaacgaagtcgcggtagcgttcgccaaccttgttggaatcggagaaccacttggaacgatggttctcagtgattcccaggcggtagccaaacggattgatcttctgacccatctttagcggtttccttccttgttagcgacgacgaccgtgatgtggctggtgcgcttgttgatacgagcggcacggccctgtgcacgagcgcggaaacgcttgagcgtcacgccttcgtccacataggtctccttcacgaccaggtcgttctcacggaacggctcgccggccttgtcggccttcacgcgagcgttcgcgatggcgctctccaggaccttacgcaccggaagggatgcgtcctgcggagcgaacttcagaatggtgatggcttcggtcgccttcttgcctcggatgaggtcgaccatacggcgagccttgcgcggcgtcacgcggacgtgacgagcgattgctttagcttccatgtgtccttactctcctttagcggcgtgccttcttgtcgtccttcacatgacccttgaaggtcttggtcggggcgaactcaccgagcttgtggccaaccatggattcggtgacgaacaccggaacatgcttgcgaccatcgtgaacggcgaaggtgtgtccgatgaaatcaggggtgatcatcgaacgacgggaccacgtcttgatgacgttgtgcgtacccttctcgttctgctcgtcgactttcttctgcaggtgggcgtcgacgaaggggcccttcttgatgctacgagtcatctactcgacactcccttacttacggttcttaccattcgggcgacgacgaacaatcatcttgttcgaagccttcttcggacggcgggtacgaacctcgcccttgccccacggagaaaccggcggcttgccaccgcgggtacgaccgccgtgcgggtgatcgacagggttcatggattcaccacgggtgatcggacgcttgcccatccaacgtgcacgacctgccttaccgagctggatgttggcgtgatcggagttgccgacctcaccgatggttgcgcggcagcgagcatccacgttgcggatttctccggacggcatacgcagctgggcgtaagcgccatccttagcgacgagctgcacggctgcaccagcggagcgggcgatcttggcgccacccagcgggcggagctcgattgcgtgcaccacggtaccagtcgggatgttgcgcagcggcaggttgttgcccggcttgatatcagcctgggcgccggtctcgatgacgtcaccctgcttgataccttccggagcgatgatgtagcgcttctcaccgtctgcgtagtgcagcagtgcgatgcgggcggaacggttcgggtcgtactcgatgtgagcgaccgttgccggcacgccgtccttgtcccaacgcttgaagtcgatgagacggtactggcgcttgtgaccgccgccacgatgacgggaggtcatacggccgtaagagttacgaccgccagtcttgctgagtttgcgaaccagcgacttctcaggcgtagaacgcgtaagctcggagaagtccgagacggacgcgttacggcggcctgcagtcgtcggcttataaacgcggatagccataatctagttcttcctttaacttttctcggctagccttcagttaccgaagatgtcgatcgtctggccctcggcgacggtcacgatagcgcgcttctgattgacgcgctggccgaaaccgttgcgggtgcgctgacgcttgccggcgcggttgagggtgttgacgttcgtcaccttgacattgaagatctcttcgattgcctgcttgatctggaccttgttcgcgttcggggccaccacgaaggtgtactgaccgcgatcggacagagcgtagctcttctcagaaacgacaggcttgaggatgatgtcgtgtgcgggcttgtgaatagcgaccatgaaaatcaggcctcctttgcagccggctcagccttcgcagcaaggaaagcgtcgaagccttccttggagaagaccacgtactgagcggtgaccacatcgtacgtgttgagctgatcggcgaagatcgggtgaacggtcgggatgttacgaacggaaagccattcgttcacattctcgcgagagagcaccacggtggtgaacttgttctcggtcaccggggtaagagcggcaacagcggccttggtggacggggcttcggaaacgccgaagtccacgactgccacgcgacctgcgttggcgcgatcggaaagcacgtacttgagagcagcggccttcatcttcttcggggtgcgctgggagtagtcacgcggctgcggaccgaacacggtgccaccgtggtaccactgcggtgcacgaatggagccctgacgagcacgaccggtgcccttctgcttccacggcttgcggccaccgccggaaaccataccgcgagtcttggtggcatgagtgccctgacgagcagcggcgcgctgggccaccacaacctggtggatcagcgggatacgggactggacttcttcggcggagaagccgaagatctcagccggagcctcaacggttccggttgcattgccctggttatcggtaacgttcagagtaacgtttgccatgatttatcaggctcccttcactgccgaacggacgagaacgatgctgcccttcgggcccgggatggcgcccttgatggcgagcacgccgttctcaacatccgacgaaacgatggtgaggttcagcgtggtgttggttacatgacccatgcggccagccatacgcttgcccttgaggatacggctcggggtagcgcatgcgccaacagagccaggacgacgctcgttcttgtgagagccgtgggtacgacgataggacttgaagccccagcgcttgatggtgcctgcgaagcccttgcccttggtggtaccggtcacatcgaccagggtgccctccgggaacagctcagcggtcagctcctgacccggctcgaactcttcggcgttatcggtgcggacctcagcgaggtgacgacgcggggtgacgccagccttggcgaagtggccggcaagcggcttagtcaccttggtcgggtcaacctggccgtagccaagctgaacagccttgtagccgtcggactcttcggacttgacagcagtcaccacgttggtggagacgtcaacgagggtcacaggaacgaagaaaccgttctcgtcccagacctgagacatgccgagcttcttgcccagcagtgcggtgcgattagacataatggttccctcctcccttacagcttgatctcgatgttcacatctgcgggcagatcaatgtgcataagggaatccacggccttcggggtcgggtccacaatgtcgatgagacgcttatgagtacgcatctcgaaatgctcgcgagaatccttgtacttgtgaggagaacggataacgacgaacacgttcttctcggtcgggagcggaaccgggccaaccacagttgcgcccgcgttcgtcaccgtttcgacgatcttcttcgccgattggtcgatgacctcatggtcataggacttaagcctgatgcggattttctgtcccgccattgccttccgccctttctagcgattcgttagttactgtttaccagcctgcttctcaaagggcaccggcgcagaagacccccgaaaccgtggaagttccgtggtcataccacatcagtgcgcagccatgcagttttcactctcgtgatcactgtgccacgctcgcttttttaattccaatttgcgagccctaaaatcaggcaacttctttatttaagcatcaggggtagtcttaagaaatcctcgcgtgtcgcggtctcaagtcctgttttcaagtccctgaaaacgaatgagatgcacattgccgatcgtctgttgcgatcataatgcagcatcatccgaaaatgcttttccacatataaaaaacgaggaatccggttgaacgaatccaaccaaattcctcgttatctatgatgcttgccgatataacgcaagcaccttatatataggtcactgctgatggcctatacatgaagcgactcatgcacgctcggaagcttcttccgtggcggcctcgccctgacgctggacgcgcagcttgtgtccttcggcctggctgacgccgtagtatgcggcgatggcgatgtccttcatatcctcgatctgcgggatacgcggatttgccggagcgcactgatcctcataggcacgcatgccgatctgatcgaggatggaccagaagtagtcctcgtccacaccgcactcctggaagctcttgttcatgccgagcttgttgtcacggtagtcctcgacggccttggccaggttctcaacgccctcttccggagtcttgcccgggttcacgccaaggttcttggcgatctcctggtaacgttccggagcgatgtacttgttgtacttcggccagctggtcggttcctccggaatggagccgttgtagcggatgacgtacggcagcaggatggagttggtacgaccatgggcaacgtggcacagagcaccgatggtgtgggccatgccgtggcacatgccgaggaatgcggagccgaatgccatgccggccatggtggcggcgttgtgcatcttctcctgggccttgatcttgtcttcacccggctcgccgttgacggactcggcgaggttgtcccaaatcaacttggccgcgtgcaacgccatgccatcggtgaaatcgttggcatagacggagacgtaagcctcgaaggagtgggtcagggcgtcgaagccagcatcggatgcgagcttgcgcggctgggtacgcgccagcaccggatcgacgatggcgacggacggggtcagcgcgtaatcggtgatcgggtacttgtagccggtcttgtgatcagtgatcacagcgaacggcgtgacttcggaaccggtgccggaagaggtcgggatgcacacgagcttggccttcttgcccagcggcgggatcttgaaggcgcgcttacggatatcgaagaacttctcacgcacgtcggagaaggagatttccgggtgctcgtacagcagccacatgatcttggaggcgtccatcggggaaccaccgccgacggcgatgatggtgtccggctcgaactcctcacgcatcatggtggcaccgcgctcgacggtttcgacgctcggctccggctcgacgtagtcgatgatgcggaaggtcacacggttggaacgtgcgcggagctggtcgatgatcttgtcgaccacaccgagctgctccatgaccttatcgcacacgatgacggccttctcgatgccgtacatgtcgcgcaggtacttgatggcgttcggctcgaagtaagtcttggccggaatcttgaaccactgcatgttgttgttcctccgagcgatgcgcttgatgttgagaaggttaactgcctgaacgttgccagacacggagttgccgccgtaggagccgcagccgagggtcagcgacggtgcgatggcgttgtagatgtcgcccacgccgccgagggagctcggagagttccagatgatgcggcatgcgtgcatgcgctggccgtattcgcggaccagagcctgatcgttggtgtggatggctgcggtgtggcctgcaccatgcttgagcatggcttcgcacatttcgaaggcctgttccttgttgtcggacttcagcacggcctggaccggagcgagcttctccatggtcagcggctcgttctcaccgacctccttgcactcggcggcaagaatggtggcgtcttccggaatctcaaaacctgcggccttggcgatgtactgcggggacttgcccggcaccacagagttgagcttcggggtctggccggaatatgcggtgcagccgaacatgtactgctcgagcttggccttctcttcgtcgttcacaaagtaggccttgcggcgcttgagttccttgatcagcggagcgtagacttccttgtcggcgatgatggcctgctcggtggcgcagatcatgccgtaatcgaagtgcttggagagcaccagatcgttggcggcgcgcacgatgtcgacgttcttgtcgacatatgccggagcgttgccagcgccgacgccgagggccggcttgccggaggaatatgccgccttgaccatgcccggaccgccggtggcgaggatggtggcgataccatcatgcttcatcagggcgccggtggcttcgatggacgggtgctcgatccactggatacagttctcaggagcgcctgccgcgatggctgcgtcgcgcacgatcttggcggcttcgacggagcacttctgtgcgcccgggtggaagccgaagatgatcgggcagcgggtcttcagcgcgatcagcgacttgaagatggcggtggaggttgggttggtgaccggggtcacgccggcgacgacaccgaccggttcggcgatctcgtcgatgcccatgacatcgtcttcacgaatgatgccgacggtcttctgaccggccagatagttggtgacgtgctcgcaggcgaagatgttcttggtggccttgtcttccaccaaaccacggccggtttcctcaacggccatcttggcgagcaccagatgcttgttcagtgctgcgacggaagccttggcgacgatacggtcaacctgcttctgatcgagcttttcgaaatcgtcaagagccttcaggcccttcttgaccagagcgtcgacctcagcctcggctgcggcgagcttctcttccggagtcggcttggtcggctcttccttctttgcgtctgccacttgaagtcctcctcgattctttgggggtttgcaaagtagtttcccgttattccatccgcctcgaagcggatggacgcgttgctggtcttttgtgacctaggacacactttagtgagtatgcaatatgatgttccactgtgtcgtgtcgcaagagaaatgttatcttctgttcatttaatgtttagattgcgttcttttatggaatcaaaaagcctcaaaaacatcattttgagcgtttttgttgctttttatcataaatcacacacactttctcaagtctcacctccatatcttttataaaagtattttctatatgatatcaatcatatcgagcttttacaaagtcgatttatttatcttgttcgtccaatgtattttttccgccagccagtaggagtttcgcctgtttcttcaaagaagcgacgattgaaattcgaagcgttaccatatccgcaagcgcgacgaatcgaagcgacgctttgattcgtggtcgtcagcaatctgcatgcatgcccgatacgcaatcgtcgaacaaaatccgaaaaccctattcctgcagcccttttgaacagacgagagaaagccgaaacgctcattccggcctggcgggcggccaaatccatgctaatttcaccgctcagatgcgatgaaatgtactcgatggcatcattgaccacaccttccgcaccactgcatacagccggatcgtatccggacgcaaccaccgtataggattcatctgcgggggcatgcgcgaacacatccaacacacgaatcagatcactaacacggcaagcaagactatgttcctccatgttttccagaatcgaaccggcctgacgagcggattcaccgctcagcaccaatgcctgccccgcacgtttcaacaccattgcaaaaccagacgtttccggaaatccagacatcagcagacgcatggtttccggacgcacatggcacaccacatcacgctgacgaagccgctcccccggagcgatgtcggacacccaattatgcggaagatttgaaccaatcagcgcaacctgcccggcctcatacggaacaacggcattgcccgccatcatcaatccggtaccttcccgaatcagatgaatttcaatatgaggatgatgatgccatttcgccaacgagcttgggtagccatgcttcgcccaacgcaccgaagcctgcgcgtccggcacaatgatctccaatacgccggaatcgttcgaacttccacctttcggcacgaatccaccaaaagaggtctgagccaaagccgccttcccatgccgattatcgttgacttgtgcaacagcacccatgacacagacccctttcgtcgttccgtaacgtgcgtaacgtcagtcgtttttcacggtaatctgcagcttaatgtctccaggacgcccctcagccatgcgatcgaacgccgcctgggcatcctccatcgcataggtgtcggtgatgaatggcttcagattcagtttaccgttagccacgaggtcaatggccttctgatacacattggcataacggaagatattttcgatgcgcacctcggtagcctgcagctccgtaatatcgatggccaccggattgaccggaatgccaacgataacggcagcgccaccgggagcaatcagcttccagaatgtctcgtatgacttcggcgagcccgagcactcgaaagccacatcagcaccccagccccccgtttcctcgcggacgcgctccaccagatcctccttggtgagatccaccggaataatacctggaatctgagccgcaatcgccagtttgattgccgacacatcggagatcagcaccttggaagcgccacccgccaacgcgcacgacgcggtcagcatgccgaccgtgcctgatccggtgaccacgcagacatcgcccggcttgatacgagccttggtggcggaccacatgcccacagccaacggttcaagcagcgcaccctcaccgaagctcacattgtcgggcagcttgtaggtgaacgccgcaggatggttcaccgtttcgcacaggcagccatcaatcggcggagtggcaaagaaacgcaccgcaggatcgacgttatacatgcccagtttgctggcacgcgaactcatatccggaatgccgggctccatggccacacgatcgcccaccttgaagccttcgacgccaggaccgacctcaaccaccgtgccggaagcctcatgaccgagaatcatcggctgctccaccacatatttacccacgcgaccatgcgtgtaatagtgcaggtcggaaccgcacacaccaacggtatgtggcgcgatcttcagctcgcctagaccaggtgcggggacgtcaggcacctcacgcacattgatgacgccctgctcttcgagaacgactgccttcatgattattctcctttgtggataatgatgttttttttgagaaaaatgatgattgagcaattgatattcaattgcgattagttacgttcgatcgcggtaatgcgatggccacgatcgtcaaatccgggttgatgaggatgaatgccgagcgtgaccaacgatccgatcgcatagcagatcgcatacgtccagcacacgccgccgaatccgatagtggaaatcagcaccgtcgcaatcagcggaccgaaaaacgtagtcaggccggaagcgagattatgcgcggaaatcgcagcacccttatgttccgacgccaacgcgggaaacacggctcccataggaacgaaagcggaaattcccaatccaagaacaaccgcatcagcacacataagcaccatattcgccccgaaaaactgcggaatgtaatacatgcccagcgtgccgatcacacagaaccagcagccaaaccagcgcatttgccgcatccaaccatgcgaatcgcccatacgaccccagaacacattgccgaaaatggtgaccacaaactggaatccccaaatctgactccattgcgaaaccttaaaccaagcgccgccgccattgttggtagtggccaagtagagtggcatgatgacgggaaagccgtacaacgtcagattgcagatcacacgcaccaccgcagccaaagcgatttggcgattatgcaccagaatggtgactcctcgactaagctcgcgcagcttgtcggcattgctcatggaagaggtgtcagcacccttgcttttcggcaccagcagcaggcaaatcagcagtccagctatagaaaaaggcaacgaaagccacagcgagtagtactcgcccaccagcggaatggtgaaactcggcaaatatgcgccgaacacgccaatgccgaacgagtaggcggcccaaaaccaccccatggccgacgcgagcttggcagtatcgatggtttgcgccatcaacaccacgaacgagtagatgaacagcgggtagccaacaccccgcaacgcatacacgcctaacatcagcggatagacgccgctcggcagcgccacaccaacgaacagcaggtgcaaaacgacccaggcgctcgcgccgatcagcatgatgcgtttggcaccgaacatttcagctagcacaccggacgcccagccagcaagcgcagccatcagcccgtacatggtgaacatcagcgacgattgtgaagaactgaatccctggtccacgatgtatttggacaaaaaagtcaattcaaagccatcgccagtcatgaacaccgctatggcgaccaagccggccaatagcgtgcgcggcagacctatcttcataacatgtctcttttcttggtagaacgtcgttgtcaccgtctcaacttttttgttgataaacatattttcgacgcaaaaaagtggcagaaaatcctttatgcacagctatttttgatacttttttgcaatacctgatatctcagaccaacacgagacataaggaaaggacttttatgaagtagtcttgaaaaagaagttgcgcaggaaggatcaaccagtgaaagcccaatccgccctatcagtcaaagaagccaatctcaaggccatgaccgcgttcatctatacccaaggttcagccaccaagcagatgttcgaacacgaattagggctcagcctgccaaccatcacgcagaatctgcgcgccatggaggccgacgggctcatcgtcaaaggcgagatgcagcaatccaccggtggacgcaaagcgcaaatctacgaattcgcggcacactccagcgtggcgatcggcgtgcgcatccaaaccacacaaatcacggccatcgccattgatctgaacggcaaatccgtagccaccagacagcgcacactcccctatcgcaacaacgacgcctactaccagcgcatgaatggcatcatcaacgatttcgcgcaagaactggcgaaacaaggcagcacggtactcggcgtggccttctgcatgcaaggcatcgtgtcggcggacggccagtcgatcactttcggcaaaatcatgggcaacaccggcctgaaactcagcgaactcagccatggtctcaaccatccgtcgctgatgattcacgattccgacgcttctgccatggcggaactctggttcgaccacaatctgaaggatgccgtctgcatctacctcgaacgacgcccaggaggcgcggtcatcgtggacggatcgctctaccaagggccaaaccaatgcaatggctcaatcgaacatatgacgctgattccaggcggaaacccttgctattgcgggcaattaggctgcatggacacgtattgctcgccggaaacgctgatggaggacggcgaaagcctgcccggcttcttctcggtattggaacaaggcgagcaggagcatcgcaaacgattctcgcaatggctggattatgtggcgctggcggtaacgaacattcgctcggtgctggccggtgacgtgatcatcagcggtgaggcagcacaatatctcgatgatgacgatatggccggactacgcgaacgcgtggtggaacatacgccattcggcaccacggatttcaccctgcgcaagggaatggcgctcgaccatcaagacattatcggcgcggccctgcgttttgtggaaccgtacgtacgcgaactatgcgatatgtgaccgcttttacacatatattaatcgcattaatcgcatcgcttgcataacaaaagaagcgtgttgccgaacccgtatataaggttcaacgcacgcttctttgttcgcttccgtctgcttcacttgttgtattttttcagcgattatttgacggtaatcatctaatgatagttatttgacaatctggcagaattcgatggtttcgccgttcggtccgtatacattgaagtagcgaatgccgtgctcccagaagctgtcgatatgctgaatttcagtgtctttgaaattcagtccgagttccttcgcgttttcgaacgcggcttcaatgtcgggagtatcgaacgcccagtggttgatggcaccggtggtcagcggcgctgggtcgccttcccaggtttcgatggtcagatggccgtaacgcaggaatgcgcaacggttttcaccgttatggaacagtcccgccaactcgaaaccgagtttcttggtatagaattcgatggtttcgtccagatctttcgccggcatgccggaatgctgcagatcggtggtgaattcagacattggtttggtcataataccctccttgtgatggttggtacgatacgtttttcccttttgtgattaggatatgcgctatgcggcgatgtcagcggcgcatttgccgtcatatcgtgacacttttttgctaattccaggctgttcaggacgaataaacagcgtcagcaccgattttgacgacagccttggaagcggcggcgattttgccgtcgaggaagtcctgcacctgctcgagttcaagctcacggccggatcagaccggcacgagcgtcgacagcctcgacatagtaagtcaacagataatttcaaagtgtttagaatgaggttatgaagaacccgtctttgcaccgttatgcaactcgtccaggtctctacttcaccgatgatggtggggcggatgccatcgtccgctcggaaacagcggaccaagtgtggttttgcgtacttgagccgctcgaccaacccagtgccttctatgccgacgcagtacgattgttcaacgagccggggctgaccttcatcgatcaggcgatgaaacagcgcatctgcactcggcgaatcccctcgctcaatcttcgcgaaacactattccgcatggacgggcccaattacggactgtggtacgtgcacgtgccgcaagcatgggacggcatgcaatacggataccgcgtcaacggcccatgggaccccgaccacggcgtgagcttcaacccgtacaaactgttgctcgacccctatgccaaaggcatcgaaggatcaatggagcttgatcccggagcgttctcctatgaatgcgagatcgtgaacggcaaagtcaaaggttcgccattcggcccgatgagcaccatcgactccgtggggcatgttcccgtttccgtggcgatagacgatcgtgccaccaacaagcatgacggtgagccatcacacccgcatgtggcatggagcaaaaccgtgatctacgagctgcatgtcaaaggcttcacagccaacgcgccttggcttcccaaagagcttcgcggcacctatgcaggtttggcacatccggcgacgctctcctacctgcaggatttgggcgtcacttccattgagctgctgccgattcaagccaagcaatccgaactgtttctgcaggaacgcggacgcgtcaactattggggatattcgacgctcggctatttcgcgccggaagcctcatacgccaccaagcgctcccaggaggccggtgcggccgcagtacgccaggaagtcatcgacatggtacgagccttgcatgaggccggattcgaagtgattatggacgtggtctacaaccacacctgcgaatccggtccggaaggaccgaccgtatgctggcgcggactcgacaatctggcatattatcgacgcaccaaagataagatcagccgcctgtacgacaccaccggctgcggcaacacgcttgatttcaccaacacgcacgtcaccacattcgccgtggattcgttgcgctattgggccaaacgcattggcatcgacggattccgattcgatctcgcggcgacgctggcacgtctcgacggtgaattcacccgctaccatccgttcctgtatgcattgcgttccgacatgctgctcggcaatctcaaaatgatcatggaaccttgggattgcggtccaaatggctggcgcaccggcgaattcggcatccccttcgccgaatggaacgacaggttccgcgattgcacacgcaaattctggctgaccgacgtggatcgcacacgcagcggcgaatacggcgaaatgaccatgcaagacatggccacacgcctatgcggatcttccgacctgttcgccaccgaccccggccgcggttcaaccgcctccgtgaactatgtggcctgccacgacggcttcaccaccgccgacctgaccatgtacaagagcaaacacaacgaagccaacggagaaaacaaccacgacggaacaaacgacaaccattccgtcaatttcgggcatgagggccccagcagcgaccaaatcatcgtgcagcagcgccagcgtgccaccatgaacctgctgggcacgctcttactgtcgttgggcacgccaatgctgctcgccggcgacgaattcggcaattcgcaaaacggcaacaacaacgcctacacgcaagacaatgacattacatggcttgattgggattggctgtacagcaccgagcaaacgccggaattgaagcaattcaatctaacgtcacgtttaatcacgttgcgaaaatcccacgatttgtacagtcatgaggatttcttcacgcgcctgagcaaaatcggtttgctgaagaaatccgatcgcgtgcattggtatcttccgaacgggcagatgccggacgattcggattggacgaatcctgccgtacgctcgttcgccatgcaactgctctcccccgacgagcctagcctgctaattctgattaatggttccgacgaagtcacacgtttccatcttccgaaaggcattgaatgggagatggtctggtcttcatcagagatcgtcggcgaatatcccggtttgggaacgtccatcgaacgggtatcagaattcgacgcagagtcggaaaacaagccggcaggtagactgcgcaatcatctgcaccgcatcaatatgatgtactggcagatgcaagacaatgaagcaaatctgcaatctgccgacgatggattgtcggaagacgatccgacattgtggacgctcccggcgttgagcatcagtgcgatgaggcagatgccgaccgcctgattccatcaagctctgcctgaatcgttcgaataccaagaaacccctcggaaaacgaatttccgaggggtttcgtataagccgtaaagctttagcgcttcgagaactgcggagcgcgacgagccttgtgcagaccggccttcttgcgttccacgacgcgagcgtcgcgggtcaggaagccagccttcttcagggctgcgcggttcgcatcacgatcgatggcgttcagagcgcgggcaacgcccagacggattgcgccagcctggccggtggtgccgccaccgtcaacgaggacgatagcgtcgaacttgccttcgagcttgagaagcacgatcggggagttgacctcacgctgcagcagcttggccgggaagtactcttccagggtgcgaccgttgatggtccacttgccggtgcccggaaccaggcgaacacgagcgacggcttccttgcgacgaccggtgccgtagcccggagcgatagcggaagtaccggtgccagcgccagcgttggtttcggtggtgtacgaggtgagctcctcttcggtctcgagaaccgcggagttgttggtgttttcagccatgtttcttatctcccttcggttcacttagcctgctgcgagacctgagcgatctcgaaaacctgcggcttctggccagcgtacggatgctcggtgccacagatgatgtggaggcgatccagctggaccttggccagacgattcttcggcagcatgcccttgatagcggacttgatgatgcgctcagggttggtcttgagcagcttgccgtagctatcgcgacgcaggccacccggacgaccggagtgcatgtacagttccttacccaacttgttgccggtcagagcgatcttatcggcgttgagaatgatcacgtggttgccggaatcggcgtgcggagcgtaggtcggcttgttcttgccacgcagcaggatggctgcctgggaagcgagacggccgagcaccacgtcggtggcgtcgatgacgtaccagtcgtgagtcagatcagctggcttcggagtgaaagttttcacgatgtaccttttctatatattgtgttccggaccttccatcaacatcaatgcgttggttaggcgcggaatgatgccgttttcaggtctcattatccgtgggctccctgaaagtcctcgatggcgagtgggaaaagcgctttgaaggaccccgtagggaaacacaacaatctactagtatatcgccagccttgacatttgcgacacatcgtatagcgaaatcaacgtaaaataactctttttcacagcaacaaaaaccggcgatacgcaaacggacgttccgtttcatatcaccggttttatatatctaatatctgatgccaaacgcgatcagccgcgcataatcgctgcgatctcctgcagtcgagtattgccgaacaattcttccagaggcacgacattgccatcgccgtcagccaaaggaatacgccaattcgggtactcgttgcaggttcccggctggttctgcgtgcgcttttcgccgaccgcgtcgacgatggacgccgccatgagcttgcatggcgatcccttcaaaccgcggtacagcgcgtcgatgatctcgttttcgttggcaagctcgtcttccagcgcggaagcgtcgagatagccttcgtcgacaagcatgctcagcatggcgttatgttcggcttccgcggacttctggaattcttcgaccggaccggacaacaatcccaactgctcgcgcagcttgacatgcccatactccaagtagcctgccgccggaggcaaatcgtgcgtgttgacggaagccagcgcatacggacgccaatccttcggtgcacggaacacaccgtcgaactgttcgaaccattccactgcgcaaccgagaatgccgtgctcggacagcgatttggacacataagccggaaccacgccaagatcctctcccacgaccacgccaccggcgcgagacgcttccagcgcgagaatgccgagcatgatgtcagaatcgtaatgcacgtaggtgccgtccatggccttcctgccttccggaatccaccacaagcggaacaagccaagaatatggtctatacgcaccgcgcccgcattggagaacatgccgtgcaccatgtctcgatacaccttgtaaccggtctgatcaagggcaatcgggttcagcggcggctgactccaatcctgaccctgctggttgaacatgtctggcggggcaccgaccgtggcgcccttggcgaaacgctcaggattccaccacacgtcggaaccggccgggtgcacgcccaccgccatgtcggcgacgatgccaatcttcatgccggcgtcacgcgccgcctgctgggccgcatgcagctgctcggtggcgacccattcgagccaacggtagaattcaagcgtgtcaggatactgcgcgcgaagctgcgcgacctcttcggaatcacgattgtacttacgcacccaatcgttgtcgccgccattggaggcgccccacttgtcgtagcacaggcaccacgtggcataggattcgatctcatcgcccacttcggcgagatactggtcgaactcagcttgacgctgtgcggaaagacctgctttgtagatgatccacagcgcctgcatcttagtgcgccacatcgtttcgcggtccaaaacctgcgcatcgccgttgagaggttcgacctgctcgtgcagtgcatcgaccttcgccttgtcttccggcgaaagcgtggcatattccggcatggattccggacgaatatagctgaagttgatgaaacggcgcgaaatcggcagatacggcgacggctcgatcggtggcaccggctcggcggcatgcagcgggttgatcagcatgaagtcggcaccggtcttcttcttggattcgacgagcagggtcttcagatcctcataatcgccgattccccaagagccgctggaacggatggaatagagctggctcatccaaccccacagggagcctttcttcatctcgtcaagcagttcgatcttctccggagcactaataacggttgcagactccgtcttgccacccacggtgacttcaagggtgtgatacccttcgggaaggtcttccggaagcaccaggtacgacgtgcacacaaatccgccatcgacctcgaccgcggcaccgctgccgccctcatgctcgattttgccggcatacgtctcgccatcttccaacgtgatggaagctgcgggaacgtcaagcgcgccgccgtggacctctactttgctcttcttaccgacaatatgcagcacggtcggaggaacgattcgggtgttgcgttcacgctgaatggtggtgatggactgttcgatcgcatcatcgttggaagcgtcgattccaagtgccttgagcaccgccacaagaacatcgtcttcgatttcgtggtagtcacggctcataccgacataactggtggcgacacccgccaactttgccagacgaatgagcggacgggctagacgcgttgcattttcggtctgttctgtcataagcaacagtctatgccccaatcacatgcaccacgcgcaaaaatctcataaaaatgacaacgtatgcaactatttttccgaaagacgcttttcagcggccctttttacttctcccgacgcatcctgcgcaagtttttccagcatctgatcggatgtgttcgggttcactgcaacggccctgcgcaccatggaagcgagcaccgccggagcgttcggctcgatctcggttcccaaggatcccaaaaaatcaagggtttgcgaatccatatccggatcctgcgcgccttcgagcctcatcttccaagatgtccgcttattacgcaatgcgacatcgcgcacttcgggggacgcatccttggtgagacgccccaccagccaattcttatcattggaattgccggcaacggctttgcgcacctcaacggattcgtcggtggacagtttgacgagaatattcggaaacggcatggtttccgcgaggaaaacacgatcttccaacggcgtatgcgcattgcctgcgacagcctccagcagtgccgtggctcgcgagaacgcagcctgttcggaacggtcaggcaatggccggcgcgcgaattcactcagttcagcggcatccgcggaatgccgcaaacgctcgtaagtcgcggtcagaggctcgaaatccgaaggaatctcctgaccttgcgattgtgcggattcgttctcggcattgccgtcttgtttgatttcagcatcggtcatagttttccaccttacgtcattgtcttccgggattcacattttcaccggacgattggaagttcccgttttctgcggagtcacggttgcattgaacgtttcgaccacacgcgattcgaattgctgcgattgctcctgtggcacgacaaccgccaatacgatgcgatcggtgtactgcgcgtccgcctgctcaccctgcaccgaggcgagaagattctgaaaactgcccaattgtgagtagtcgagcgttacctgatattcgctacacggtacgattttcgctttggtcgccactttgacggcgatggacgcacccgaggaatatgcacgaatcagaccgccggaacccaataggatcccaccgaaataccgggtgacggcaaccacgcaatccgtcatctcgttggcgcgtagcacgtcgagaatcggcttgccagccgtgcccgacggctcgccatcatcgctcatacgctcggccaaacggccgtcggagccaccgcacaccgcagcataggcaacatgacgggctttcggatgctgatcacgaatcatctgcacaaacgcgagcgcctcatccaaggaatcgatatggcaggcgtcgccgatgaattccgatttcttctcgacgaacgcatcatgcgcgggctgatcggcggaatcgagtatggtctgcatgtctttcaacctacccaatcacgccgaccgtccgtacgtttttcttataccgtttcatgcgatcgctcacacgacgacgttgaaatcctcgcccttaaagtaagccgcgaccgattgaacaacctgcttggtgatgcccacatatgcgccgtcggtgcgccaggcggtgtgtggggtgaggatgatgcctggaatcgagcacagcggatcgtcggcagcgagcggctcatggtcgaacacgtcaagcgccgcaggaatgtcgccgcgctggagtctggagagcaacgcgcctgactcgatgatttccgcgcgggccgtgttgatgaacatggttcccggtttcagagcctcaagattttgcgcggtgacaatgccttttgtggagtccagcaacggcaagtggatggacaccacgtcggatccggcaatcagttcgttcatatcgtcaaccggagtgacgttcaggtcggtgagcacctgctcgggaacgtgggagttccatgcggacacgttcatgccgagagttccggcgatacgcgccacggtttggccaatgccgccaaggccgatgatgccaagcttcttaccgtacagttcatagccgtcgacaccatcccaattgccttctttgacttgcctgtcgagtttgccgacctgcctggcgagttccatgagcaatgcgatggtgtgttcggctacggcatggtcgccgtagtgcaccacgttgcatacgcggatgccacgttccttggctttgtttagatcgatgtagctggccacgccggtgccgccgaaagcgtagcatttcgcgttcagacggtcgaggatcgagtcggcacagtggaatccgatcactatgatggcgtcggcttcgacgcaacgcgcgacgatggtgtcttcatcgagcgtgaaatccttgtacatgcgtacgcgggcaatgtctttgaacagctcgaagttcttttcgaacgattcaatcatcgattcgatgatgacgggtataaccaccagcggcagatcggtacgttccggctgggtttcgtagatttcatccatgtctttcacctcacactgtgtgttcaagcggttcttccgcgttttcaaccaacggtacgaggcatattgtgccatggaaaactactcgccagatgaactcgcccgctctgcggttatattccattccttgaccacgttttggtcggcgcccatggaatagagcacgtcccagatgcgttggcgcacattcgcgtcttgcgtttcatcccagcaagggccgtccggatggtcgcttgccagcgaacaccattggtatttgccttgcgtcacattggcgctgggcacccagtcgatacggttgacgcgccacgagcctgccacgccttttttgcctgcgaattgaatgcgcgcggtcacaccttggttgtttacgatggtgtctgcagtattggccgattcggttacggcattacccaaaccgtagatgatccaagtgccgttatagttctcgatcggctgcgcgcaatggcaaccggcaccatagatcacatcaaatgcgcccgtatcagctagctcgtgcgcttcatcctgctgccaggaatcggcgtagtccaagtattcctgcacggaatgcatggccatggccaccacgtcggcaccttgttctcgagcggccttcgccttggccacggccttgtctatatcggcctgatggttcggatctccggattcgcgaaggcgatccacacgccagtcgtagtcaggcgtttgcgcattcaacgatacggttcccgcaacgagtccgattttgccgccgcccgtcggcgaatcgatgaccaacggctcatacgaatccttttcggttttataggaaccggtttgcgctatgccgtcctgttcaagcgtgtcccacaaacgtgcgatgccgtcggcaccttgatcccaagaatgattcgaagcatgagtgcaggcatgatatcccacatttttcgcggcatcggccacttctggaggaatattgaaaatcggataggcggaatatggaccgccacgttgtgcgataggtgtttcgaattcacatacggcgatgtcggaagcttcgatatatttgcgcatcggttcgaacagaccggtgaaatcaaatgcggtgccgtcggtggccgcggtgttggcgctggcatactggttccacaatccctcatggaacagcagatcaccgttgacaagcatggcgatgcaatcggtatcgggacaatctggggaattgccatgatgctccgcaggttcggtcacttgtttcttttcaaccgtttttggctcgctcaccgttgttgccggcttcgtatcggcatcactctgctttgattgaaggctatgcaccagcagccatattcccgcaacaagcacgacggcaagcacggccaacgccgcaaacgcgagcctgcgtcgaccggccgcaagcacttccgtgttggttgcgtgcactgcctcttttctgtatttcacggcaccccgccttcctctgaaaccttctcaactcttcaattcaagaataacggacgcaccacggtttctacactccgaagctggcgatgttgttgccgtatttttgacgcaccgcatccagtgccgcttccgcaccacgcaaacgttttgcgtgggtccgcatttgcgcaggttttgcctgaaccgccgcatgccgttcggcttcgttttcctccagcagatcatccagtgagggctggatcgcagtctcttcggcaagcacaagtccactggcgctcattcccgccaaacgcacgggtcgagcaagggaaatggcatgcacggactccggaaccatgcccatcatggcgagcagcaggtctacgcattgcgggtaaagcacgctcgccgcgtccgtagggcagtccagcgtgcgccctttcgtcgcataactcaagtccggaaatcggagtttgaccatgaccttgcgtgcgaggaaaccacgcttacgcaacgatgtagccacgtcatcgcaacaccagcgaagcatagaacacacctgtcgcatgtcttgtgtgtctgcttcgaaggtgcgttccgcaccaatcgatttttcctgcgtgtatggcacgacgggcctatcgtccaggcctcgggacgcctgatacaggccgtgtgcggagatagcagatccggtggcccgctccagagattcgagactcatgcgtgcaaggtcggcgaccgagtcgatgccccacgcgttcagacgcttttccagagaaggtccgatgccgggaatgccacgcaatggcatcatctgcacgaattgcgcatgccgcgccacgggaatcatcaacatgccgttgggcttggcattggtggatgccattttggcgaccagcttgttcgccgcgatgccgacggaacaggtgatgttgtagcgcaaggccacctgttcacgtatccacgctccaatggcactgggactgccccaccgcagcaatgctccggaaacgtccatatagcattcgtcaaccgatacctgttcgatgcggccggtaatccgactgagcacttccttgaaaatgcgatgcgacatcgcgcgatagtaactcatgtcgaccggaaggaaaatgccgttcgggcatagcttttgcgccctggaacttgccatggccgagttgatgccgtattgccgtgcctcgtagctggccgcggacaccaccgaacgattgcccacgccgatgatcaccggcctgccacggtattccgggtgccgggccacttccaaagacgcatagaaagcatccatgtcgatatgcagcaccgtgcacccagcctcgtcatggccccagtcacgtttggctgctgcgattctcggtgcggtactcatgattccatgatagctgttttttcacgttcctttgaaacaaatgttcgaatatcgcagtttatcttatgaaaacggcgtgtcgacagttgcgatttcataaggcacgcacatgcatacagcacggatttttcccgatatttcaacgttctttcatctttttttcgagatatggtgttttgcccgcaaatggatggtatagttgcatgctgttgcgccgtgaaaacggtaaaacagtggagtcatgcctgagtggccgataggggcaccctgctaaggtgttagtcgtttttagcggctcgagggttcgaatccctctgactccgccttgagggttttcggagaaatccggaagcccttttttcatgccaaaacgatggaataccaacgatttcaaggcatccaaacgcgacgatacacatgggcgacgccatgaccgacatgctcaaacagcagataaacggcaaggctcctaccgactacgtgatatccgcacgacgccgaacagggtctttaatggcccgagcctccgcgagacgccaccgacgaaccagacgacggaaacggtgaaaagtcggataatcagtctcgaaatcctcctgcacgcgcaacggcaaaccattatgcgacagggacgatccataaagaccgtccctgtttacatatcagtatttatacatcaacggcatgccgtcacaggccgaatgcttttcgatccgtttcggtaagccaatccgtccgcatgcccggtttttggcacaaatgcatggctgggcattcctcaccgatgcaaggatcccatacaggaagcggcgttccgtcacggtccgttccgttgggatcgccattggcggcgaaattggtccaatacagccccattcgccttgccagatcgtaatgccatccaacgaacggacgccagcatttcgcaaggcttccaaaggagaaccacagatcggacgagtggaaggctccggcatcatcccccggcatagcgacatcgaaatgatagtagtatggcgcggtcccaccgcttgcggtccatttgcggatcaacgtgagattgccgagctgtccgacatgcacaggcttcccatcttcagtcgaagcgatgaactcattggtcgtgttgccgaccagcatgtcgacgttgttggccttgcagccctcgacgatacgctcctcctgatcgggaaggaacaggccgtccacgcatggcacccaattgacaatcatcgaccagtcatcttcacgtccgctgtccggtggaacaggcagggactcggcggcttccaataccgttcgggccgggattgcacgggcctgctccagcgtggagacacccaatgcttcgaacagacggattccgttggcctgcgcatgctccagcgtgtcctgccgcgcattgaaataccctaagcctgcgccggattgcatgatggctttctgaaacaggccatgattcatcggcgagcagatctgggccaagacgctggcggcaccggccgattggccgaaaaccgtgatgttttccggatctccgccgaacttcgcgatgttttccttcacccattggattccggcacgctgatccaggaatccgaaattcgcatatggttcgccgtcgccgcgttctacggcctcctcatgaagcaaagggtgcgtcataaacccaaatgcattcagacgataggccacactgaccacaacgacgccgttcgcggcaagatgtgtgccgtcgaattccttttcaaatgtgccgccacattgataggctccgccgtagatccagaccatgaccggcagcttttcggaggctaccatgctatccgcgccatatccgcgtaatgccggagtccaaatattcaggtagaggcaatcctcgctcatcggcacggccggatcagtgccccattcacgatcatagaaatcatcggaggcgcccggcgtcggctgcatcgcggtaggcccgaaatcgaaggcttgcagcacaccatcccatggcagggccggctgcggcgcacgccagcgcagaccgccgacgggaggctgggcgaacgggacccctcggaacacggtgatgccctgatcctcagccgccaagccttcgacagttccttgcgacactatgacctgtcgcttcattgctctctttccttcgtatccggcgtcgaatacgcaaagtcgtaaaaatcggcgattccaccggtctcttttgtcgaatacaggaacaatccgatacggcaacctgtgaaatgatccattttgaagaccatccggtgcgctgtccccaatggacaccattcggattccggcgtatccgcatcgcggtagaagaacgtcacttcatccttgcaatcggtgaaatcatataccgcgcgcaggcgcatgcaatccgcatccgccatgatttccgcatccgttacggctggactgtcccaatcatcgtcggagaagatggaatcgtcattcgccggcttgtattggacggtcagcatcgtgcggccgttccttcgcgtaagcgcgatgtaggaatagcatccttggaacgccgccaatccggcgaagtcgccatcatgcaatgtcgacgcgtcgacggtgacttcggccaccgtcaccggccccatcgtgcgctgcgtcagcgtattccatgcatgattgagattcgagctgatgcgtccggaatgcaggcggaatgctcccggacgttccgtcagtgaccagtattcgttatgtgggatgtgattgaactgccagtatggctgcagacagttggcatcgactccgccttcggcgttatgccgggctatgaattcgctgccgttgatgggcgtgacaggttcggcacagcttgcagccggcacgctgaccgactgcggcactttgccgttctcgccgacgacggggaatccgtcctcgccgaaccgcatcggcatcagtatcggcacgcgtcccacaccgccgcggtcctgcatcatgaatgcataccagtcgccgtccggagtgtccaccataccgccttgcgcgactccgtaaccgtggaaggacaggtcgtcttcgataatttcacgcacttcgaaagcgccatccaaggattcggccatcaagcaggcttctgttttgcccttgccttgcggaaagtgacaggtgaagacgtaatagcgtccatcatgcttgtacaggtgactgccctcataaccaaggtcagcctgcggatcgtcctgcacgatgacccggtcgagcccacccggcatcggcccgcttaattcaggattcaactccgtgatgcgcaatgtcgactgtccatgtacgacataggctcgatcatcgtcgtcaaagaacagtccgctgtcgtaatagaagccgtcaagctcacgctttcgccatgggccgcatggatcgtccgccgtcagcagatagctggcatgcgtatcgttggcggcgaacaacacataccaggtgccccgatggtaacgcagtgacggcgcccacatgcctcgaccgtaggcgttggcaccttcacattccaaacgttcttcaggggtatccgccacgatattcaatgcgtgcgcaatgaattcccaatgcactaggtcatagctgcgcagaatatcgcacccgggtgtgaaatgcatagtcgtagtggccatgtaatacacgcccccgacccggatgatgtctggatcaggaaaatccgtgtagaccataggattagttgaggtaatcatcattcataccgatactttccgctcaacgccagcatggcgaaagcatagaggaaattgtcatagtaacgacgcgtgccggttcgcatcggcgtattccacagcatgcgcacccattcacgggcattatgctccgcgtcgggctgggccgaatgcaccgccgcaagtgcgccttgcgcggtcgcggccaggaatccgaccggatgaagcacgacctcgtccacggcggtgccgtcgatggcgtagacgctagtacggtcgtgggtcaggaagaatcgctgcagcgcggcgacgcggtcgcacagcacttcctgcggaccgttccaggctgcatccagcccgatattcgccgcggtacggtaggcgtcggaatagaaatgccaatgattggactcgtcgacatgcggctttccgtcataatccgcgtattcagcgttcatgccggtccgctcgtcgcaggccgcctgcagatagcgacggcttgcggcggctgcctcatgccaaaatggacggtcttcttcgtcggcttcttcggcgaatacttcatagaagtgcggcagatggtaggacggatcgctccactcggtttccggaatgaacttgatgagcttgttgtcgggattccacatgggctcgccgtcgtagcgttcgcccttatgaacgcaatatctcaagatctcgcgtccccatgcggaatattcgtagatatcctcgccatcaccccagcgacgggaggcgaggaacagatccatcgcgaaatattcctcgccgtcaggtgcaggaccattcgagttcggcgtaccgtccggcgcgaccgaccatgcgaaataatgcgcatgatgaccgtcctccatgtacatgtgacgcattacccagccccacagcttgtcgaatacgtccttacggtcgtattgcagggcgatcatcatcgcatagctcataccctcggtacgtacatcgttgttgccggtgtccatcacataggcaagaccttcgtcgttctcccaatagaatttgttcggaccttcgaaaatttcatgccagacctgtgacacgcgcttatcgatggcgtcttgggcatatccgcactgtgcgaacatggactcgcccaatgtcttgctggtatcggttgcatttgtcatatcagttgttccattcccagattcggatgcgattctctccggagacaagaccattcaacgccccggccttgcgttccgttgccgtcaagtcttgttccagcaagtcggtgtccagcacatagtcactgccatcgggctgttcatagcgttcctccacgatgcgaggcacgccgagcatatcgctggtgacgacctgcatcctggtatcggcgacggcctgtggcacagtgcaccgcaggtacagtccatcgggttcttcgaccaatgtcaccggcatgggctcatcacacgcaacgctcgtggaggcggtgccgccgaagaacggggcgtcctcctgcatgcgctccgaatcgtcggctgtaccttcctgcttgttcagcccctgtgcgccggacagatagatgttgccgcccgcgtatagagactgcagaggattgcgctcgccaccaccctgcgaaggatctgcccacatggcccgctggcgttccaagtattcatgcatcgacatcgggcaatcgctgtaggcggacaaaccatattcaccgacagtcggtttcaccggttgcggcgcgaacatgttgttcagccaacgctcatcgccgccggacaccacagcgcacccggccacctcggtggtgtgcggatagtgatacggcgtggaacggtcggggacggtatgcggttcaatgccgccgcaaatcagattgttgacgaaggcaccaccttgcgaccagttctggaacatcaccggcgaggcgaaaacgttattgtccaccagatacggcccatgactcacttcaatcatgaggtcacggacgttatcgtggaacacattgcgcgtgatgcgcgtgccctgcgtctgccaatccatccacatgcccagcgagcagtcgtggatgttgttgttggcaatgaccgtatccaatgcggcatggaatttgatgccagcgacctcccatccgaagaattcacgcttcaacgcaatgtgatggacatggttatgctcgatacggcagaatgcgctgcccatatgtccgacgatggcattctgtccacactcgtagatgtcgttgttgcgtacgatatgaccgccgatcagccccttttcccagccgatgcgacgggccttgaacacggcctccaactggtactggtaaccggtcttacgctcggttttcgcccactcgttgtcgccggatgagatttccttgcccaatgacaccgcggagaatttggcgtcatgcagcacgttgtcttcgatgatccagccatacgaccagttcgggccgatcatgccccactgctgcgaggtaggcggcgcccaatctccagtggcctgcgccatttcaaagccacgcacggtgatgtagttgacatggttgcgggcagggaagaagcatgtgcgacgaacactgacctccaccagttcctcattcggatcggcaccttggaaattcgcccagatcgttgtggtgccggcattctcgtccacttcggcatgccatacataacgtgtacggtccacatccggcacagggcagggaatcttcaacgcgaaatcctcatccgtatcacgcggctgcggatcgtatacgccttccaacgtcgtcgattcgaagaaggaaacaccgttgagatacacatcgccaagatgtttgtccggatcctcgccgaacttgggcatttccagccagtcaccgaaaatcggggtcgcgaatggattgaaatccccgaacatcgtattatcaagcaccaccgtccacacatgcggatgatcggccaattccgtccagccctgcacgcattccgagcctttgataaccggccgtgcttcgccttcggctccgcagtaggtgatgcgctcatgttcactcagaccgccgcgtttcggatcgacttgttcgcggtatacgccttcatgcacgattaccgtatcacccggagaggccatctgcgcggccttggaaatcgtggcgaacggatgctccgcgtcgccgcacgcagcatcgctgccggttggtttgacatggtattcaaacttcattgctgaatctccttattcacacatgttcctaaaccgtgacagtaacgctccgccatggttcgcaccaaccccataccggtacgtcctgctcggattgcagcacacatccgtcatcgaaaatcttcggcatcgcaagcatcgttgctcttccttcttccatctttgacaagtccacataaagcctccatatacgattcatgacggcttgcatacgtcagtggcgacgaaaacacagctcccgtcgccaccaaaacacctactcgctatcaggcaattcccgataatcgaattcgctgaatttcgcaaccctgtcgtatccagaaagatcgattgcagccaaaccgacgaatgctccggtgaagaatccgccgtatcgacgcaggatatagtcgtccgacaggatcttcgcgtccagtttcacgcccaaatcgacccatgaagtcccatcaaacgaatattcatacgaataccactgcttgcgcaccttcgtgcgcagccacacggacttcacgtcatccggcactgctggagcggtatcccgcaggaacgacgtgtagttgttgaaatcgttctgagcgacctcaatcacgcggcattgccgccgctcgtcccaagtcacgaacacccacgaccagcataaatcatcgtagtagttcgtcaggccggccatctggcggtagttcttcggatcgaactcaacctttacggtcgcatcgaagttgaacgcctgccaacgacgtgccaccaacgacagatcgaaaaggttgcacagcgagccttggccacgcagttccaacacgccgccaccgaccttgcccatctcgccatcgaacggcacacgcagcgtattccaattcaaatccaacgtatcggacatgaaatcgtcatgctggctgtgatccgcaggtgcctcggtctcgatggcatccttcggagcatccacataacgctgtccgccatggcctccgacaatatacggccagccatcctcggtccatccgaccttctggatggaggtttcacgccccagcgtgcaccagccgcgcggatcagtgaaagattcattgtcgtgatgccacggacgaccgcacagcgaggcgtaataccattcgccggacggggtatcgaccagcgcgccatgcccctgcttttgcagataggaacgcggcgtgtcgaaattcgtgatgaacggattcgacggcatgccttcgaaggacaacgcgtccaaagtcttggatcgggccacgacttcctgatgcgtatacacggtaccgccttcagcggcgaacaggtagtaatagccattgatcttgtacagatgtggtccctcggtgagtttgacgtccgtaccgcgccaaatcgtacgttcagtttccggcttgagcttcatcgtcttcacatcgaattcggtcagtgtgatgccgtcgaagccatgatggtactcacgaaaatcccaagtctgctgcaccagatacttgcggccatcgtcgtcatggaacaggcttgcgtcgaagccgacaccgttcacacgaatcggctcgctccacggaccatggatactttcggcagtgaccaaatagttcgtgcaatccttgaacgcaccgttcacgaccttcacgtccgtgtagatcagccagaatttgccgtccgcataggaaagatccggagcccagatgccaccggatgacggattgccgcgcatgtcaagctggctcgtgcggctcagtggactcggcaacaggttccaatggaccatgtccttggactcgtgcagacggacacctgggaaccattcgaacgtggaattggcgatgtagtaggtatccccgacccgaatcatcgagggatcggcattgaatcccgggagaacggggtttgcgatttgcataaaatactcctttatatggaaccctcggccataggccgagggagttgcaagcaatcagatgatgatcagacgtattccatgcggcattactgacggctacgctcgtcacgaatcttcgcgaaatgcttctccggatcaggcgcggcattaagcaacactttcgtgtagtcttgctgcggattcaaaatcacatcatcagaaggaccatgttcaataatgtctccatgacacatcaccataatctcatccgaaaaatggcgagcagtcgccagatcatgggtaatgtacagcatgccgatgtgttcttcctgctgaattctagacagcaggttaagcacgcctaaccgcaaagaaacatccaacatcgaaacaggctcatccgcaattagaacctttggcttaggagccaatgcacgtgcaattgcgacgcgctgacgctgtccaccagacagctcatgagggcgtcgatacatgaaattgacggcaggcgttaattcaacacgttccagcagttcgataaccttctgctcatattcctcttggctatttgccatgtgattaatcataagaggacgaagaatatggtggaaaatcgtatgatatggattcaaggaagcgaacggatcctgaaataccatttgcacattatgacggtattcgtacaaatccttaccatgcgtagggacaggcttgccgtccaacgtgatgcttccagaagtcggcgtctccaaacatgtaatcattcgggcgattgtcgatttcccggaaccagactcaccaacaagagcaatggtcttatccgaagctaactcgaatgatgcatccttcaccgcatgaatcgtcgtggttttcaaaccattacgcagggtaaaatctttttttacatgctcaagcttcaatactgacatgattattcctttcacgcatggcgtggaacacgaacgaatgagccacgatctcctgtcaaagatgggaacgagctcagcaaccgttgtgtatacggatgcttcggattgaaatacacgtcttcagaaacgccttgttctacgatgacaccatctttcatcacagcaattttgtccgtgatctccaagagcatcggcaaatcatgcgtgataaaaataacagagaagcccttgtcacggcgcaattccgaaatttcctcgatgatttcacgctgtacaacaacgtccaacgccgtggtcggttcatccataataatcagctgcggctcaagagccaaagccatggcaatcatcacacgctgacgcatgccgccggaaagttcaaacgggtaagcagctagacgatttggatcaacatgcaccatctcaagcaaatgtgcgcaacggtcttgtcgttcgctcttcgccatatgaggacgatgagttttataaatatcggcaagttgcttaccaatcttagttacaggacttaatgaattcatggcgccctgaaacaccatggaggttttctcccaacggtattcacgcaatgaacgccccgacaaagcacggatatcaatatctttccctgacttatcatggaaaatcacagagccagagttaatcttacccggagctttcagcatttgattgatgctatacgccaatgtactcttgccgcaaccggattcaccagccaaaccaagcatctcaccgcgacgcaattcgaatgtagcgttctgcacggcgtgcaccggatcatccgtatcgtagataacgtcgaggttatcgaccgaaagcaggatatcagaattctgagtcgccatcgtgttcaccctttctttcccttgctgttcttggtaggcttacgcagtcgcggattgatgacttcatcgatggagaaattaatgaaggacaatccggcgccgatgatagcgatcatcagtcccggtggcaggaaccaccaccatgcgcccgtgttcagagcagaaccgttctgcgcgtaatacagcatggttcccagcgagaaggattgggtcgaccccaggccaatgaaggacaacgaagactcactcaggattgccataataacggagaacacaaactgcgatcccatcacaggcaacagattaggcagaatttcaacggtaatcacgcgccacggacgttcacctgcaatttttgcggcaagaacataatcacgcccacgcatcgacaatgtttgcgcccgcagtacacgggcaccgccagcccatgcggtgattgaaataacaatgaccaacatcatcgtgcccttggaaggcatcaatgcagaaatcacgatggtcagaggcaaccccggaatcaccagcatgatattggtaatcagagagaacaaatcatcccaaattccgccaatatatgtgcccaaaacaccgaaaatgaacgacatcgcagttgcaatcaagccaacagcaaagccaataatcagagagccacggacagaatagccaagctgagtgaaaacatcctgaccagactgcgtagtgcccaaccaatgctgggcagatggcgcagacaagccaatgtcattgatcttattaggatccttcgtgaagataggaacaataatggcgaacaaaaccattgcgatcacaatggttaatccagccgtcaattttgcagaacgctcaggaagaactcgcttgagagaatccaaagcggagcgacgacgtttagcttggctacgagccacagcagcagaagaatttgttgcagacatatttaacctcaatcctgttgccgcgtacgtggatcgataatgccgtaaagcaaatcaatgataaagttcacgactagaacagtaacggtaataatcaggaagataccttgcatcagcgcgtaatcgttactggtcaccgcttgcaaaagcatctgaccaacacctggataggagaacacctgttcagtaagcagcgatccacccaccactgcaccgatagacgtgccaaaaccagaaatggatggcaacactgcattacgagctgcgtagcacatcataatgcgtttaggacttaaacccttggcctcagcagtaacaatgtagtcctcagacaacgtggagaccatcatattacgcataccgacaacccccatgcccagagagctgacaagaatcgtcaaggccggcaagattgcataccgcactgcgctcgagaagaattcccaagtgaagccgggcacaacctcacgataattgtatccgcctgactgagggaaccaatgcagcgtacgggcaaacacccaaatgaagatgagtgcaagccagaagtaaggaacagcttggaaaatggtggacacaggggaaatgatgttatcaaaagcgccaccacgacgccaaccagcccagataccaagagcctgttgaataaagaacgatataatcgtggttgtgccgacaagacaaatggtccaaggcagtgcagaagcaatggacgttgtaacttggttggggaaatacgttacagatacgccccagttgccggtgaagatattcttcagataatcaatatactgctggaagatgttgcctccaccttgtcccagcattgcagtaatcgcttcccttgtttcgggtgcaacagtaccacctcgcgatgcaagcctggtaagaacagctgaaaccggatcacctggcatcagtcgcgggatggcaaagttcaatgtcaaagccgcaaacaatgcaacaaggtaaaatcctatctttttcaggtagaacctcatcgttacctcatttctacatggaaaaatggtgcacaaagcgcacatctaaaacgccttgtgcaccgttgattcataaaatccgtcaggttacttcttaaccttcaggttcttcaggacaatgcccaaatcaggatttgcccaagtctgcggattagcatagacgttatcgtttgtcggccaaccggtaaccttatcgctccacatttcgctcaaaccggattggcgcagaatcgggatatacggcatgtcctcaaacacctgagtctgaatcttctcatattcagacttcttggtcgccacatcagtggtggcactgatgacattaagagcatcatccacggtcttattgctgtagcgagcgtaattaggccaagcgcttttacccactgcagccgtactggcagtggcatagaactggttgtagaacatccatggttcggaacctgcgacccacagaccatagatggacatttcaaactggccctgctgcatcgcctgagtccattcattagaagacatttggtccgcatgcagatcaataccgatttttgccagctgctgcgaggcgacgttaatcgtgttgatccagtcagagacatcactcataacagcgactttgatgctcagcttaactccgtccttctgatagatgccgtcatcacccttcgtatagccggcgtcctccagtatcttgacggcttcatccgtacgtcctttacccggaataggtgaatccgggacgtcatccgaagcgtacttggtgaactgtccatacggatacagagaaccagccagctcactgtactggccattcagagcaagtttattaatctgatttcgatcaagagcgtaatagatagccttgcgcactgccggatcagtgataggaccactgcagccgagttctttgttcgaacaggtcatgaatgccatctgactagaaggaacgtcaaccgtctgaatatcaggatatcccgacagcacatcatccatattcgggaagatcgcagacatccagtccacatcgccagcggtcaaagcattttgagaagcttgggtgccaccggtgatcagaacataacggacgccatcaatttcaggcttaccttcatcccagtagtacggattcttcttaaacgtgtaagcggttggggaaaagttcccgcccttaactgtgaaaggcccagagccaacagcatctttattggtataggtcaccggatcatcgatcttttcccacacatgcttcgggacaatcatcgtgccggacagatacgacagagcattcaccgactcagaattgtccaaagtgatgcgaacttccgtatcgctaagggccttggcagagccagcaaagccaccggtattcaaagccttgttggagttaaggaggttgaatgtgtatgcaacgtcttcggcagtgtaaggttcgccatcagaccacttttcaccgtcacgaatcgttacatcaatagttttcgcatcgtcactgatagtgtaggatttacccattagcggttccagcttagtagggtcgtccttaaggttgttcatatagaacaatggctcgtacagagcaccgaccacaccggtcaaagctgtagaagagaacggattataattcaacgacgcctgcgaagttgaattcataacactgttgataatgactccgtccttcgcggtgctattagcacccccccccccgcacgcagccattgaaacggccgctacaccagcgcaaacagcagcaagcactcgcttccaagttcttgacttcatcatgtctttctcctttggcgacatatatgaacacacatcttcatgtttcgtaaatgctttagcatttcagtcaaagcactgtttgattatatagcttgactttcaagaaagtcaagtcacttaactaaatacttaaaatctttgttacgaaagttttatatgcaaatatttacgaaactttcgaatagatttaagtattccagggacgacgccctgcggcctagcctacgccgttcactttgccatcagcgacatcaacagctgcgcataaccataagacgcatgggcgttagactcccccctgactccgcagataaaaggcttctagcgattgccggaagcccttttgcatatcggcttagcgcgccaaacgttcagcagcggaagcgatcgcctcgtcgctggcggtggcggagaaacgcagacattccggcgcaccatagaactcgccggggctggcgacgatgccgatttcggcaagctggcgcagatcctcccagcagtcgccggacttggctttcacccacacgtacaacgcgccttgcggcatgtcggtgcagtatccgtatgcgcgcagagcactcaccagcatgcccagacgctcctgataacgggaatgctgggtcttgaccgcgtcgaagtcacgcagcccggcggccatcgcagcctgcaccggtccgggaatgatctgcccgatctgtttgcggtatgccgccatcggcccgatcagcgatcgatcgccagcgataagcgccgtacgatacccggccatgttgctttgcttgctcagcgagtacagcaccaatacgccttcggcggacccgccacacacatcggcgcgcaaggcgcacggcgtggaggcaagcgtatccgcatccacttccgcaacgtcgtcttcccattgcatcaacgcatagcattcatcggacagtaccacggcaccaatcgcgcgcgcgacacgcacaataccggccatctgttccgcggacagcacctcaccggtcggattgcacggcgaattgacccaaacggccttgacgcccggcacatccttccaggaatccgcatccgccacgtcgtcgaccttcagcgtttgcgcgccggccaactgcgtgccgatctcgtacgtcggatacgacaccttcggctgcacgacgacatcgccttcgccgaaatgcagcagcgacgccatcaacgcgacgccttccttggaaccgaccgtcggcaccgcatcggcgccgatcgcacgcaaatcgacattgcgggcggccgcgaaccactcgtgaatggcgtcacgcaaatcggcggtaccggccgtgacgggataaccgtacgcgttcgggtcgttcgacgagaccgcgagcgccttacgcaccgaatcgggaacggggtcgacgggagaaccgacggacaggtcgaccatgccaccgaacgcggctttcgccgtacgtttgtacgacgcgatgcgggaccagtcgtacggcgaagaaaactcatgaaagcccatcgtgaaaaccccttaataatcctctataaacaaaatatgcggcctcttccaacgggaaaaggccgctttcaaatgccaatcactgattttgcggcggcagggccgcgacctgctccggatccttgccgatcgggccggctgcggaagcgccgcccatatcgccgacttcagcgaagaagctgactgcggcatccttgtaccaggcccactcgtctggcagatcatcttcatagaagatggcttcagtcgggcacaccggttcgcatgcgccgcaatccacgcattcgttcggattgatgtacagggaacgggagccctcgtagatgcaatcgaccgggcattcgtccacgcaggccttgtctttgacatcgacgcacggctgagcgacaacgtatggcatggttacctccttaacacttaccgttcaagactactcttgattgccaacttccagctctcccgtaccaagtcgggcgtggcggtagccgtagccgaagtagatgcagaagccgaccgcaagccagaccacgaatcgaatccaggtgagcacgctcaggttgagcatgagccagatgttggcgagcgcgatgaggataggcacccatggattgccggggattttgaagactcgcttcaggtcggggcgcttcttgcgcatgatcggaatagagattgaaacaagggtgaatgccgacagcgtgccgatgttcaccatgtcggcaaggatactgacgttgcagctggctgcgatgagtgccatgaccacgccgacggcaatctgcagacgcactggagtgccgtgcttgcccgtgtgactgagcgagcgcggcagcaggccatctcggctcatggcgaacaccacgcgggtcaggccgagcagcagcaccatgaccacggtggccaggccgatcacaatgccaaaactgatgattttggcggcccagtcagcgccgaccatttcgaatgccgtggcaagcgacggatctttctgcttggcgaggtctttgtaggagaccatgccggtggtgacgatggcgacgagggtgtaaagcacgatgatcagtcccatgcccacgcctatacccagcggaacgttcttcttcggattgacggtttcttcggaagtggtggcgactacatcgaagccgaggaacgcgaagaacacgagcgcggctccggagatgatgccggcaatgccgtaaatgctgggggtcatgccggtggcccactgccataatggctgttccatggttgcggccaacccggatccggtggcggtcgccggttcgctcggtggaatgaatggggtgaagttctcggctttgacgtagaagaatccgacgattaccacgaatagcacgatggcgattttcagcatggtaagcgcgccgtcgacccgtgcgccgattttcgtgccgcacaccaagagtgccgtgaagaaagctacgacgatgattggcgcgaaatcgaaattgaatgatccgatggtgacgttggtattgatattccatccgacaagtcggaagaaatcgttgagatagacgccccaatatttggagacgacggagcctgccatcagcatttcaaggatcaaatcccagccgatcacccacgcgacgatctcaccgacggtggtgtaggtgaaggtgtaggcggatcccgcaaccggaatcatggacgcgaattcggcgtagcacattacggccgcaccgcataccacgccggcgatgaggaagctgatgatcacggccggacccgcatggaaggctgccgcctgcgcgccgatggaaaagatacccgcgccgacggccacggccacgcccataatggccaaatcccaccaggtcaggtctcgtttcagggagcgccccgactcctctgtttccgccagcgtctgctcgacggatttcttacgtaatacgttcattgcgtttcccttctcccttcgttcttacgtttacttaaggctcatgccgatgacgaccggttcgggaacgagacgaatgccgaatgcccgttcaacgccatcctgcacggttttggcaagttccgcgatatctgcagctgtggctccgccgcggttggtcaatgccagcgtatgcatggtcgaaagccccgctgcggcatttccgctggttttgtagcccttatggaatcccgcatgatcgataagccatgccgcggatgttttgacgcccggcgtgccatccggcaaggtcgcgtcgaatcgtggcgcgtcttcgggaagctttgccgcttgttctttggtgagaatcggattcatgaagaagctgccgcagctgtggcgattgtagtcgggttcatcgttgcctgtctgcgtgcgctgtgcgtcatgcgcgatggcgaccagttcgctctttttggtgcctcgcatggcttcggtcagatatcgatgggaatcttcaagcatgcctttggaggcgcgtactttcaacacggcgttgcgaatatccgcggtcgccatacggtcgcccacttccacgcccaatgctttggcgagctggccgtagccaactacgccggtttcgctgtgatgcagcgcgaaagtaacggacaacaccacgtagcgcggtgtcgggaagaagtcggccgcaggcgttgccggagcgctgtacatgctcgctttgagcgcgctcatgcgatagccgaaatgaagttcctgattggtgagctccttggtctgcttgtttttgcgatcccagacctccacgctttcgacgctggatgcgacttcctggccgtatgcgccgatattctgcacgaccgacgcgccgacagtgcctggaatgccggagagtccttccacgccctccaagccgaggttgacgcagtagtcgacgaaatcatcccaattgcaacccgcttcggcgttgacatgcacgattgtttcgccgttttcgacgggagccgcctcatcaagcacgcttacggcgtgtcgcgcgtcacgcaccacgacaccatcgaacggcgtgtcggccacgagcatattggatccgccgccgatcacgcacagcggcaatcctttggcgtcggcatcctcgacggcttcgataacgccgacacgcgaggtcggttcgataaaggatgcgattggtccacctacggcgatggtcgtgagatctgcgaaattggtcatgatgtttagcttagcgtgcggggaaggcagttggaaaggtgtcaagaaaaggttgaaagaaaacaaaaaacccgaccatattggtcgggtttcataaagctttgaactcgctcagcgggtctcgcgatgcacggtctgcttgccgcagcgggagcagaacttcttcagctcaagacgatccggcgtgttacggcggttcttcgtcgtgatgtagttacgctccttgcactcggtgcatgccagcgtgatgcccggacgaatgtcggcgctcttgcttgccatttaagttcacctcttgtggttcgttgctatgccgacgttccgtcgacctttgtagcgagaaagagactcgaactcttgaccttacgattatgagtcgtacgctctagccagctgagctatcccgccatgagagcctcgagtgagaatcggactcacgacctcttccttaccaaggaagtgctctaccactgagctatcgaggcgtggcggatagtggattcgaaccactgaagcacgaggcgactgatttacagtcagttccctttgaccgcttgggaaatccgccgtgctgcctgtttggttgaaccccaaccggcaacccgtttagtatgccacagatcatgcgattaacgcaaatacggcgtgtcgcggaagccaaaaagtctcaaaatcgttgaaattccaacgatttctcactatcagccacatgtcggtgtcaatcggagcaaatcctcccgaaaaaaattccaaaaagaaaaaacacgagtatttcttccgaaccttccctgcagaccatctgaacagcgacgccaacaccagcacgccaacgccaatgaacacggcatacatcggccgcgcacggcctattgcaggaaccccaagtgcttgaaatcaacaagaccccgccaacgcaacgattgttcaccaatcgttcgctgacggggtcttcaaacagctacgcgctacgctcagccgagaatggccagaatatcgcgggcggagacgatcaggtaatcctcaccctgatagtgcacctcggtgccgccatacttggagtacagcaccttgtcgccgaccttgacgtcgaccggaatgcgctcgccggcgtcgttgcgacggcccggaccgacagccaggacttcaccctgctgcggcttctccttggcattgtccggaatgaacagaccggatgcggtctgggtttcagcttccgcctgcttgacgatgatcttgtcttccaacggtgtgagtgagatcgacactgtggacctcctctttctaagagaaatcgttacttaccgcgccgggacccgctagcaagaggctgacgatcacttacggcgtcgtcctttcgcgctgaaacatatcctagcgcgattattagcactctgccaactcgagtgctaacgctgagagcaaaatatacgaaaaagcctgaaaccatgcggtttcaggctgatgttctttacgcttgttcgtatgtttcgtgcgtttcgtgcgttcgctttccctccgtcacgccccgcgacgggccatgatggacgccaaacccacgcccagggaatcggaggtgacgctgggagcctcaacgtcggcgctgacctcggagtcgtggaatcccacggtatccacgtcctgcagatgcacaccagcctccacacgggctgcggcctcgtcggaatccatgctgctgatcgcgtcggtcggcacaatcaacggctcgacattgtcggaaaccgtactcgcagtcggaggcacggccttggcgacctgacgagtggacttgatttccatgctttccggagcggctggcgcgatatcgttaccgctgcgtggcgatcccaacgagaacgaaatcagatcctgcgacgcgccggccacggcggacgaatccgcatcgcatgcatccacaccctcggttttggcgatttcatcacgctcatcgtggatggacagaccgttcttcttatccggcacgacttgcgcatccacaacgttcggttccgcagcggatttcgcttcggtttcctccttgcgtttgcttacaacaacatcacggtcggccttgccgcgatcgatcgcctgacggatctcaccttccggcataacatcggtcggcacctgagattcggcgatcctgcgaatttccgcaagctcctgctcccgcaaacgagcgcgctccgcctgctcttcctgggcgcgcttgcgctctgccgcagcacgcttcctcatcttggaacgatacttggcgactttccgctcccacgctgcggcctgcttggcggccctcacccccaaagcgagcactccagcaagcagcgacgcaggaatcaaagcaaacaacggactgaaatgcaacacaaacgcacacatcaacacgacgattgtgatcaccagcatcgagacaacaataatccgccttctgcggatcgcggcacgacgaagggcacggacatgcgcgatcctttcgtcggtcagcttgccctcatgcgtctcgttggactgcattattgcccctttcgcctttgcggcggtctcatcggagaatcgcgttccactgtcggcatccaccagatgcagcgacggcgaaaagcggtcctctcggtgctcgattacccgcttcatgcctttgaccgtccgtttgggcagccagaaaaccatgagaataatcacaatcgcaagcaccacaaccgtgcttaacgattcataacccataactcataagaataggtgacattccgacattctccggggtgcacgcccccgcgtgtcgaacatgtgcgcgaaagcgcgtgtcgaacctcgccaacggctcactcgcccatcaaccgtgcggtaaagccattcggtgcgtactccggcagcaacgcatacgattcatggtcacgccattgcccgttcacgaacatgtacgccttgcgcatcccctcataggatgcccccactttgagtgccaccttacgtgaacgttcgttttcgggaagcaagtcgatctccacacgatgcaattgcggcccggaagggtcgaacatcgcccaatcagccaatagcgtaacagccatcggcgcatatccacgccccgcacaccgctcatcgacccaatagccaaccacgccggtacgcatggcgccatagcagatggcccctaacgaaatctggccgacgatacgcccatgatgctcgatggcgaacaccactccggtgccgtttcgctcgttgcatcgcatcgcacgcacccactcgttgaacgacatcgacgcgccatgcaccggatccccggattcccaaggcttcaaccaatcgtcgttgcgccagcggacttcgttccattcgtcgcagtcgtcagtagtcagcggacgcaggattatgggaacgtgaagcccatgtgcctgaatgaaccgcggaacatcaatggcattgggatccgaacgcatcatgccccgtaaagatcgcaaaatcgtcacgccctcattctgccatacgcataacatttccgattgcgcgcaaccatcccgtggtacaacatgcggtatgaccacgaacatgcaagccgacgtcatggaaaacagcgtctgtgacgacgccgcgaaccaacgtgagctgaaaaagcaatggcgcgcacacgcaatcgcacgaagaaagcagaccagtaaggaggaacgactggaagccggccgtaagttggccgaacaggcgcggaaggcgaatctcattcattcgttcaccacggtggccgcattcgcgtccatgggcagcgaaatgtcgatgatgccgatgctgcaggcattattcgattcgaattgccacgtgctggtgccacggctcggatccggcatggatattggctggagcgaacttggcgacattcacgatctgcaggaccagaccaacagcgacgggtccatcaatacgcaccgcccgcaagagccgggcaatagcgcaaacggacctgaagcgctgaaaaacgccggtctgatcattgttcccgcccttgccgtcgaccaagagggattccgtctgggacgtggcggagggtggtatgaccgcgcgctcgagtatcgtgcggccggcgcacgggtggtggcggtttgctggccgtgggagccgacggacaagcctgttccgcacgaagaccacgatattcccgtcgatggcgtgctcactccgaacggatttacggccatacgcgaataagatgtccgaagataagacgttcacgcagccgtctcagggaacgtactaggatatgtcccgttaagaaatttgagaacctggttgaagcgaggatactttgcctacttaccattaccgttgcaagaactgcaactacgatttcaccgaacagcagtcattcaccgacgatccgatcaccgtttgcccgaaatgcggcgaagagcaggtccgcaaggtgtattccgccccgccgatcgaattcaagggatctggtttctatcgcaccgacaagtccaagtgagcgaaaacgaatacacgtaaccgagcagccgaagcaaggaaacgagtcaaataaccagggtcagcaaaccttggaaaacaaggcgacacgccgaatcctgtggataactcgcatcctccgaccacaaccctcgatccggcttgcgcagcaactattcgtaaggtcatcatgcatgaatggtgaccttttttcatgaccttagccaacgtctgcaaggcacggacggcaaacacacgaaccgcgcaccgtcttcggcgcctcatcgacgacgacgaaacgcgcaattgcatcgtctacttgcttcgctgtgcgccggacttgccatattcgcggccctgcagtgcgtacgattgacgatttccacgcaatccgtcgtcattgcggcgaagtccatcgccaaaggcggcgtgatttccgcggattcgcttgctttgcgagatattccatacgatgaggccctgcgcagcgttgctcacgatatcgatgatgccgtcgggctgattgcccaagtgggtattgcggaaggcagcatcgtcacctcggccatggctcgcgcttcccccgttgttcccaaaggatatacggcggtcgaagttcggttggcgagttccgccgacagtctgacgattggcgatacggtgacgctttccagcgccacgatgttcagcgaggccacgccggaaacggtaccggatatggatgcggtgtcgttacgtgagctgtgcacgggagcgatattgaccgcgaaaccttcacggaatgcggacggcgacacgcttgcggtgtttgccatgcctcctcatgaggcggcaaccgtattgcaggcccaagaatacagcgcgatcatcgccatcgtcggttcgtaacggcattcccaagcgaatccgcagcaccatcatgcggaatatatgaaattcgggaggtctgaacgtatcagaacctcccgtatagcagacgaacgtcagcgctcccgctcggagaacacgccccaatgcggtggcagctcgcccagaatacgcttgtcgtcgtcagcattgcgctggcgttcggtaagcacatcggacggttcaagcttgacgccatcggcatcgaacagttccgtaccctgccgaaccacacgcttgtgtttgcgcgccgtacggcgggtggcggagtatccggacaccacacgcacggcagactggtcagattccgcggactcttggatggagggttcgtcgacgctcacttgacctcctgatacaggtcgctcaagcgtgccacgatgcgatccacttccttgtctggattcacgaacgcgccaacgctccacacggtcataacggaccagccaagcgattcgatgttctgcaaaagcacgcggtggcgttccctggtggactgcaatcccatgaactgcgcatcgtcggtaagcacggccaatgcgaacggcttgtcgttcaggccaaccaccagcggcagcttggaaccattgtcgaaaccgtagtcgacggccacattcaaaccgcgggcacgaatacggtcggcaagatcgttgagcaatacgttcgaaccgttcgtcttgacgactggacgcaccacgctgtcatcgagctgttccgcccagcgaagcaccgttttcagcatcttcggaccagcttggtgcaggcgctcgtcatccatgtcagctgacgagaatgcggacacgatgtcaagatgacgatccggcacggccaacgcatccagcaacataccccgtccgccttcggattccaacgctccaaactgttgcagcagccttccatgagaagtcttcgcgtagcacatcgcaagaatcgcatcggtggcatgcgcgccggccacatcggaaatgtccacgatgcgcacatgacgcaagaacatgcccatggccttgttcttattggcgatcgccttaagctcggctcccagtcgggtgcggaacgtatgggtcagcgtcaccacggtaagcatgtacgatgcaggcacgatcgtgaaaccggcggcacgcttggtgatcagcctgaccacctcgtcgatttcctgctggctgctttccaccagtccggacgtgatgaccggcacgccattggcatcggccacaaaatggtaggcgacctcgccctgcgcgccttccctggccacgtcgaagggcacggaaccgtagccttccgattccaggaacgcgttgagcttcggcgcgcggcgaacaggacgattggcgattttcacgctcggcagcaatgcgatgagacgcttcagaccgtcggaagtgacggtttcgcgatgcgcgatcaccaccacctgcttggctcggctgatgatgctgagcagttcgatggattgaatatgcgctgcggcatcgatgatcacgacgtcggccaatggcgccggatcggtgatggccgcaagcgtggcaggagtcgcaacgagaataggcttcgccgcggcgagaatctgcggatgctccttatgcaggcagttcagcgaaacattacgggcgccggcaagcgtggtatgcagcagattggcctcctgcgtacgcgagaacagcatgtcgcacagacggcgcatggattcctgcgccaccatcggaccgaccgaacgcacatgttccacatcgacctgggcgaaccgctccgcagcgccctgcaatgccgacccatcctgattggaaatgatcgcggaggatttcacgatgtcttcgaacgccgtggtccaccatgccagctgcagttcccctgcaacggcatcgttggcaacgccacgattgttcagatcttcgaccagctcgtcgaggccgaccgaatggaattcacgttccagacgggcgcgctcaggcagaatatcaagcgactgcttatcgtcatacagggccttcaaacgctcttcgacctgattgaaatcaacggtttcaagattgccgccctgcggagttgtggcaagcaccgcattcaacgcggtcatatcccgattgagattctcctgcgtttcgataatgtcatccagcttggcgggcaataccggccagccgccatgaggcacgaacatatgccactgatcggcctgcttggacaccaccagcaacgcctcatgcaggttctccacttgggcaccgacgcgcagcaaacccttggcttccttgatgtggcggcgacgctcccagaagcccatggacgtaccttcggccttgcgctcggccttcggcttggtcgcctcgatcatggatgcaatgtcacgttcgaaaatctccggctggaatacgtcaagcacacggcgcaggttcttcagcaccatgacctgacggctccactcctgcgcggtcgtgggaatcgggaatccgcaggtctgtaccgtactggccacctgctcgcgggtggcgggcaacaccttgcgcaacagctcaaccacacgctggtatgcgctcaccgcctcctcttcggaatacagcgatgccttataccatgcggtgtcgttctccgtaatggtgtattcgccaagctcgcccgcacgctgcagtttcgcagcccaatcctcgatcttgtccgcgatggaatgcgcggtctgcttgttcaaacgcacatgcgtggtcggatgggtgggcaatgccgcaatctgcgcgagattctgaatcgtctggtaggcggatacaccccactcctgactcacgccgtgaagatcgcccagataacgggtcaaacgcgaacgcacgccaaccagctcatcggcaatctgatcaaaacgggaggaagcaacccccgattggaagccgacggctgcaatcagctgacggtcaatcgcagcgttggcaccatcatcggcgatatccagcagctgtccgctcatttcgtttgcggcaacggcctgtacaaaacgacgcttctgatcggtcacacacggcacatagagcacagaccgtccgttcatcacgcaacgcgacgcaatcgccgcggcctgctcggcggtattgttggcgatcgcactatccacaaacagcgaatggcccgcggaagcaagctgcgaggcgtatcggacggtattgtccgcatcgccgacctcatactcgccatgaggatcggcatcaaacggactgtactccggaatttcggcaccttccaacgcttcggcggcggacttgtctcccgccaaagcgtccaaggcggtattgccggtcggaccttgcgccaactggtcgatgatcttccggctttccaccagcatctgcgatgccggatccataaagcatccgagaataatgtgccgttcgatctcaaaatcagggaacgcgttggccgcaaggcgtgtgatggcagcgaacaccgcggatgtttccggcgtgccgctttcgtaattcgaaccgtcgaacagcttggactcgtccaatacgacgttgttctcgcgcagcacggcggcgaaagccgcattcaagcgtacgcgccctgtgaacgcgatcaccgtaccgttttcaatattgcgtccttctttgcgcacctcaaccggatacatgagtaccggcatctggttgcccttccaaatggccacgccaaccaccaaagacagttcgcccacgccgctgacacggcttttcgcctcacgatcgtcgagcacacgctccacacgacgcccggcggcacgcaacatgccgttgtcgcggaacaaggaatcaagttgcacatgcccgctggcgaacagctgcgcgatgccggacggatgcgcatgcgtcatgtcaagctgggcgctcagctgcgtcacgtcctcaagcggcgacggcgatagaccaagacggtacttctcacgccacccccgaatacgatccagcgcggtgacggtctcgttgctttcgctcatgtattgactcacttccctaccgctttgcggtattccgcataccccggattatgtgacagggccgcgtcgatgtctgcattgcccaaagctcccagccatgcgtacaaatcgtcgtacagcgacgggttcatggcaaggaacggcagcagctccggatgacgtgccatctcgaactgcacggtgaaatcgtcggtgcgtttggcatcatccgacgtcagtccgtcgacttcaatggtctgttcctgcttggcaagctctcccttggcgactcgatcgaacaccgatccgggttcaaaagccggtttgaatacgctggtttcgtccggtgtcggctcgctcacaatctgtggctgctccgtgttatgcggcctgaaacgctcgtcgtcggcccgttgcgccgcttcttccggttgaatcggattggtaccggattgttctgcaatttcattgcgctgctcgtgcgttttttccgcttgttgttcaggcatgtcgctgctatccggcaatgccacgataatcggcttgcttggtcttgcgctgaatagtttgctcacgggaatcgtgtcgtgttcgacgtcgttgcctgcgatggcttgcgtccgcgattgggattcgggcagcatagccggcttttccttttcggcggcgttcttcttggccccttcttccgccgcctgctgttccgccacggcatctgcctcggctgcggcgtcggcgaagaggtcacgtggcgcgttatccacgacgtcgttatgctgcaccagcgaaacggatgggagatccccataatccggctcgttggatcgaactggcgcgaaagactgacgttcggagcgttgcatgagattcacacgattggcgacgttgcgcgcgttgaacaatgcggtcggctctccggcacgcagattgagaatgtcgtcgaccgacatatcggcggcgtcgggctcctgcgacgcctcatcggacactgcataggagaacagattagataccggagctgacgtggtactctcggattcgggcatggcgctcacgctgtcacgttcaaaagtgacgcgtacgtcgccgaattgcaaggtcattggcgtggatggcagtttgaaatcctcatccgcgggcagacgcatcaattggccgttgtcggccactacaaacgaaccattggtcgacttgagatcacgtacggaagcgttgccctgcgcgtcgactgaaacaatggcatgccgtttcgacatggatttgttcgtatccataatgtcaaggcgcgcgaatccgtcatccgccagaggacgtaacggcttgcggccgatttccacgctttcgccgctgcccagcttcttcagttcggttccatcaaccttgacggtccactgctgtgccgttcgttgatcttcgctcaccgttgtcggccttcctttcacacataccactacttgtcattgtgtcatgccttgccacgtatttcaggattatgacgcgattaattgacaactttcgcctaattcccccattgtatggcacgatatggaagcattcatgcctaaatcggattttattggatcgtcagcgaaagaaaatcccgtaatatgcggaaaaccccgccgccttgtggcgaacggggtttccactcaagattgtgatatgcggcttcaagccgcgcgaatcacttgagctcgacggtagcgccggcttcttcgagctgggacttagccttctcagcgtcttccttcttggccttctccaggacagccttcggagcgccgtcgaccagagccttggcctcagccagacccagggaggtgatagcgcggacggccttgatgacctggatcttcttgtcgccaacggcggagaggatgacgtcgaactcgtccttctcttcctcagccggagcagcagcgcccggagcggcaacggcgacagcagccggagcggcagcctcgacgtcgaacttctcttcgaaagccttgacgaactcggagagctcaaccagggtcatctcaccgaaagcttcgagcagctcatcgttggtgtacttagccataatggcttcctttcattcttggcgacggtttgattgaagaggtgaccgtcacctaaaacaattatttttcttttatggtcactatcattcacgcggctaaccgcaatgaaatcaggcagccttttcctgcttctcgcggagcgcatcgatcgtacgcacggccttggtcggcagagcgttgaacaggtacgcggccttggacatcgtagccttgatgtcgccggcgaactcggcgagcagctgcgggcgagacttgaggtctgccagcttctgggcaccttcagcatcgtagacggtgccatcagcgaagccgcccttgatgatcagtgccttattggtcttggcgaagtcacgcagggtcttcgcagcttcgatgaagtcacccttcacgaaggtcacagcggtcggaccggcgaggatctcatcgagaccttcgatgccagcttccttggctgcgatgcgaatcagcgtgttcttagccacagtgtaggaagtatcgcggcctagcttttcgcgcagttcagagatctgcggaacggtaagcccgcggtactcggtcaggtagatagcgtcagcttcacggaacttatccgtaagctgggcgaccaccgcttccttttcgggcctcttcatggcgttccttccttagtcaaccattgactgtgaagcaggaacgtttcgccggacaataaaaaagccctgcacgcaggcagagcaacattcgaccgctaagcggaaagcccttggtgggcgtatgttcttcaacctgcgttggcttggcgaaccaaacttcgtgagcgcttgcacgctccaaccaacggtctgtggtttacaggtgaacaacttacggtcatgcttggacttgccgtcatccgggcgtgtcgcgctttacgaaatcttcatgactcactcaagtgttacggttaagccttgttcggaatcccacgattccacaaggcgagtcgcaattctcgccggaacgcgccgcccaatagtcggaacgttcctaccaacccaagagaaatagagatagggaaaaatggaaaagttcttccatcttaaggagaacggcaccaccgtgtccactgaggtcatggccggtctgaccacgttcttcgcaatgtcgtacatcatcatcgtcaacccacagatactgtcgcaaacgggaatgccgtggggcggcgtgttccttgcaaccatcatcgcagccatcgcgggcacgctcgtcatgggcttgttcgccaacgttccgtatgctcaggccgccggcatgggcctcaacgcgttcttcacctacaccgtttgcttcagcctcggcttcacctggcagcagaccctgtgcatggtgttcctgtgtggcctgatcaacattctcatcaccgtcaccaagattcgtaagatcatcatccaagccattccggaagtgctgcagaacgccatcggcggcggcatcggcctgttcgtggcctacgtcggcttcctgaacgtcggcttcttcaccttcaccaccaaggccgacgccaagaacggcgacaccgtgcaggccaccccaggtctggccgtcatgaataatccgaccatctggctgttcatcatcggcctgttcctcgccatcatcctcaccgtgctcaaggtgcgcggcggcatgctgatcgccatcgcggtcaccgccatcgccggcattccgatgggtcagaccaccatggccaactccatctccatcggcgacactttcgcccagctgccgcagacctttggcgctatcttcagcgctgaaggcttcccatcgctgttctccgacatgtcgaagctgccgatcattctgctgacgatcttcgcattctccatgtccgacaccttcgacaccatcggcacgttcatcggcaccggccgccgcaccggcatcttctccgcggaagacgaggaagccctcgaaaacggttccggcttctcctccaagatggacaaggccctgttcgccgattcgatcgcaacttccatcggcgccatctgcggcacctccaacaccaccacgtatgtggaatcctccgcaggtatcgccgctggcggccgcaccggcctgacctccgtggtcgtggccatctgcttcgccctgtccgccttcctctccccggtcatctccgccattccgtccgccgcaaccgcaggcgtgctcgtggtggtgggctgcatgatggcgtcctcgctgaaggaaatcgactggggcgatatctccgaggccgtgccggcgttcttcgcttccgtattcatggcgttcagctactccatctcctacggcatcgccggcggcttcatcacctactgcctgatcaagacctgcaagggcaaggccaaggaagtgcacccggtgatctgggttgtgtcgctgctgttcattctggacttcatcatcaccgcgatcctgtagttctgaacgtcaggttcaacctgaccaccagccgaaattactggttcagtaaataaatttaaattcggcaaatgaaataggggcgattccgctctcaccgcggagtcgcccctattgttgtatcgcttgttttcgtactgctttttagtgaaccgtcttacgcgatgacttgcgagaaggcgtcaaccagactttccatccaggccgtcaaggaatcgtattgttccggcatctgttcggtcagttcaaccatgggcacgtttgcggatttcgcggcattcgtgattttgcccgtcagctcgctttcctcctgcgtattgacgaccaaaagcttgatttcacccgccttcagcgcatcggtgaactgtttgatatccgttggtgtcggctcgctttcgttcgctgtggctcgcgcgtacccgcttggcgttgcgtcggtcaaacccatgtcttccgccagatagcttgccacggattccgttgccgcgtacgccaatccgtccgatttctgtttcacttcggcgattttgctttcgacgttgttttcttcagatttccactgatcgtgcagcttgtcgaaatcactctttttcgcggcgtcggcctgttcgtacgcttcggtgatcgcctgtgccactgccttgcgcacatcggcggagaaccaaacatgcggattttcgccgtcattcaccccgccgactgcagcggcattgacgatagttgcgttggcggattgcgccgctttgaccgcccatgcgtcgtagccggctccattgacgatgatgacttgcgctttctgcagtttggcgatatccgacgtcgttggctcgtaatcatgcgcatccacattggtggaattgatgatgctggttacgttgacgttgccaccgcccaaggttttcgccacggtaccccactgattcacggaagcgaccacttcgatggttccgtttttttcggacgacgatcggccgcttccacacgcagcaaccgacgcaagcattcctacagaagcaagtgcggcaatcgcaattctcacaatacggtacatgatagatcctccctaacgtgatataacaccatcataacttaattgagaatcattatcaatagagcgtgtcgcgatcaggtatcacatacaaaaaactcccgctcaggggaacggccgccacgaatgggatcgaaatggttagcgaagcaaccactttcgaccgcacatccgtgcgacaatcccccgcaagcgggagtaagagatgatttgccgatcagccgcgtgcaattaaggagcttcgcaaagcgaaacataatttgctggctcgctaaagctcgcttgcgttgacccactgggtcaacgctacgctttggcggatcggcttttgccgatcagccaaagcgtcccgatacgtagcgctcggcttcttcgttctgggggttgttgaacatggtggtcgtgtcggtgaagtactcgaggtgacccggctggccgactgccttcaggttgaagaacgcggtgtagtcggcgatacgagcagcctgctgcatgttgtgcgtcacgatcacgatggtgtagtcgttcttgagctcgttgatcagatcctcgacagccaacgtcgaaatcgggtcaagagcggagcacggctcgtccatcagcagcacctgcgggtgcacggccacagcgcgggcgatgcacagacgctgctgctgaccaccggaaagaccaatgccaggattgtcaagacgatccttgacttcgttccacaggttggcgccacgcagagcccattcgaccagatcgtccgcatcggacttcgagatcttgcggttgttgagcctcacgccagcgagcacattctcgcggatggacatggtcgggaacgggttcgcacgctggaacaccatgccgacatcgcgacgcacggcaaccgggtcgatgtccttgtcgtacaggttcttgccttccagcaacacctcgccttcgcagtgagcgcccggaatgatctcgtgcatgcggtcgagcgtgcgcagcaccgtggacttgccacagccggaaggtccgatgaaagcggtgaccttgttggcttcgatgttgatgttcacatcttcaacggccaggaagtcgccgtagtagatgttcagatgattgacatcaatacgttgtcccattttggttccttatatgttgtttctgtatgtaagactaccgctcatcgttccgacttgacggcgaagaccttcgccacgagtcgaccgataaggttgaggataagcacgatgaggatcagcacgagagccgcggcccatgcgcgttccatcgggatggtggtcacgcaggaagcgtcggcggaagccgggcaattcgcgttgagcttggagtactcctggtagacgtacaccggaagggtggtcatctggccggagaagaggttgacgttcgtggaggcgatgtagcctgcggtcatcagcaacggagcggtctcaccaatcacacgggcgacggcgagaatcgcacccgaaacaatgcccggcaaagcggtacgcaacacaatcttcgtaatcgtgcgctgcttggtaacacccaaagcatacgacgcttcacgcaagtcgtgaggcacgatcttcaacatttcttcagaggacttgaccacggtcggcagcatcagcagcgacagtgccacggaaccttcgaaaccgttgatggtgccaggtccaatcagaatcgtgaacatcgagaatgcgaacaaacctgcgacgatggacggaataccgctcatcacgtcgaccagcagggtgatgacgcgagccagcttgccacggttggaatattccaccaagtacacggcgcacatcagaccgatcggaatggagatgatcatggcgccgaacgtgatttccagcgtaccgatgatggcgtgctgaatgccgccgtagccaccggacggcgtcggattgccgccgaccacaccggtcatgttatagctcaggaagttgaggttcagcctcttgacaccgttgacgatggtggtgagcagcaccgagaacagcggaatcagcgccacaatgaacgcaagagcgatcagtacgcgcatcgcaagatccttgcgcttacgtgcagcggtaaaggaacgcgtcggcttgaacttgtcgaaatcgatgacgggggcaccgtccatcggagaagcgttgttattcactgcggtcatcacgcactcgctttctcggtaagcttacgggcgatgaaattcaccacgaaagtaatgaggaacagcaccaggccggtgccgatcagcacggacacgccgagatcgttggcttcaggatactgcgcggcgatgttggctgcgatcgtctggttctgcgaagcctgcagcagcttgatggagtagttgagacctggagacaggatcatgagcacggccatggtttcgccaagcgcacgacccaagccaagcatggaagcggacaccacaccggacttgccgaacggcagcaccgcaagcttgaccatttcccacttggtggcgccaagagcaagcgcggcctcttcctgaaggcgcggagtctgcaggaagatatcgcgggacatggaggtgatgatcggcaggatcatgactgcgagcaccacggccacggtggcgacggtacgggaaggattggcggcaggacctgcgaacagcggaatccagccaagatacttggccacccaattccagaacgggtagatggcgggcaccagcaccaggccaccccacagaccgtagataacggacggaattgcggcgagcagatcgaccacatagctcaaggcggtggcgagcttcttcggcgcgtagtgcgagatgaacagtgcgatgccgaccgacacgaagaaggaaatcagcagtgccagcgcggagatcagcacggtgccgaacagcagcggtccgacgtagccccagaagctggaggccttgccgccggtgaagttgctgatggtgtcgctgttggcctgctgatcgccgccgatcaacggccatgcgcggaacagcaggaacagcgcgacggcggcgagcactacgaggatcagaatgccgcaggcgtaggccacgcccttgaacaccttatccgcgtttttgccgctcaccggctgctgtgccgttttgctttgcgaactcacgggttctccttaacttgcgattgtttgaaacagatctgcgattacttgcgatgactgcgttttttgttttacctgcaggtaccgtttcaggccgcacccgctttcatgttgcggctgcggcctgaaacagacggtcagttgccgttcaccgagagcctatcgcttactgtatcaaagctcacttggtttcgatggcgtcgatggacttgaggaccttctggcgcatggtgtcggacagcggagcggagcctgctgcggaggcagcggtctgctggccttcgtcgctgaccacgtaggtgagccaggacttgacgaacttggcggtgtcggcatccttgtatgccgggcaggcgatgtcgtaggagacaagcacgatcgggtaggcgccagcctcggtggtgttgtggtcgagcttgacgaccacacggttgtcgccagtggcggattcgtcgagcggggaagcgtccacaaccttggcagcggcttcagcggagaacggcacgtaatcgtcgccgaccttcactgcaacggtgccgagctcgccagcctgggaagcatcggcgtagccgatggtgccgtcagcctgctgcacggtggagatcacgccggaagtacccttagcgccctgaccaacctcgttcggccagttctcgccgagctcgtagctccaagcgtcgccagcagcatccttgacgtagctcaggaagttcttggtggtaccggacttgtcggagcggtgcaccacggtgatgtcgagatcaggcaggtcgaccttcgggttctgctgcttgatggcgtcatcgttccacttggtgatcttgccgtcgaagatcttggcgatggtgtcggcgtccatgttcagggtcttgcccttgccggaaatgccgttgaggttgaagaccacggcgatcggggagacgtagaccgggatgtcgaaggcgttgccggaagcgcacacgctcttggactgctcgacctcgtcattggacagggcggcatcggagccggcccatgcggtggcgccggtcagaaaggtggaaacgccagcgccggaaccagacgggttgtaggcgaccttggcatccgggttggtgccctggaagccggcgatccaggcttccacagcagtctgctgggaggaagcgccagcgccggagaagttgccggacacggcttcggtggtcttggtgtcggtgctagccgaagaatcagtgttggaagcagtgttgtcgccgcaagccgcgacagaagccagcatcacaatgccggacacagctgcaatggagcgtacgagaatggaattacgcattattcttttccctctgtcaacattctgatggcgtatgtttctgacatttcatatgctgttgtcgccatcgttcttcatgacactgtcaagcctattggtggtttgggtcccgcaaaaccaaaatcggtgaacggaagatgaacactctacgacacttcggacgttttcgtcatttccattcaccgatcttcggcgactaccgtgataccacggtcttacattcagttatcaattaataatcaattattcggaaacttacgatgattactggaatcgcagtgttttatcttatatatttccatctatcgcgatatttccgctttattccgcaggaacgtcaattttgtagcccaaaccgcgcacggtggtcagatatttcggatgcgccggatcctcctcgattttggagcggacacgcttgacgtgtacatccaacgttttggtgtcgccaacgtaatcggacccccaaatgcggtcgatcagctggtggcgggtcatcacacggcccttgttctgcatgagatattcgagaagctcgaattccttcagcgggaagaacacgttctctccgcgcaccatcacctcatgctggccgatcttcatggaaatgtcgccgcagatcagcggaatatcgtcatcggaggattccgtcgcgtcggccaccatctggttgcgtcgcagcaccgcacgcacccgcgccagcagctcgcggaacgagtacggcttggtgatgtagtcgtccgcgccgatttccaaaccgaccaccttgtcgatttccgcgcttttcgcggtgagcatgatgatcggcacgcggctttgctcacgaattctgcgacatagcgcggtgccgtcaagccctggcagcatcagatcgagcaacaccaaatcgatgccgcctttggtgaacagttccagcccttcctcgccggtggccgcggcggacacgtcgtagccttcgcgggtgagctggtagaccagcggctctcgatacgattcctcgtcctcgacgatcagaatacgtgtcatcagtgcttctcctccattgctctgttgatgggaacgttgcttgttatttgctgtattcggtttagctcagattattcggattactcggattgcgtagtttcgatgcgttcggtttcgcccgtcacttccatgcgatccgcttccgcagtttgtacgtttcccgcagtctctgcagtttccgctgtttccaccgcttgcgcctgaggcagggtgatggtgaaggtcgatccctccccctcacgcgaccacacggcgatagtgcctccgcaatcctgcacgcaatgtttggtgatggccaaacccaatcctgtaccccctgtttcgcgggaacgtgcgggatcgacacggtagaatcgctcgaaaatacgatccagcgaggattccggaatgccaatgccctgatcgacgacacgaatcgcaacctcgtcatcgccactgccgatgccgactgcgacggtggtgtgttccggagaatagttgacggcgttttccaccagattcttcaccgccgttttgatggtttcatgatcggcgttgatgaacagatcatcctcatcgacagcgtttacggcaccctcgacgtgcaccagcttctgcttgccattcagcgaaagcaccagattgatatgcttcgattcggccttcacctggttttcgacgatcgcctcgcgtaccaacgcaagcacggaaagccgttccgcgttcagcaccgcagccgcgctttgcgccttctgcaagtcgatcaagcgatgcaccaattccgtcaatcgttcggattccttggaaatgcggcccgcaaaatacttcaccatgccgggatcgtccgcagcgtcgccgatcgtttcggcaagcagggaaatcgcaccggcaggagtcttcaattcgtgcgaaacgttcgtcacaaaatcgcgtcgcataatctcaaaacgacgctgctcgctcatatccgaaatgaaaatcgcaaaaagatcatcggagatctggccgacccgcacatgcagatacagcgtgtcggaaggacggaacttacctgcctcaatgcctttgccgtcggtgtttttcgcggccgcacgggcggctcgatccagcggaatcgacaattcgcgttcgcgcaccacgctgtcggtcgacaccaatcgcagaatatcgcggatttcggcaagcgtcatcgcactgtcctcaacaatgccgaaacgttgcgcgcccggggaaacatatgtgaccgacgccagtgaatcgacgacgatcaacgcctccggcatgacggcgatcagctggcgttccgtggactgcacgggcacgcgcggcccgaacagcgacatgttcttctgcgcgccgaacaggcttggatcgttcgggtcgatctcatcctcccccaattgcacgccacgggcacgccccagcaaaaaggcgaccacagcgacggcaacaaccacaatcgccatcaccacgtgctccagcgtcatacgttaaccttccgataatccgtcattcttcttcaacagtagcggttccggaaagcgatttccgtgcgcgattccctcacgccatcggaagtttccccgcagttcactttcgtgagattcgccataccgaaatatgagacggcccgtccagcaaccgatgcgttggacgggccgtctttcatgcgcttacatgcgcttgacgatgttcaccgcgattttcgccgcggtgtcggcatattcggaaatgtcgaattccttgaattccacgtaatccgtgtcggcattgtcgctcaacgcgcggatgaccagcacgggcaggccgttgcgcgccgcgacatgcgccaccgcggcgccttccatttcgaccgcgtccgcgccggtttcgcgaatcacctgctccactttcttcggatcgtccacgaaatagttgcccgtggcgatgatgccggtgatgtgatgcacgctcagatcggtcagcaccttatcggcgacttcgatcagacggtcgtcggagtggaattcctccaccggctggtccgcagtgcctggcttccactggccgacgagacgcatgtcggtgtcgaggtagcgcaacgtgccgccaagcaccacgtcgttgatgtgcagatgcgtgttgagattgcctgcgatgccggagaagatcacggcgtcaggctggtccgcgtcgatgagatgctgcgtggtggcggcgatattgacggtgcccatgccgccgaccgttgccgcaacgttgacgcgagtgcccttgttggtttcgatggtgccgcgtgtcacgctgacgccggcttcctccgttacggtgatgtcgctcaatgcggatgcgatattggcgacttcctcgtccatggcgccgatgatggcgattgtgctcatgcgttcgttcctttcgattgcttcacgcttttcgctcggtttcgcttattttcgcttcgctcacttccagcggcgcttgcccacagcttgcgcaagttcgcgcagcaacgcttccgtaatctgccagctcaagcatttgtcggtgatggattgaccgtacgtgagttcggcgagcggtgccggtttttgactgccaccttcgatgaagctttccatcatgatgccggtgatgccttcctcaccttcggcgatacggcttgcgatattacgtaccacttcgacttggcgatgttcgtctttgccggaattgccgtgcgagcagtccacgatcagaccgtgtgccgccgcggattcgaccggcatttcctcacggatgagcttcatggcattcgccacggattcggcgtcatagttcgggccgctgctcgaaccacgcaataccacatggcagtcgggattgccgagcgttttgactacggccgcacgacccatatgatcgatgccgaagaacgtatgctgctgtgccgacgcaaaacacgagtcggtcggcgctttgatggaaccgtcggtagcgtttttgaagccgatcggcatcgacatgcccgaagcgagctggcggtgcacctggctttccgtattgcgagcgccgatcgcaccccagctgaccgcgtcggaaatgtattgcgggctggttggttccaggaattccgtggcggtggccaaacctgcgtccaatacgccaagcagcgtacgacgggccaaaagcaggccttttttgatattgcagctgccgtcgatgtcgggatcgttgatcaagcctttccaaccgaccgtcgtacgcggtttttcgaaatacacgcgcatcacaatcagcaattctccgcccagctcgtctttcaacgcggccaagcgacgggcgtaatcgagtgcggcagccggatcatgcacggaacacggaccgacgatcaccagcaatcgatcgtcctggccgtacaggcaggcacgaatctcatcgcgtgaataggcgacgatctcttgcgcctgatcgctgagcggcaggtcccccaacacctgcgccggcgtgggaagcacctcgaattcaagcaccctgcggttcacgatgcggctgatgccgacctgatcttcccagcgtggcacatccgtagccaccagcggattctttccctcatccatggcctcgcggatggcgcgaagctcttcaggcgtgttcagctgctgctgcatttcactgctctccttgacaatcacctatctccccaagaatatcaatcaaatggcagtcgctatgcaaaaaccgtgcgattacgcagttacgcgtattccgcacggttagttatttgcgattatttgcgcttatttggcgagtgcgcgacggctttcgaccgcatcggcaagcgtgtgcagcaactgttcggtacgttcccacggcacgcaggcgtcggtgatggacttgccgtactcgagctggtcgagcggagcgggcttctgattgccggctttcaggaagctttccatcatgatgccgctgatgcccgactctcccgttgcgatgcgggaggcgatgttttcgatcacttcggcttcgcgcacttcgtccttgccgcagttgccgtgcgccgcgtcgatgacaagaccgtgttcgctcgggccggacgccttggaaaccttcagatcggccaacgccttcgccacggaatcggtatcgtagttcgggccgtgcgaggagccgcgcaacaccagatggcaatcgggattgcccttggtttcggcggaaatcacacgaccgtcaagattgatggacagaaaatgatgctcgaaggcggccgcgaagcaggaatccgctgccggcttgatcgaaccgtcggtggcgttcttgaagccgattggcatcgacatgcccgacgcgagctcgcgatgcacctggctttcggtgttgcgagcgccgatcgcaccccagctaatcaggtcgcagatgtactgcggggtgatcggatccagccattccgtggctgccgggagtccaacgctcagcacgtcggtcaacaccttgcgtgcgagccacatgcccttgcgaatattgaactggccgtcgagatcgggatcgttgatcagacccttccaaccgatggtggtgcgtggcttttcgaaatacacgcgcatcacaatgaccagttggtcttccagttcttttttgaccgcggcgagttttgccgcgtattcgtgcgccgctttcggatcatgaatcgagcatgggccgacgatggcaagcagacgatcgtctttgccgttgagcacatcgcggatttcctgacgggacttcaacaccagatcgctcatctcgtcggtgagtggaatttccttcagaaaatatcggggagccggaatcgggtccaactgtcgaatattgacatccacggtctccggaaacacggcgttatccaacaactgcgcatccttcgaactatctggaccgcgaagacctgacatctcttctgctcctccttatacctgcatacctgcttcatgcatactgtgcatggatgataatcaccgaagttaccttaacggataaaagtggaataacacgaatgccgactgcatgctggactttttgcgaagtcccatgcagtcggcattcgtcaatcggtttgtcggtttacgtatcagtcagccagagcgcccatcggatcccatgcggggagcatggtggctggctcgtcaagagcggcctgatattcggcagggagcagcgccttcggcacggcgacctcgtacacgtattcggtgaaccagtcgtcgctcatagtgaagtagcccttgtctgcgatcttgtcgccccaagagttctccacacgccaacgacgggtggtcgtgccgtcttcggccacgtccacgccgacgaacgccatagcgtggttcatcgcggaatcggcgaaacgcacgcgatcttccttgttcagatcgaagtcgacgccatacaccttgccgtattcaaacagatcagtagcccaagcgccgttttcacgatccatcatcgggtggcagtcagcaccgaaccatactggaatgccctgctcttcgagaatctgacgcacgcaatccttcatgaactggttcggcacgttcaggtattcggtcgggtctcccccggccacattacccaagtgctcgataccgatcttcttgcccttcgcatgctcctgacgaggatcgtcgaccaggcacacgtagctttccaaatcagcggaaccgacgtacttctgccagaattccacaggcgtgacctcaccatcgcggtggaactcgccgtccttgtcggtccactcccagtcgaagctcttcggcggctcgcccaagtgaatcgtcagaatgcggtgtccggcggcggtcgcttcggcgattaccgattcgatcgaagccggatcagcatacatgtgcgcgacggccgtatgcagcaggcgacgcaattgcacgttcatttcgccggtgttcttggaagattcggtttccgggaacagatccttcggaacggcaccgtacttcttgtacacgttcatggccatggtccactggccgccgtcgcccatcacgtcggcgagcagatgctggatcaggcgggagtcggacggctcgccggccttcaccagttcggccacgtcctgcaggaagtagttgacgcgctcgagcttgtcgtagtacatggcatagttctgggagaactcgaattccttcagccccatgttcttcttggccacgaaacgagccacgttcagcgagctgaacagccagcaacggccggaacgatcctgatgggtggcggtgccattgtcgacaatggtggagaatcggcgctgcatcaggcgggcgcggtcatagttgcgtgccaccttgttgatgccagccgcggtgaccgcgttcatggccatacggttgtggtcgctggcttcgaaatcctcaaccagcgttgccaatgcatcagcgctcaacggcgtgatgtcagtcattgttctgttcctcctgtgcttcttcgccctggtcagactgctcgtcttcggacggttcttcaaaatcgtcattattctgctgttcgtcggagacaacatcctcgtcgaaggtcacttccggttcgcccgcaacagtttcgccactctcgtcgtgcgattccgccggagtttcagcttcagctgcggaatcatgctgttcgccgtcgatggaattgaccacggacaggccgttcgcgccgaaaccggagaacgcgttggcaaacatggcacgcagttcactgacacgctgcgtgatctgcgcctcacgggtctgcaggtcggcgatgcgctgctgcacaccttcaagctcgctcttggctgcctcacgacgctcgttgatctgctcgtcggcctcttcggtggcctgcttgagaatgctggcagcctgcttgtcggctgcctcacgcttgtcggaagcgtatgcctcggcctcatcgcgcgtatgctgcgcttctgaaatcagctcgtcggactgcttcttggcgatttcacggcgttcgttcaggtcggcgagcagctcgttgaccttcttcgtagcctcatcctgctgggcggaaatgtcggcgcggatctgctccacctcggcattgacctggctgatggtcttggtgcgatgcacttcggcctcgtcggtgatctcctgtgccttggctttggcggtatccgtgatttccgaggcacggcgctgcgcgtccgtcatcatcttggacacctgctcacgcacgtcggccagcttcttgttggcttcggccaacgcggattcgatctggtcgttggtctcgcttttcatgcggttgatctcgtcattggcgttcttgcgctgcgccgcgatctgctcggtggcttcggcgcgcagatcggagagctcgcgctcctgcgtggcgcgctccgatgcgagacgcttgtcatgctcctcacgggagttcgtcaattccagatcgacggtctggcgctgcgccaccacggccttctgcgcttcgccacgcagctggtccgcttcgcgctgggcgttggacttcaacgtgtcggcatcattattggccttcgacagcaccgcttcggccttggcgttggcctcgtcgagaatacgcttggcgtcgagcttggcgttgttcagcagggtttcggcctgaagctgcaccgtggcgcgtgccgcggaagcgtctttcttggcacggtcgagcagctcggcgctggtttgttccgcgctggcgagcatctgctgcgcgttggcgcccagagacgcgaacgaattcgggttggccttcttgtttttctcttcctgcagctgtgcctgcagttcaaggatggtctgatcgtcggccttgacctgatcacgcagacggtccaccgtctcctgagccaaagcgaacgcctcatcgaccctttccttgtcgtaccccctcaacacgattgggaactgctcaaccatggtattcctttcacgaattcccttccatcgcgcatcttgcccgcgcctatccgttttgaactttagcgcagaacaaacgttcggcacacggcagtcgcataattctcacagagagcacagaaatcgttcgaggaaacgccgacgccgttcagccgagcagaatctcacttgaggatggctgcagataataacgcaccgattcgcggatcacatcgttacctgcggcgatttgctgcgcgattgacagtccatgttgcggatgtggctgctcgttgacgatcggcaggcttacgaaacccgacagaatgcgcttttcctgcgctgcagaccagtcgagcaaatggtagaacagcgaattgcagacgaacgtgcccgcatccgaactcaacgcggcgggaatctcatgtttggcgaaatcgcgcagaatcgaacgcaacggcaggcgcgtccaatatgccgcaggcccttccggattgatcggacggcgaggcggaatcacattgtcggcgtcaggcttggccgcgtccatcagattcgtggcgcatcgctccaacagcacgccgcgggccgaacgcttcaaaccggtggcgatgacaatatcgggattcgcctgttcgatggcgttcagcaacatgggccaggcattggcgaaactgaccggaagcgtcaccgtcgtcacgctcatggaaacatcctgcagaagatcgtcggacagcgccacggattgagatggatcattccaatattcggcgagcgccacgggaacaagtacggccggattcacgtcgatgccgtcgtacggggtgaaacctgagatgacgatgttgatctgctgcatgtgttccagtgtacgtggttgaaagatgggttcgtttacgatcagtgcttatgcatttgcgagaatgcttcggcgaacaccgcgtgcatgcgcgctttcgcttcttgtttggcatgttccgggtcgagactgcgcgcgatgttctcggcgatcggcatgtcggcctgtgtggtgattttgagattcgtttcggatccggcgacgatggcgaccggctcgttcggcagatagtccaccaccacgcgggtgtcgtcggttgggtggaagtcgggatcggcggtggcgagctcgtaggctttggtgatggtaccgaaacggaaggcctgcggggtttgcgcgcggaatgcgttcgtacgatcaggcacggagcgcaccaccttgcgctctccaagatcttcggtcagtagaatcgtgtcagtggacgcgtatgccacggtcgccgcgttgaactggtcgaggctgtcgatgcagccgtcgatggattgctgttcgacgaacggtcgcacggaatcgtggatgaggattttcgcgccatcgggaatgcctgcctgcttgagcagatcaagcgcggagcgggtgctgtccacacgctcggagccacccggaatcacggcacgcaccttggtataaccggcttcgtcgatgagcatgttcaccatattgctgacacgctcgttgaccacgacgatgatgtcgctcacgcgatcgttgcgttcgaacgcctcgatgctccagcagacgattggcttatcccccaccgaaaccaactgcttgggattgttctcatcgaatcgcgtgccgaaaccggccgccaacaccacggccacaaccggcatcttctgttcctgcatctgctctctctcactcatacgtcccaccgtaaacccccgaatcggtttgcagcgcgttttgccttacgttctgcacgcaatccgcaatagcgcgccgctctcccactattcgcgcacgatcagcgcaagcatacgaccttcgtgcgctttgcctgcgatggtggcacggcgatgcgagaaccagagcggattttccagcgtgcacaggctacggcggattttcttgaaacgttccgcgagctgcggttcgccttcgccatcggcctggcagatttccgccaattcctcgtcttcggaaagatactgggtggctgcgttgacgcgggcgcgggaggaaacgacgttatcagccggaacaccagctttggcaagctcctgcagcgcggcggccgcaatatcgatgcccggctggccgaaacggctcagcgtgaaggttccggggaactgcgcgtcgaattcgtcggcaatgtctccgcccacctcgtagcagtcgccgcagatgcacgggcccagcgtggcgacaatacgctccggcctggctcccttggacaccatcttttcggtggtggcgccgatcacaccgttctgcaggccacgacggccgcaatgcgcggcgccgatcacgccagcttccggatcggccatgagcaccggcaggcagtcggccgcgaacatgccgagcgccacgttcttctgagcggtcacctggccgtccgcttcaaccactgccggctcatccgcggtttcgcccacctgctgagcggtttcgcccttgccgccagacacgtcgaaaccgaacggacggttcatggcgaacaattcgtccacatcgacggcaacgccggaatgcacctggctgaccaagctcagcttcgcgtcgatggcgttggagagcgccacacgattggcgagcacatggttcggatcatcgccggacttgcctccgagattgcagtgcgcataatcgccttcgctggtgccaccaagtcgcgtggtgtacacgactttgacgcccggcgcaagcatgatcggaatggtcaccgggattggattgccgtccacgtcggtcgggtcgatcgcattgctgtcaagaatcgcgtcgtcatactgcttgtcagtcattttttgttttccttgattgttctacgattatttcaacttatttctgctgattttctgcgtctacacgatgtttttcgcaattattccgctttgagcgtcggctttttggtacgagatcggatggctgcgttcacgggcacttcctgcgggcatggcatggagaagacatgcgccggattgttgatggattcgacccaatgtccgtcggcgtcacggaatccgcctgcgggaacggtgtaggcgagcggcgccgcgcccggtagcacgaattcgacttcctgaccggcttcgattttgttgcggctcataatggtcacacggccgccgtcttcttcgctccacgagagcacttcgccaaccaccagccaagcgcggaaatacgcggaacggtcggtgctttgctgcactttgtgttccggatagtagaagccggtggaatagtcgcggtgcgccaccttgtctggctcgtccagcaaccagtcaggcagggacacgtgttccgccgggcgcactccggcgtgataccagccttccggcaggatttccgcagccgtgttcgacttacgcctcgtactacgcgcatggtagctcagatcatccggttcgccggcggaagcgactggaacggttgcaatatccggcttccccgcgaacgcgccatccgcatgttccataatcaaatcggtggtttccggcttgccgtaatccggatcagacgggcgaatcacacggtcatggaatggcttcagcacagtgccatcctcgtcttcaaaaccgcgttgcaccatgtatgcgtcaacggcggtcttgtaagcgttcgtcatcgccgcaatatagtaggcgctcttggaacgtccttcgattttcagactggtcgcacccgaatcaagcagatcgtcgatatgcgcaagcatgttcatatcctgcgaattgaacagatacgcgccttccttagtctgttctatcggaaaatactggccggggcgcttttcttcgacgatggaatacttccagcggcacggttgagcgcattcgccatgattgccgtcacgtccggtcagataattggagaacagacaacgaccggagaacgccatgcacatcgcgccatgcacgaagcattcgatgtcaagatcgtcgggaatgcgtgcgcgaatgtctcgcacggcctgcagatccatttcacgggcaagcaccacacgacgtgcacccaactggtagaaggcgttcgctgcctgatagttggtgactcccgcctgcgtgctcacatgcagttccaggttcggcgccacttcgcgagccatgagcatcacgccaatgtcggaaacgatcagtgcgtccacgccggtgtctttgagctggccgatgtattcgcgcatcgcttcgacttcattgttgcgcggcaacacattgcaggtcacatacacgcgagcgccacgctcatgcgcgtaacgggagccttcttcgaaatcctccaaactcaggtttttcggcgccgaacgcatgccgaacgccttacctccgcagtagacggcgtccgcaccgtaatcgacggcggttttcagtcctcgcagattgcccgcgggagccaatacttcaggcttgtttcttctttgcacgcttgttcctcttactcgatttttccgctctatattctcgactattcacgggacacttctgccgcatccgggaaatacatacgaggaaaaacacatgcggaaaaacaaaggcgtccatcgtggagacggacgccttgacgcaaaacgttgcgaatctgacactcagccgagtttggcgagttcctcttcggtgagttcgagctcgtcggccttgagggaatcgagaatggtttccggtcgatgggcgccgggaatcacgaacatgtggtcgcccttggccagctcccatgcgagcaccacacgctggtagctcacgccacgggcttcggccacctcgcggaacggatcgaacaggtgctcgtcgtacgggtgacggtagccgcccaacggactccagcacacgaacgccagaccctgctcggcgcaatagtcaagcgtatcttgggtgtccagatgaatcggagaatactggttctgcacggccacaagcttgtcgccgaggatctcctgcgcgatcttcaactgttcgatgctcacgttggaaacacccgcccactgggccacgccctgatcgagcagcgccttgatgccttcgcaggactcgttgtacggcacttccggatcatgacggtgcaggtacagcagatcgatgctgtcaacgccaagcgccatcgcggactgcttgccgtattcgatcagatgctccggcttgccgtcacgcggccaaaccggcttgtcaccctcccaagcgcggcgcaagcccaccttggtggccacggtgacttcctcacgcgggcccttccacgagtcaagcgcctcacgcaccagcttttcgccggtctgttcctcttcgcccggcgtgtagtacgcccaagcggtgtcgatgtgacggcatccggcatccaacgaggcgtgcaatgtttcaataccgacatcgtgaccacgattgttttcaatggtcaacggcatttcaccatggccgatggccgtggtgcggaacggtccaagattacggaacaaagccatcccgatctccttcaacaacgtacagagtgtctttccgaatgcaaccttaccagccgacccgcctcagcagacaacaaacccaccaaacatgcgcgtaatgccgcagatcagcgaccaccgaagctgccgccgccggaaccaccggaggaaccgccgaaaccaccgccggagaagctaccaccggaaccaccgtaactgctggacggagatgccgcggcaatcgtcgattgaatatcagcaaaacctgattccaactgcgcgccaatatcaccaaaattggcgctcggcgagaaatccatcgaattcgtatcacacgaagcaggaccggcgtaatgatgattgaaataccatgaacggtaactccagtaaagcagcgaatcggaagcgttggcatcaagccaattcgggtcggcaagctgcgggtacgccttgagcagctgcttcatcgccttttcggaaatgccgaacgcggtggcgtacaccatgtagcgaccccacaacgtcagatcagccacaccacgatcacggaagtcgctgaaatcctccatataccgtttcaaaccgaccacctgaccggcaagacgctgaccattgtcgttaagccccttcaatttgaggtagctcagcgcaaacacggacgcgaacatcatcggcgcggaaatcagcacgcccaacgcaagattgccgatcacgccaaaatacactatggaaaggaacgccaggatcgcggcgcagatgcctgcggcgaacgctcccccgccgcatgacgaagtggcacccaacatggagaattcgctactgcacgcattcgtaaacttttcctgatacttgtagcccttcgaccaatcggagaaattcttgtccatctgtttcagatcgaacaccggagaaccaatgcgttcggacgccttcaccagcaggtcgagcgcggtacgttcgctctggctcagcgccaatgactgcgggttatcgaacaccaccggcagtatcacgatggtgctggttttgcctgcatcacgcgcacgagctggatcattggaaatcagctgcgcgatatcggcattgcgagaccgactcatatcaatgccccgatacatggcggccggccccgggtaaatggcgattgctccacgcgaagcgagcgagagcacggaagccgacatttttcggctcgacagtgttttcgaatgcttgttgtcaacgatatgcagcagttccgcagcgctggcggggctcatttccggctcgtcacgccaatactcgatgtcaccgtggtattgcgaacgatcgaaactgtgcaatgcgagcacaacggcgatcacacacaagatcagcccggccacggcaatggcgatccacgtgatcaggcggatacgcgcttttgtgcgctgccggtcacgccactgctgctcctgttgggcctcgctttccataatgccgtttttgatggtggtatcacgagtgcgtgccacaccgctggtcgcaccgacgtcgaacatggcgaccacgtcaacatagtcgccggcacgaacgtcgtgcacggtgaactgcaacgaccccttatcaccacgttcggtggttgacgtacgttcggtgtgcagccaggcccatgaattatccgccgtaatgccatccgggaacgtgacggttccggtgactttgccgatgggaatctgattgctcacgccgagcggctcccattggaacgtggccacgtcttgataggcggtggtcacgccctgcatggtcatggtcacatcgaatttcaggctgctcgccgacgtggtggcgggaatattccagccgatttcgattttcttggaacgatcgtcggtattgtcggcaacaagaccgtcttttgcgggatcgaacggctgcggattgctgtcaccttgcgaaacatcggcgatataccactgccccgcatgttctcgattccattcgtcggtgctatagctgcttgggattgcgatatcaccctgctggtaggtctctcccgtcgtcgcgttgcgcacgctgatatcggtgatattggccaggttgctttccttcagcgtgtactgctggtacagctgcttccacggatggtcgccgtcgtcatcgctgcggtcggcgagtttcatatcgatgtgttgggtgattttcaaatcgccattgctttgcacctgcacatcgtagtcgagcgttttgtagctcagatcggccctaccgtcatccaatgcgatggccagcaatatggccgctacaacgccaacggtgacgacgatcgcgataccgaagctgcgcaccgctcgcgacgcatgctgtttggccgtcataatccctctttctcgcttcttcttccctcagatggccgtacaacagatggccgtacaagccgaattgaacagtaaagccccatcgtcatcggacggggctttacatgcatgtcagaacttaacttgcggaacctgacgatccgcttcgtccacctggaagtagggggcctgttcgaaatggaacaagccggcgataatattggtcggcacaacctcggtctgggtattgtacttctgcacgacatcgttgtagaactggcgtgcgtaggcgatcttctcttccaacgattccagctgattctgcaaatccatgaaattcgtattggcctgcagctgcggatagttttcggatacggcctgcagattgacaagtgcgcggctcagctggttttccgcagcgatgcgctgcgccacgtcaccgctttgcgcggcctgcaccacgccggcacgggcctgcgtgacctgcgtgaacacttgggattcgtgggccgcataacctttgaccgtttccaccaggttcggaataagatcggtacgctgcttgagctgcacgtcgatctgcgcccaaccgttcttcacacgattacgtagcgtgaccagcccgttgtaggcgctgacggcccaaagcacaataagtacaacgatgacggcaatgataatgccaacgaccatgacgactccttcgttaatggctcttcacaccattcttgcatgcgcccaggtacgttatgacaaaactcatgcccccgtgtctcattttcatgcaatctgcatggaaacgcaaaagtgccccgtaccttccggtacagggcacttcagtcagtcagctatgctgcgagggatcctttttgaggcgtcagtcctcaaaaggatcaaagtcgcggcggacgcggcggcgaggacgctcggaacgctcttcgcgatcggcacggtactcgtcgtagttctcgtcggctgcgtaacgcggattgcggtcgtcgcggcggctgctgcgacgacggtcggaacgacgatcatcgcgatcgtagtcacggtcatcgcgatcggaacgacgacgacgcggacgatcatcataatcacgatcgtcacgatcggaacgacgatcatcacgatcgtagtcacggtcatcgcgatcggaacgacgacgacgcggacgatcatcgcgatcgtaatcgcggtcatcgtcacgatcggaacgacgacgacgcggacgatcatcataatcacgatcgtcacgatcggaacgacgatcatcacgacggccacggctgccgcgacggtcatcgcgatcggaacgctcacggcgcggagcggaggattcctgatcttcgaagcctggaatggccagggagatcttgccgcgatcgtcaacgccctgcacgactacctcaacggtgtcgccttccttgagcacgtcttcgacggcgtcgatacgctcgccgttggccagattacggatctgggagatgtgcaacaggccgtcggtgcccggggtcaggttcacgaaggcaccgaaggaggtggtcttcacaaccttgccgttgtaggtttcgccggcttcaggaacgtgcgggttggcgatctggtcgatgatctgcttggccttttcagcgccgtcgccaccttcggaggagatgaacacggtaccgtcatcttcgatggcgatctccgcaccggtctcttcctgaatctggttgatcatcttgcccttcggaccgatgacttcgccgatcttgtcgaccggaacggtggtggtgatgatgcgcggtgcgtacgggctcatctcggccggaccatcgatgcactcgttgatgacttcgagaatggtggtacgggcttccttggcctgctgcagagcagaggccagaatgtcagccggaatgccgtcgagcttggtatcgagctgcagagcggtgatgaactcggaagtaccggcaaccttgaagtccatatcgccgaaggcgtcttcggcgccgagaatatcggtcagggtcttgaagatgtgctggccgtcaacatcgccggacacgaggcccatggcgatgcccgcaaccggggccttcagcggcacgcctgcggcgagcagcgacagtgtggacgcgcacacggaacccatggaggtggaaccgttggaaccaatggcttcggagacctgacggatggcgtaagggaactcttcgcggttcggcagcaccggcacgagagccttctccgccagcgcaccgtggccgatttcgcggcgcttcggggagccgacgcggccggtttcaccggtggagtacggcggcatctcatagttgtgcatgtaacgcttggactgcggaccggacagtgcgtcgatctgctgttccatcttgagcatgttcagggtggtgacgcccagaatctgggtttcgccacgctggaacagtgcggaaccgtgcacgcgcggaacgatgtccacttcagcggacagggtgcggatgtcacgcaggccacggccatcgatgcggtaatcctgggtcaggatgcggcgacgcacgatctggcgctgcagctccttgaacgcattgccgatctccttttccttctcggcatcgtccatgtcggtgaattcaccggcgagcgtggccttgacgccctccttgatctcatggatgcgatcctggcgaggcagcttctcggcaatggagagggcttcgtcgagatcggcgtgggcgatctcatcgatacggttgtacagatcttcggtgtactccgggaagagctggaattccttggtttccttcgcagcgatcttcttgagttcggcctgagcctcgcagatcaccttgatgaacggcttggcggcttcgagaccaccggcgacgacttcctcgtccggcttggtctggccttcgtcgtagatgaggtgccaggcgttcttgcctgcgccggcttcgatcatggcgatggcgacgtcgccgttttcgacgacacggccggcaaccacgatttcgaacacggcgcgctcacgctcgctccaacgcgggaaagcgacccactggccgtcgatcagagccaggcgaacgccggaaaccgggccttcgaacggcagaccggaaatcatggtggaagcggaagcagcgttcagagcgataacatcgtaggcatcgtccgggttgacggcgagcacggtttccacaacctgcacttcgttgcgcagcgtgtgcgggaacagcgggcgcagcggacggtcgatgatacggcaagccagaatcgcctcggagctcggacggccttcacggcggaagaacgagcccggaatcttgccggcggcgtacatcttctcttccacgtccacggtcagcgggaagaagtcgtagttctccttcgggctggaaccggcggtggtggtcgacagaatcatcgaatcatcgtcaagataggcggcgacggcaccatccgcctgctgggcgagacgaccggtctcgaagcgcaacgtgcgcttgccaaatgaaccattatcgattacggcttcaacagccttgatttcgggaccctccatagggttcctcctttttcttttcttttaccaactatcggcagtcctcttcagcggactccaaccgatttctgcatgcgtgacgcgacgtcaccttcgtcgcttcctcatctttagattctagacctcatgcaccctaaaccttgggctttcaaactgtcttttcctcaacgcggctgtcatgcaaaaacgcccgaacgccaaggaaggcattcgggcggaagaatgtaactatcggcgcagacccagacgctcaatcagggagcggtaacggttgatgtcgacgcgcttgaggtaatcaagcatacgacgacgatcgccgaccatcagcagcagaccacgacgggagtggtgatcatgcttgtgctccttgaggtgctcggtcagatcagcgatacgcttggtcagcagagcaacctggacctccggggagccggtgtcaccctcgtgggtagcgtaagtcttgatgatttcctgcttttcctcagccgtaagtgccacggcatcctccttatattgctgcgcggtgctgccggcccaataccggcgcgctctctatccgcgggcgaaacacgccaaggggaaatcatacacgaagggcagaccaaatcgaatccacaacaaatggcggatcagaccacgttcagcagacctccgaacaacaccacggcgagcgcgatgatctcaatcgcgaagaacagcaggaacgatgcccaactgcgcgtcagcacattgaatttcgattcctttttgatgcataccagcaatccgacccagagcaccgcatagaaggcgacaccgcatccggctgcgataatgccaaggttcgccgcgttggccagccctgaggaatcgccgtacatcacgtaggtggcgttccaaaagttgaagctcagcagacatacgccggcgacgaactgttcggcggcgagtcccaccacgaaaaccgtgccccacagccatttcttcacatccgcaaccatcaatcccaaaccggccatcgccataatggtgaccgtccacgaaatcagcgccacgcctttgggatcgaggaagctgagattggccaccatccaagccgcatccttgactgcgatgacacgtccccaccagtaaggcgcgatcaaagccaccagcaccagcgcgatgaacagcgcccaatgccccggatgcgatttgcgccgttcgatatcggccaaggaaagatcggacgcctcaatggatgccgttggatgcttggaaacgtcgacctgttcgaccacgccgtcgacgacttccgtcaccttgttgccttgcgtttgtgccatacccgctccgttgtattgcgattgtcgcaccgctgtcacgacacgtccagcatacccagtcgtcgaagcaatcgtacggcaggtatgcaaaaggcgtgccgtcaagcacgcctttcttcttctctaacgattgtgtggagcggatgacgggaatcgaacccgcgtaatcagtttggaagactgaggctctaccattgagctacatccgcgtaccgtctatgccagccgaagccaacacgaaacgactcgagccattatacacactccctcaacaatcgcaagtcgaaatcgtaataattatttttcgaccacgcaaacctggtacggctccaacgcaacttcggcaggaagctcgatatcgcagtccgaatcaagacgcgcgatctgacgtgcggacgagaaattgaacaatcccaataccgtacgtccttcaacgtggcgcaccaccgcaagaaccgcatcattatgcgcatcccaagtagtgacccatgcttccggagcgaacgcgggatcgtcgcgcatctcacgaacgctcttcaaaccgtcccacatctgcttctgcagcgtgcccgcctgcttgcgcttggccgcattctcccaattgaaggggctgcgatgcagattgcgcgaatcctcgacgcgatcgggatcctccttgtattcccagccgttgagctgcacgatttcgtcgccgcagctcagcatggggaagccacgcaggaacgacatggcggaatgcatcatcagatcgcgtttcatcgaaatgtcgagcagcggcttgtcatgcgtgatcagcgcacgttccacaccgcacaggctggccgtggtgccgcagctgcgcgcgtccttcgatgcctcgtcgtagttgtacagctctcccatagcccagctgccaggcaccgatccctcgtagaagtggtacaggaattccttatgcttgagcgggtcgatgccgaggctctcctccaccggctcgtccaagccccagccgatgtcgtcatggcagcgcaggtagttgacgaaccagcagttctccggcagcgcgttaagcttgtcgagctggtctttgagcaggcgcacgtccccactggcaagcgcactccacagattcaccatgatcgacacgttgtaaagcatgtggcattccggcttttccggcgtgccgaagtaggcggcaagctccttgggggccatcaccacttcgcccttcagcactacggccgggcagacgcattcgagcacgatgcgcagcatacgcacgatggcgtgcacttgcggcagattgcggcagttggtgccgagttccttccagatgtaaggcaccgcgtcgatgcggaacacttcgacgccaagattggcgaggccaagcacactggagagcaccgacacgagcacgctcgggttgcggtagttcagatcccactggaacggatagaacgaggtgagcacccacttgtgcatctgctcgttccaagtgaagttgccgggcgcggtggccggaaagacttccggcaccacggcgtcatactggtcggggatggtgcggtcgtcgtggcagtagtagtagtcctgatatttcggatcgcccgcttgagcggctttggcccagcgatggctggatgcggtgtggttcatcacgaagtcgaggcacaggctgatgcccgccgcacgcagtttcttggtgagcgcggcgaggtcttcgttggtgccgagcgacgggtcgacggtgtcgaaatcctccactgcgtaaccgccgtcattctgcggatgcggcattttcagcagtggcatcaggtgcagataggtgagtttctgttccttcaggtacggcactttgtcggcgagtttcttcagatccccggcgaacagatcggtgtacatggtcataccgaacatgttgccgcgcttgtaccattccggatcggcgagacgcttggtgtcgagacgcttcagatcggcggggcgcgcatcgtgggctttggccatcagctcggtgaggttgcggaaggcttcgtcggcctgctccccatacagatccgtcaatagttcgcgcagttcctcactatattgtgcgacgcgctcgtcaaatgctttgtcggatttggaccgtgccattccttgactcctcttcccagggaacttcgttgttatgagttggattccgcagcgttcgttgccacgacgttggcaccagtgtagcgtgattttacggttttatcaaaccggttcgaggtgttgtcgcgattgacgtcaatcgattgacgcaatcacttgcggtcacgcttctatcgtcaccaccgcggatgcgacggatccgtcatgactcatggaaatatggattgcgcacgattgatcatccccatcaaccggcaatcccaacgattgccgcaacttgcgtcgcacctcgggcgagagcatgacacggggcacgccgtgggaatcgtcaagtatttcgatgcgcgcccaaggaaaatcgtcgagcgtgtacggataggcaatgtctccatcggcatttgccctgcgtgaaatcgcttcgcaccacgccttgagaaaagcctccttgcccgcccatcgggccgcaagatgcaccgcctcaccgtcccttttgacctgcacacgttgagcggtctgccatagctcgcgcatggagaacaggtttcgcatgcgcgaccccggttcgcccagttgctcggcgaacgcaggcacatccacgacgtcatgccctaaacccagcattttccagcctttcgaaagttttcaggaagaaacgaaccatgtcgacttccgcgaaacaggcgggcgacacttcgctttcatgcaaggacaccatcctacctaagcgcttcatcctctgccacccgcattgcgcgcccctcgtttcgcgtctgcacaagtgaaaatacgacaccaaacggaaatcgtgcagacggaaagtagagtgattcaagaatatgaaaatcccgtatctgccgcgaaatactgagattgcgacagatacgggattttgatgatcgtgcgtctgagcgccagaaatttcaggcgctcagacgcgggaatcaggcttcgaagtagccggaggcgcccaggcgcgcgttcgggtcgagcaacatggccttctccacctcgtgcgcgttgtagccgcggctatcctcatggaaacgacggttgtcgatcggctcgtagagcgcggcgcggcccatcatgccttcctcgaggcgacgctggccggcagccaaacgctcgttggcgcgatcacgccatgcattcagtgcctcgacgcccgcggtgttggccactgccgcttcgaacgcgcccggattgacgatcgcagcgaagccggacacgtggccgaaaccgagcgacgtggccaggcccgccttgacggagccgaccttcaacggttcgcgcagccagaccatgtggtcgtcgcgcatgagcttcggatcaacgcagtcaagggcggcattggccggaatcacgccggacttgaacagctgggtcagaccgttgacctggaagatgcaggcaccgcccttggcatgaccggtaagcgtcttctgcgagatcacgaacagcggattgccgtcggcgcggccaatggcgtgggccaacgtgttgtgcagttcggattcgttcggatcgttggcgttggtggacgtatcgtgcttggaaaccacggcgatgtcgtccggggtgacgccaagacgggccagatcgcgtaccagcttggaatccttgccgcccatgcccgctgcaagcgcacccaagcccggagccggaatggaagtgtgcgcgccgtcggcgtaggagtgcacgaatccgattacgccggcaaccggcaggccgagcttcaacgcgatatcgccacgggtcagcaggatggtgccgccgccctgggattccacgaatccgccacgacgacgatcgttggcacgggagaagaagcgcgcgtcgatgcccttggcgtacatttcctccgaattggcggtggcgttcatgttgccgaagccgatcacggattccacgccgatgtcgtcgatcgcaccggtgaccacgaagtcggccttgccgagcgcgatcttgtcggcaccctcttcaagggagacggcagccgtggcgcaggcggaaaccggctggaccatattgccgtagccgccgatgtaggactgcatcacgtgggctgcgacaacattcggcagagcctcctgcagaatgtcggtcggaatctcatggttgaggaagcgattcaagtacagcttgcgcatggacgccatgccaccgaaaccggtgccctgcgtggaggccaccatcgacggatgcaccgcctcgaggatttcggtcggcgtgaagcctgcggacaggtaggcgtcgaccgtagtaacgatgttccacaaggcgatcttgtcgacgtcgccgaccatggaagccggaatgccccacttgaccggatcgaagcccttcgggaactggccgccgaccgtacgggtcatggccgcgcgacgaggcacgcgaatcatggagccggcatggcgggtcacgttccattcgccggattccgcatcggccgcgaagctggtgtgcgcttcatcaagcttgacgtactcttcggcaatctcacgagtcggaaccgagaaggtcacatcgtggtcaaggaacacctcggcctcttcctcatcggtgccgtccttgtagtcgttgcccatgccttcgtcgaacggacgcacgccggaacgggccacgacctcgtcatggtaacgttccgcgatatcctcctcaggcacgaggttgccatcaacgtcgtaccagcccggcttgggactatcgttccacgtcagcaggcccatattccatgccagttcgagcaccgcgccggcagacagatccacctggccgtcggaatggatgccgagttcggcttcgaaacgggtgcggccggagccccatgggccaagttcacccacggacacgatgacgatttcgtcttccggacgtgcactgacgttctgccaatcggcaagatcgaccttggcctgacgcggagcacgcgggcttggcagcgccttgatgagcgtcttggccgcggtatcggattcgttgcttgcgattgcgttcttggcattcgccgcttccgcttgggccgcgtcttccatggcttccgcacgcagtgccttgatgtcgatcggctcgttgccgagtccgccggtcagatccacgtcgagcggggccttggctgcttcgatacgggattcgcgggtggaaaggttcagcagttctaccgcgatttcggcggtggaataggtcttcagaccgtgacgctccaccacttcgaccagcggatcattgccgcccatcaagcccgtgccgcgcacccagccgatcttcggatgggcgaaggtcacacggctcgaccacaccttttcggcgcgagcacggttcacaatcgcatcaaacgcgctcttcacttcgccgtaggcaccgtcgccgccgaaaataccgcggttcggcgatcccggcaacaccacatgcaacttatgctgcacatcggtgtcggcaccgatcttcgcaagtccggcaatcgcacgctcaacaccccacagcatgaggcgagcctgggattcgaacagttcgccggaatcggcgaggctgccatgcaccggcggagccgcgaacgggaagaacaggctcggctcgtaagcaggtttgagaatcgtggtggtcgcaccggaagtcttcttctgcacattgccgacccaagcgaccaacgcgtccacgtcacggtagcttgacaggttcgcaggaaccagccacaacttggcgtcaccggccgcatgctcacggtaggtctgcttggcccatgccttcacgcttggcttgaagctgtgcgaggtggccaccacggtagcaccgcctgcaagcaggccgttgaccacctgggctgcgatggagttcggagccacgcccgtcaccacggcgatatctccagcgaaacggctggtttccgccgattcggaagcgttttctcctgcttcggcagcgacacgattgaatgcggccttcagatccgcgttgtcgctcttgcctgcataccaggcggcttcgtcggcaatggtcttgccgagaccgatgaagctaccgttcaatgcggattcatcgttgttgtagtaggcgcgtgccagatcctcacgtgcggatgcccaacgatcgtcgaacagaatggccttgcgctcgtcgaaacgaggttcgacctgcttcggccagtcagcaccgagttcggcttcgaccgcagccacaacagccgcgttctcatcagcagtttcttcggcaaccggagcggcaacgcccagctggttcagcacgaacttcgccgtggaagcgagcacgccatcggcaccggtcaccttggccgcgaacgcgtccaaagcggcggaatcaaccacagccccgccagctgcgccaccagcgctcggcatggcaacggcgatgcccttgtcggcggcaaccttctgcacggccgcatcgatcagcgcgttggcagcggccgcattggaagcggcatccgtgctcaacgaggcaagatcaccgccacgagagctggtcccctcacgggtttcgagcacgagcgcagccaccacatgggaagcccacccttcaccaagctgccatgtatcggtcacacgcttggtgatctggccgagcttcacaccggcggcaccgaacatgccacgcacacggtcgcgcacgatgtcagacagcaccggaccgaacgccttgtagttcggagcgaccttgttgaccaaagcgctcagcgccttgaccgtcgcttcggcggcaccgtccacggaagccacgcccagttcggagctgatgtccataagcaactggttacggcgggaagacacgccattagtcagcgtatcggtggtatcgctttcgccgatctgatcggggcgaaccttggccgagtaagccagcaatgtggcgatcgcatcggatgccttgaatggaatatccgcaacggcggcaccagacggagcgccagcggaagctgcggcaaccggaacttccgcaacggctgcaggagccgccgcaggagctgaggcaacagccggagcagcagccgcagaagaagccgcagccgcaactgcagaatcgtcggcatcttcttccggaaccaacgaatcggaatcggtcatatatacgcggccctcatcgcgaccaacgttgtacaccgtcacatcgcgaccggcaaactgtggcagacgcaacgtcttggcaccaagattggcgagtgtcggagcattgccgagaccaacctcaacatactcttccacaccaagaccgccctgctcggcggaaccgaacagcagagcctgcgtctcaatccaacgcaccggggaggcgaactgccaagacagcagttccgtaagcagcaatcgaccgagcttctgatcatcagcagcataggaatcccaaatctgcggatcatccaaagcggcctgaatgcgctcggacggcacgacttcgagaatcttggccgcgaattccttcgtcatttcgaacggagccgcaaccaggttcggaatgtagcgtccgaccaagcgaccacggtaatcgatggtctgcggcaggagcgcgtcaagcttgtcgcggaattccggcacacccttgcgcaacagcgtggaatggaacggcacatcgatgcccggcaccagcatgaatgccggcttgccgccatattcggccacgcggcggtcggaatcggccttcagcgccttcagaccggcgatggtgcctgccacggcatactgctggccagccaggttgtagttcacgatctgcaggaactcgccggaagccttcgacacggattcgacgtattcgcgtacgccgtcgtcgcccacaccgaactggttcggacgcagcgcacccatgcggtagttggagcgacccttctcgtcacgcggaatgaggtggtgcatggtggaaccgcggtggaacacgagttcgatcacggtttccagcggaatcacgccggcgaaggagctcagggcgttgtattcgcccagcgagtggcccgcgaaataggccggccaaatgtcggcgccggcttcgcgcagacgtgcggtctgggcgaatgccacggtggcgagcgccacctgcgtgaactgggtcaggttgagcagtccttccggatggcggtaggtcacgccgttggcggtcagttccttcggattgtcacgcacgacggcgaggatcgagaatccaagcttctcgcaggtcaccttgtcggcacgctcccacacgtctcgtgcggccggggacttggcacgctcgtcgagcaccatgccctgctgctgtatgccctggcccgggtagacgaaggcggacttcggcgcacgtacgatggcggtgccacgagacacgatattgccgtcgatgcggctggtcacttcgagcaccatgccggagtgtgccacgcgtccgacacgctcgacggagatttccacttcgtcgtcgagctgcaccatgccgtacatgttgtaggtccagcctgcgatttcgtagtgcgcgcccttgccgtcaagcgcctgcaccgcgtattgcgcggttgcggagagccacatgccgtgcacgagcggtgccgcaagaccggaaacggcagcgccacgatgcgaggtgtggatcgggttgaaatcgccggaagtacgggcgaaggcggtcatctcgtgcggagcggtcaccttgacgcggcgcagcagtcggcgcggagtgctttcgatttccgcttcgattccgccgtagtccggcgcttccggcggcagtgcgtcggaatatgcgcggccacggatggcgaaacgctcggtttcgttggcaagcacggtgccgtcttgtgcgctgtgggtgacgtggatggtcaccacacggccggatgccgattcgaagtagttttcggcccagctggtcagtgcgatctgttcgccagtgtgcttgagcagctcgtcttcgctgacttccagttcgatgagatggtcgagatgcactgcgttgagcaggccttcgatcaccgggaagccgttgacgtatacggatccgagggccgcgtagatggcggtccatgccggtccgacgagtgcgtccggtgcgatgcgcgacggcaccagattgctcggcagcgcgccgccggtggccgcttcatggtcgaagccgaggttggcggacagcgtgtaactggtatgcgcctgtccgaacggataggcggctttgtctgccacctgctcaataacgggcatggcggtgagcttgtcgccggtgatggcggtattgccgatgcccgcggtgtcggcaagcatgcgatacacgtgttccggcaggcggtcgcggtcgaccaccgggaagagcccggattcgttgccgtccacgttcagcgggatgacgatgtcgcgtacggcgtgcttggatgcgccaccgtcaggatcgttgtcccagtaagtatcgagatgaatgtcgagatcgtacttttcgatgcttccttcgctggaaatcttgcggatttcgtagttggcgtcaccgttgctggtaccgtacgccgggtttgccatgagatggcccacccacgagatgttcggggatttgcgaatgaattcttctgcggaagatgccgcgccgagctgggcaaacgcggttttgtctgcgcttggcgattcggcggaaacgcgcttgaccatggcctcttcgaaacggccaagaatgtcggcgaccggttcgtcaacggtggtgatgcccgcaacggagatcggaccaggaataatacgcacggaatcggcggagtaacgggagtcttcggactgccacagctgatcctgaccccaccaacgcagcaggtcgttgtcgatgacgggcacgaacggcattggcttcgggtattcacgcacgagcaccgggaaccaagcttcatccatcggggtgacggtcagttcatcagcttgcggataggcttcggcaagcttggcgatggccgcatgcggatcggattccacatcggcacgggatgcgaacagcgatgcgaattcgccgctttccttcgtggtgacgcgggcttcgatacgctgtagcaagtgcaggaagcgatcggcataggtttcatctacccacgggaaagcgagatcggcgaaacgctgcgcccatgcgagataggtcatggccttcaggtcaccgaaatacggcttcgcggtggcgttcaacgcatcgatgatttcctcacggcggctttccagctcttccggatgcttcatcacgcgcaccagcaggcgtccgcaacgcgcggaagagttttccagctcgtacatatcggcatgcaggtggctcaggccggaggtgactccacccttggcttggccgctcggcacccactgttcgcccagcggagcgaacggatcgacgtcttctcccttggcgggaatgcctggggtgttgacgagcatctgcttgacttcagggctggtgtgcgcctctttggcggtcatcacggcggtgccgacaagcacgccgtccaccggcatgagcgggcgaccgtattcggcggaccattcgccggtgatgtagtcggctccgcgttccggcgtgccgatgccgccgccgaccacgagcaccagattggcctgttcacgcacttcggcataggtgctcagcagcagatcgtccaatgattcccacgaatggtgtccacctgcggaaccaccttcgacttcgatgagcaccttgaccggagcgacggccttggcgatgcgcaccacctggcgaatctggtcgacggtgcccggcttgaagctcacgtacgggaatccgtcggcgttgagagtgtggatgagttccacggcctcgtcaagttccggaatgcccgcggacacgaccacgccgtcgatcggggtgccgctggcacgcttcttcggcacgatgcgctgggatccgaactgcaggttccacaggtagcggtccatgaacatcgcgttgaattcaacggtacggccttcttcaagctcttcttccagcttggcgacatgacggtcgaacacgctggcggtcacctgaccgccgcctgcgagttccgcccagtaaccggcgttggcggccgccgccacgatttccggttccacggtggtcggggtcatgccggcgagcagcaccggcgctttgccggtcagttcggtgaatgcggtacgcaccttgtctccggcggaggtgtggatgatgcttggtgcgaagcgggtccagttctgggtgcgttcaggcagggtttccagcgtggagagttcgccgcgatcggccacggtggaggcttccaccacgccgacaccggtgccttgggcaacggtggagaacagcttgccaacggtggttcccgggccaaagtccaacacccacagggcgctcggatcggtggatttcatgagcgcacgcacgcgggcggcccaatccacatggttgagcagcacttcggcggcgagctcgcgagcgtggtcggcgttgattccgcaggattccgcccatgaaacagcctgtgaaacagcctcggccataagcgggctgtggaacggcagggtcacgtcaaggtattcgagcaccggttcgaacacgcgaccgccacgcaccttctcttcgcgcagcttggcctggtgcttgtgctccttggccacttccacgccgaacgcggccagatcctccgggtagccggagagcacataatgcgtggcggaattggtgactgccacggcgatcgggcctcgggcaccggaaacacgcttgatcagcgcatccacctgggcgcgggtgatgtccttgacagacagcatcggcgtggcttcgccgtgacgtgcggcaaggccaagctgacgcgcctgacgggtgccggcaacgccgatcagcgtggcaatcgcaagaatttcatcgatttgcgcggaagccgcctcaatggaacccgcttcgacgatcgcctgcaccatgtgcacggcgagcacgccttgggagtgaccgagcacggcaaccggcttggcaacggcgggattgtagccgagggaagcagcatcgagcagcgcacccaactgggcgagagcaatgcccggaacgctggcggaagccgctgcggcagcgccgagtcgtgccggattcggctcgaatccaaacaggtcgaccgggcgcccggtggtggcgagcaggtcggctgacaccgggtacagcagtgcctgggctgcgtcggcgtgggtatgcagggcttcgtcgagcaccggattggcgctttggtcggcgagcgtcaccggccatggggtggattggcctgcgaaggcgagtgcgtgcggctcgctgttcagtcggtcaagaaaaaaggtgttcatgatgttccttacttgtttcaaaaatcttgcgatgtgttcttgcgtttacgtttgcttacgattcatccgcgcacttcgcaccggtcacaacggctggttgccgtggtgtttggtggttttgcgcacgcgtttcttgctggagagcagtttgagcgattcgatgatggtttcgcgggtttgctcggggtcgatcatggcgtcgatttcgcccatttccagcgatagattcgcgttgacggtggtgcgttcgtagtcggccacgtatttggctcggagcgcttcgacgtctttgcctgcgtctttggctttctgcaggtctttgcggtggatgatgttcaccgctccggccgcgccgagcactgcgatttggctggatggccacgcgtagttgaggtcggctccgatggctttggatcccatcacgatataggctccgccgaaggctttgcgtaggatcacggtgaccagcggcacttgcgcgttggcgtaggcgtagatcactttcgcgccgcggcggatgatgcccgcatgttcctgttcggcgccaggcttgtatccgggggtgtccaccaaggtgacgaccggcaggttgaacgcgtcgcacagacgcacgaatcgtgccactttttcggaggaatccacgtcgaggatgcccgcgttgacgttcggctggtttgccacaatgccgaccggatgcccgttcacgcaggcgaatcccaccactgcggagcttgcgaacagctcgtgcacctgcacgaattcgccgtagtccacgatgcagcggatcacgtcgagcacgtcgtacggctggcggtcgttgtccggcacgatggtggcaagtcgcttggccacgtcacggtcggcgcgggttgcggcgtacgcgtaggtgggcggctgcaggtcggaattggacggcaggtaggcgagcacggttcgtgcgtagtcgatcgcgtcggcttcgtcttcgcccaggtagtgcgccacaccggaggtggcgttgtgcacgtatccgccgccgaggtcgtccatgctgatcacttcgcctgtggccgctttgaccacgtcaggaccggtgacgaacatgttggagttttcacgggtcatgatgatcagatcggtcagtgccgggcagtacacggctccacccgcgcatgggccgagaatcagcgagagctgcggcacgaaaccgctggcgtcgcaggttttacggaacagatgcccgtattgcgtcagcgcggccacgccctcttgaatgcgggcgccgcccgaatcgataagcgcgatgatcggcactttcaagtcgagcgctttgtccatcaatcggcagatcttgcggccttccgcgactcccagcgtgccgccgcgcacggaaaagtcctgtgcgtatacggccactttgcgtccgaacacttcgccgaaaccggtgatgaccgccgctcccgcgcgtccgccgttgatgtcgccgccgcagaatcgtccgatttcctcgaaggaaccggtgtcaagcagcaggtcaagacgttcgcgcgccgtcaacttgcctttgacatgctggcgattgcgggcatgatcttccgcttcgtgcgcgagttgcgccgcacgaagcacggatgcgcggattggctgggatgcgcccggcaggtcggccgcggagacggttgtggccgcggagacggcttcggccgcgtttttgccgagtcgctcctgctgttccattacgatcttcacggcttctttgacggccgggcttgcgatgatatcagtcatcacttacccccttccatagttccgtcggttgcggttccgtcaacagcagcgccagttgcgccgttttcgccggcttccgtaccacccgctccggtcacgtcgatggtcatcaatgtttcgccggcttccactcccgccgcgggtcccacgaaaatcttggtgacagctcccttgaccggcgcatacacgtagttctccatcttcatggattcgagtacgacgagcaggtcgcccttggccacctgctggccttcggccacgttgatgcgtgttacgacggcctgcatcgggcttgcgatcacgccggattggccgtcgttgctttgctgtttcttctgtgcatgatgcagtccctgcccgcgcagcggctggatggcgcgtttcgcgtcgcgtgctttggcaccgcctgtcaggttggcgacgatgtcgttcggcacggtcagcgacactctgcgattgttgacttcgatgacgaaggtttcgctggattccttcttgtcgacctcggaagcgccagacatggacgccggctgccctccttgcgatgatgcggcttccttgttgaggtacttgcgttccagccatttggtgctgacatcgtatgcaacaccatgttcggcggtgaattcgtcgtcgttgaaaatctgttcgaacaagcttgccggagtcggcacgccttccaccttcagctcgctcaaggcgcggcgcacgcgggccactgctgccgctcggtcagatgcggtgaccacaagtttgcccatcatcgaatcgaatttcggcgaaatggtgtcgccttcgaccacgccggaatccacacggatgcccgggccggacggccagcgcaacgaggccagcgtgccggagcttggcgcgaggttcttcgccggatcctcgcaggtcaggcgcagttcaaaactgtgtccacgaagcggatggttcacggtcagttccccaccgttggcgatggtcagctgctcgcgcaccaggtcaagtccgcagacctcctcgctgacggtatgctccacctgcagacgcggattgacttccaggaagtacactttgccctgttcggtcaccatgaattcgcaggtgccaagcccctcgtaatcgacggcttcgaacagtcggcgagagtaggtttccagctggtcggtcacctcggaggaaaggaacggtgccggcgcctcttcgacaagcttctgattgcggcgctgcacggagcagtcgcgcgtggaatacacggtgaagttgccgtgcgagtcgcgtccgcactgcgtttcgacgtgacgtcctttgtcgatgaatcgttccacgaaatattcgttcagatcaccgccctgcagcgcatcatgattcatgtagaaaccgcgcagctcgtcatcgttgtgcacgagcgtgatgccgcgaccgccgccgccatcggtacgcttaagcatgagcggataaccgtgcgtatgcgcgaaatccagcagcaatcgcatgtcggaaatcgactgggaaatgccgggaaccggcggaactttggcgaacgtggccacacgacgtgcggtgatcttatcccccaaatccacgagggctttcggattcggaccaacccaagccgcaccagcatcgatcactttctgcgcgaaagtggccacttcggaaaggaatccgtagcctggatgtactgcgtcggcaccgctgcgctgcagaatgtcgatcagcagatcctcgttgagataggtgtctttatacgtgtctccggaaagcagatatgcgtcgtcagccatctgcacgtattgtgcatggcgatcctgctccgcgtacaccgcaaccgtgggaatccccatctcacgggcggtgcgcactacgcgaagcgcgatttcgccgcgattcgccaccagaagtttgttgacatttttaggcataacgtcaagtttggtcgcgcgaacgaaaaatcgtgaactcgtttcccacaaaagacacgcaatctttttgtaaggctccacaaacgttaccgaaacttggcaagcctacgattgggggcataagttgacaaaccttgcattttcgtcactttcgcgcttgccatcatttcggctgtcaacaatcgtcgattcatcaacgtaatgcaatcacatccaaggagaattaccgtgcgtaacgcaatgctgacactcaagaccacgctgaaaaccgccaccagcggcactgtcggatccatcctcaagccggcgctgttcgccgtgctcatgtggaccgcctccgcggccggtgccgtgccgattccgggcacgccggtgccgatcacgctacagacgttcgtggtgatgctggccgcgctgatgctgccgtggaagcaggccggcgccgcgatgctcatgtatctggcagccggcgcggtcggtctgccggtattcgccggcggcgcttccaccatggcattggttggcccgagcgccggcttcctgatcggcttcctgccggcggccatcgtcacgtcgctgctgaagggtgaggcgcgcaccgattcgctgaagcatggcgcgctgaccgccgcacgttacctgtttgcctgtgtcgccggctgcattgcgcttgactatctgcttggtttcatcgtgcagtccgccattaccggcatcgcactgccgattgtggccgtggcttccatgggattcgtcgcaggcgatgcggtcaaggccgttatcgcttccgccgtggtcgcaggtcttgccaagctgaagtgagattgcggcaaatttcagcaatcaagtaattttttacttactgagcacgcctacgtcggccgtgctcacccgatgcaatacgccttcctgatcctcaatggtcagggaggcgtcgtcgtttaacgcgacagccctgccctgcaaagtggttccgtccacaaaatgagcctcgcactgcttgccgagcgtccagcagatcggggtcatcgcttcccgggcgcgcacagcctcacggtgagggtcctcttcgaaatcagccaaccgcgagcgcaatccttgcacccaacgtgcggcaatcgcatcgcgcaacaccatcgcatcaggcagattgcgcgcaaccaactgcaacgatgtggacttatctatcggcaatcgttcctgagcgacggcaagattcaaaccgacgccgatcacaatggcaacgcgatccccgcaatccggaatcggcaccatttcagcgagtacgccaccaagtttcttgccgcccgcaaaaatatcgttcggccatttcagcaaaacatcttcatcgagcgtgccgccgaaatcgcataccgcaccaacaatcgcctcacgcatctcgcaaccggcaatcatctgcagccaaccattgacggacgaatcgcgcacaatcgcaaccggcacgctcaccaccagcgacacgatgaatgactcccccggcacactggcccacgtatggtcgagccgcccgcgaccggccgtctgctcgttcgccgcgacaaccacgatctcacgcccgctccacacgaggttccctgcaatgccgtccatgccatccatgccgaacagccgacctgcacgcaccaaatccgcggcatacgtgttggtggatcccaccgtatccaaaacaagcacctgatccgccgcaacgcatgtacgcggcatgatcgcagccgaatccaaaatcgccatcattacctcctacctactacagcgcggcgcgccgacgcaatgtcgccgcaacgcaacagctcatgcagcagccaacgcagccgctactcgtcctgccgcacctggctggcctcatgcgcactggccacgttcgcgctggcagccgatcgcgcattacgcgactcgcgccagaattgcaggcatacgaaaccgaatacgaacgcgaccggtagcatatgccgttcgaaattgttggccggagcggtgatcatcacgcccatgagcagcagcaggggcagatgccatgacagcgagcgccatcgccgcaacaccacttcggcagcgccgaccagcagcatcagcgttacgtacagattgccgtgcgtcacccagccgatcacgggaatattgccccaacctttcgcgaagccggccaccgcatcgcgccaatcgtggttatacaggtggatccacgcattgtcgttctgcacgtaatcgttgttcacgtagtagtccatcgacacgtatggcaggtcggtcacgtcgaaatagccgaagcattcggcgaaaaacgcgtcgagcgcgataacaggatttgcgacaacgatttcaagccaggcctcgttgaagtttgtcatgtcgtcttcggtgacggtgcgccacttgtagctgactttcttcgattggatgccggaggatttcaccgggtcggcgtcctgccggaagtacgcttcggccatctggtcgaggttgaagaccggttcaagctttttcgccgcgtccgccggaatgcctttcggattgtatttggcgacgcgcgcgatctgctgcagttggatgccacggctttcgatggggtcgccgccgatgatggcgcccgtgttggtgaggaacacgatgccgccatgaatgaggatggttggcagcagaagtgccacaagataggttttccaacgtttgcgatcgttgataagtgccaggatcagggtgaagagaatgatgtaccacgcgtatttcgcgctgatcagcatcacgcagcttgagatggtgaaggccatgatcgagcgtttgcgtaggtacgtcggcttgccgttgatggtgggcagcgctttgatatgcgtcatgtgcagttcgtaccacacgccgaaccaccatacgaatgcgaaagcgaacagcggtgatttcgtcagggaaatcgtggcgaataccgcaagcgggcacaccatgaagaacagcagtatcatgaatcgtgttttcgcaccggcccgcagtctggaggggcgtgccacaacgcctgcttcaggatgcgcgtaatcgcgcatattccagcaatcgtggcgttccggatgcgagaagtcgaacgtgccgacgccaagcctgcgccacggcaggttgaagaaccggttggcggtggccgaacagcagaatgcggcgaacagccattgcaaggctgcgagcaccacgatgcccgcatcgttggagtcggtgaagtagcgcgaaaccgccgctgcggcaccgtagaacacggtgagcacgacattgtgctggtcggtcagatatgtgggattgtccggccacatgtaatgcgcggtcgggtaaatatccatgggcacgaacgagaagaagccgatatatggctgtttcaagcccgtccactggttcaaggcccagctgaattcacggatctgcgagcgaatgtcggcgccgaacgcggccaatagcgtggttggaatccacagccagccgattacgaacaccagcatgagtttccaccaacagtcggtgcagcgggtgagtttgcgccccgtccatacgatcactgcatgcagggcgcgccctgggcggctgtgcgcggcatcatgcaagtgtcgcaacataatgccaagcacggtggtcggcgttcctgcaatctcgttgcatagtttttcatgccgtcgtgcgaaatattgcggaagtacgcgacggccgcggccgaatctgaccaatgcgacgactatcgaaaaccatatcgcgaaagcgaccaccaaatacagcacattcagccagccgaagtcggaaagcccatcgccgaaccaatacaacggcccgatcgcgcaacaccatgccacccaaaggcatgccagcacggccagcatccagctgaggaatgtgccgatacgctcgctacgctttccagtttgtttgacttcgctcataagcggcataatagcggcactccccgaatgaacttcacctcgttgacgctttccgttcagcgattcgccagttgggcggctacacttgacgcttatgaactccgatcaggcagacattctcgaccttctggcagggcacaccgacgattcaaccatcgaacggctcgctttcgaatgcctgatgacttctcttacggatgatcgcgtcgcctcgttgatgaatgtgcttggttggcgtggggatttcgattgtttcgcgattggcggcacaccggaaacgagtcccgcttcggcttcgctcgttgcgcgtaaggcggtgcgcgatctgggcggagaacatgtgattgttggcacatacggcagttttctgctggcgcttgtctgtcagagtggcgccgccactgccgaagtgacctgcacgtcgattatgcccgctttcaaagatgacgaatcggtgtatttgagtccggtgcgttccggtgtcgccggcgcttcgcacgtgttgcgtgaaaccctgttttccttgcaggcggctcccgctttggcgtcgccgtcccgcccgttgcgtgccgatgagttgctgccggaacgggcgctgttgggcgatgattacgctcgtgaagagttgtatcagaacgtgtatcaggtgcttcatggcgagaatcccgacgatccgacgtttgtgacggtttccacgtttttgcgcaacggcagttcgttggaaaacacggcgaaggaattgaatgtgcatccgaatacggtgcgttatcgtttgaaacgtgccgcggaaacgaccggttgggatgcgaccgacccgcgtgacgcatacgtcttgacgacggcgcttgcgattggccgtatgcgcgaccgttgaaatcgtttttactgttctatttattttttttgaatatatctgatatctgacctgctcaaatttctttgatattcagatgattgcagaatcttttttacaaatgagatagataatcgcaagatatatgtgaaagacccgcatctgcgatgaggcaggatgcgggtcttttgcaagctatatagaagctatctgcaagctatattgctcaggcgatgaccgtcggatcaaccgggacgcccgggttcatcgtggaggtgatggtcgccttggtgacgtagcggcccttcacggtggacggcttcagacgcttgatttcgtcggcaacagccttgaagttctcgtcgagagcctgctcggtgaaggagagcttgccgatgaggaagctcaggttgccgttcttgtcaacacggaagtcgaccttgccgcccttgatgtccttgatggccttggtgacgtccatggtcacggtgccggtcttcgggttcggcatgaggccacgcggaccgagcacgcggccgaggcggccgaccttgcccatcatgtccggggtagccaccacggaatcgaagtcaaggaaaccgtcggcgaccttctgcacgagatcgtcgtcaccgacgatgtcggcgccagcctcgagagcctcggtggccttcgggccacgggcgaacacgagaaccttggcggtcttaccggtgccgttcggcaggttgacggaaccgcggaccagctggtcggccttgcgcggatccacgttcaggcgcagcacggcctcaacggtctgatcgaacttgtactccggcatgctcttgacgagagcgatggcttcgttggcggtgtaaaggttgttgcgatcgatcttttcagccgcttcgcgatacttcttggaacgctttaccatttgtccctctcctctcagtcggtaaccgtgatacccatcgagcgggcggtgccctcgatgatcttcatgccggcttcgacgtcgcgtgcggacagatcagccatcttgatttcggcgatctcacggacctgagccttggtgacggagccgaccttgtgggtcagcgggttttcggtacccttctggatgcccgcggccttcttcagcagagctgccgccggcggggtcttcagaatgaaggtgaaggaacgatcttcgaaaacggtgatctcaacagggatgacctggcccatcttgtcctgcgtggcagcgttgtactgcttgcagaagtccatgatgttcacgccatgggaacccagtgccgggcccagcggcggggccgggttggccttgccagcctgaatctggagcttgagaagcgccgagactttcttcttaggagccattgtatggttcttctttctgtagaagcggtggtagcggcaccggagtaggtctcccgcgtccggttccttccgcaacgtatattgctgtgctgtgctagcaggttccgcgccattcaggcacaataaaccctccagacacaagcttttccattatgcccactccgccagacaaaaaaagaccccgcaaacgcggggtctttcaaagacttatcaggccaatttctctacttggttgaagcccagctccactggcgtgtcgcgaccgaagatggacacgagcaccgtgagcttctgggtggtgggctcaacgtcggagacaacggcggccatggtggtgaacggaccatcggtgacggtgacctgatcgccaacggcgtaggagacttcgaggacgcgcttcttgttggcggctggcttgtcaccagccttcttgagcgcttcggaagcgatcatcggagccatcatggagacgacttccttgcggctcagcggcgccggttccttggtcggaccgacgaagccggtgacgccttcggtttcacgcacaatacgacgggcgttctcatccggaagcatgcgaatcagcacatagccgggaacacgcacgcgggtgatgaccttcttgcccttttcggtgtgcttttcgacttcttccatcggaacttcaatctggaagatcttatcttccatgccgaagcttgccacacgggattcaacgttggtcttcacgcgcttctcatagccagagtaggtgtgcagcacgtaccacttgccttcgagggtgcgcaggctgttggagaagtcttcgacggccttggcgccagcatccagctcttcgccgccctcgtcctccgcgggctcttcggaagcagcttcagcagtcggctcggcctcagcgacttccggaacgctttcaccctcggcctgcagcgcctcaacggcagctacggcctcgagatcagcttctggagcttcgtcgaggttgtcggaaaacacttcgtcagtcatgcagtttcaccttcaagtcgttgatcagccgaagatccacagggtcagcttgcccagaccgaagtccatgccggtgaccagtgccatcaggagcagcacgaagatgaacacggcgagtgcccagaagaacagctctttgctggtcggggtcacgaccttgcggagttcgtcgataatctgtttgatgaacaagccaagacgcatgaagatgttcggcttaacggccttttcgctattttttgccttcgccataataatcctccgctgagcttgttgtaagaagcttggcagggaaggcgggactcgaacccacaacctacggttttggagaccgttgcgctaccaattgcgccacttccctaggtgtactctgccgtttctacttgctggcgaggattttgtgcgaaaaaccacgcaagaagtaagcggcaaaaccgccaagtcgaaataatagcgggtatttgcgacttagtccaaccggtttttcaagaaatgtcccaaaaccgctatttttcaacgaaaaaaagattcgcacccggcatgtcaccgcggtgcgaatcgtgtgaaaagtctcagtcaggccagtatcagtcctcgacccactgcttcatacgcttcatgccctcaacgaggtcgtcatcggcaagcgcgtacgagaatcgcaagtagccgggagcgccgaacgcttcgcctggaacggccgccacatgaccttcgtcaagcagtgccgcagccagttcggacgtgctcgcataagcggttttgctggtgccgagcggcttgttcagcagtgcgctcacgtcggcgaacgcatagaatgcgccggtcggcgtcgggcagttcacaccttcgatatcgttcaacgcggcgacgatggtctgacggcgcctgtcgaacgcctcacgcatctcgtacacggcgtcaagagatccggacacggctgcgatcgcggcacgctgggagatattgttcacgttcgacgtcatatgcccctgcagcttggatgcggccttcgccacgtcgagcggagcgatcatccagccgacacgccagccgggcatagcgtaggttttggccacgccgttgagcaccagcagctgatcacgcacttcaggcactgcagcgccgatatacgtggtttttgcaccatcgtagttcagatgctcgtagatttcgtcggagatcacccacacatggtgttccacagcccattcgccgatcgccttgacggtttccggattccacacggcacccgtcggattgttcggcgtattcacgatgatggccttcgtacgttcggtacgtgccgcttccaggtcttccaagcttggctcgaaattgcggtcagctcccgcgaacacttcgacaggcacgcctccagccagtttcacggcttccggatagctcgtccaatacggcgtcggaatgatgacttcgtcgccgtcattgagcaggatttgaaaggattcgtatacggcctgcttgccgccattggtcacgatcacctgattcggatcgactccataccccgagtcgcgcaacgttttgtctgcgatcgccttgcgcaattccggcaaacctgccgtcggagtgtaacgatagttcttcggatcctgcaccgcttcggccgcagccgcgacgatcgcagccggagtcggaaagttcggttcgcccgcaccaaatccaatgacgtcgattccttcagctttcatcgctttcgctttggaatcaacggccagagtagcgctcggagccacgcggttaatacgttcggaaagagtctgccagtcagccatagtcatgtttgccatgctatccctcccgcccgaaaaacaacagccttttagcacattttggaattccttttccctgttgaccggtaggggcggcatattgctatttacagggcaccgaacaaaagagggaaagggattaaaccaagacgaggttgtcgcggtggactagggggtgggcgtattcttcgccgaggaaacgcttgagctgggcggtattgcggccgagcatttgcgggatttcttcggaatcgaatcctacgaggccttttgcgaggtgattgcccgcttcatcgtcgatccacaccgcgtctccggcggcaaaatcgccccgcacttcgagtacgccggcggcaagcaggctggcggcccctccgcgtaccgcattggaagcgccggcatcggccacgagcgtgccttgcgggtgtgctgcgaacccgatccataggcggcgtgatgatccacggtcgttgatgggggcgaatgcggtgccgactgggtcgcccatcatggccgggcctgcgtttgccgcgcaggtgagcactgcgggaatgccggagaccgccgcaacacgcgccgcttccattttggtgaccatgccgccggtacccacgtttgatccggtgccgccgacctgcactttggcgagcgcgtcctccacgttcggcacgtagctgatgcgtcgcgatccgggttcgcttgggggtgccgtgtagagcgcgtccacgtcggtgaggagcaccaaagcgtcggcgactacgatgttggcgatcaatgcggagagtcggtcgttgtctccgaaacggatttcgttggacgcgagggaatcgttttcgttgatgatcggcaccgcgccgaggtcgagcagccggtcgagggtgcgtcgcacgttgcggtattgctgtggggcgatggtgtcggacacggtgatgaggatttgcccgacgcgcagtccgtattgtgagaaagcgttctcgtattgggccatgagcaggccttgtccgacggccgcgcacgcctgctggtcagccacgtcggttgggcgtgagtcgaagccgagggagccgaatccggctgcgatggcgccggaggagacgagcaccacgcgcccgcccatgagtcgcacgcgtgcgagggccgccacgagcgcgttgagtcgttccggatcgaggtggccacttggtttggtcaacgagctggatcccactttcaccacgatggtttgcgcttcggcgatggcgcggcgcacttgggcttgcgatggcgtgttcatggttcctccaggcgttcgaatggccgaaaagaaaacccgccgacatgccaatcggcacatcagcgggcgttttgctgcttctattgttccacgttttcggaatcggtggtttcaccgcgtccgaagaggctggtttcgtcatggcggtcgtcgtccacggaaggatcggcccagtgtccggccttgcgttcggccatcatggcttcacgcacggcttggcgcgcatccatcatttcgtggtactggcgacggcgttccgcgttggtgcggcgctgcgaacggccgtcctgttcctgcagtcgcaggtcgacgcctcgtgcgccaagctgggcgccgtcgagcatttccgcgcccgcagcaatggtcggatcccaatcgaattccacggctcgcgcacccttgccgatgcgtacttcgtcgccaggcttggctcccttgttgcgcagctcgtcttcgacaccgagtttggcgaggcggtcggccaggtagccgactgcttcgtcgttgtcgaagttggtttgcatgacccaacgttccggcttggtgccgagcacttcgtaccagacgtcgccgttgccggcttccttgcgttccacggtgaagtcaagcgcggtgccgccttcgtcgttgcggcgacggcggttgcgcggctcttcgagcggcttgatgaccacgcgcgcttcttcttcggcctgttcgcgttcggcgacttccttgcgcatgtcggcgaccatggccgccaacgcccagttgagttccttcaaaccttcgtgggatgcggtggagatgacatacacattgagaccgagtttttcgaattccggtttgacgaattcggccaattccttggcttccggcatatcgaccttgttgaggatgatgattcgggggcgttcggggattgggattgcgcccaacggcagttccagcttgtcggcatattcggcaagctcatgttcgagcgccttgtagtcgctcatcggatcacggtcaggttccagcgtggcacagtcgatgacgtgggcgatgatttcggtgcgttcgatatggcgcaggaattcaaggccgaggcccttgccttgggatgcgcccggaatcaggcccggcacgtcggcgatggtgtaccgcatgtctccggccataaccacgccgaggttcggcacgagcgtggtgaacggatagtcggcgattttcggcttggcggagctcatggctgcgatcaggctggatttgcctgcggaggggaagcccaccaaggccacgtcggcgatggatttgagttcgagaatgacgtcacgttcctcgcctggttcgccaagcaacgcgaatcccggagcgcgacgggtgcggttggccaatgcggcgttgccaagaccgccgttgccgccggccgccaccacgaacttgtctccggcatggcgaagatcggcgagctgctcgcccggatgcttaggcttgccttgcggccctttggcttcgaaaatcacggtgcccacaggaacgggcaggatcagatcggcacctttcgaaccgtctttggtgtctcccaagcccatggtgccgcttccagcctcgcggtggggcatgaaacggtaatccaacaggctgttggcgttctggtcggccatgaagatcacggaaccgccatcaccaccgttgccaccgttcggtcccgccaacggcttgtatttttccctacggatgccggcggaaccgttgccgccgtcgccgcccttcacatggacggtcacgcgatcgacgaaatcactcatgtatctaccttaatcgtttgttcgaaacggtccgattattgtccgtttgatatgtcttatgcaactgtatgcaacgttacgtgacgtttgggacgggctgaaggaaaccaatcctcagcaatcatcaaaataaagaaaagccgcgtccataacgggcgcggctttatcttgtaagcgttaattgcgcgtatttcaggcggcaatcacgtcgacgaccttgcggtcacgacgtacgccgaacttcacgctgccgtccttgagggcgaacagggtgtggtccttgcccatgccgacgttctcacccgggtggaacttggtgccacgctgacgaacgatgatgttgccggccacgacggcttcgccgccgaacttcttcacaccgaggtattgcgcgtttgaatcgcgaccgttgcgcgagctggacgcgcccttcttatgtgccatgtctgttcctttcggtccttgactctaaccctgcgccaatcaggcgatagccgtgatcttgacagcggtcagctgctggcgatggcccttgcgacgagcaacgccggtcttgttcttatacttcatgatgctgatcttcggacccttggcctcatcgttgacaacctcagccttgacgctgacgttggcgagatccttggcaccgaggacaaccttggagccgtccacaacgagagcaaccgggaattccacggtttcgcccttcttagcctcgagacggttgacgtagatgacgtcaccgacctcaaccttttcctgatggccgccggccttcacaatcgcgtacatatccgttcctttattaacttggaaagcttactgcccggcacgttcgagcctcgcggccagacaccagcaatctaatctacacatacccgcgtacaaccgcaagtctgtttccggcgtgtcaggttgacagaccggaataatcatttattcttctacgcttcctcgcccagttccgcattgttggcggccacggcagccgccgcgatctgtgcgagtttggccttcacgtccggcgaggagcctttcggcacctgcacgtccgtgccgtgaccatgcttgttggttttgacgaacgggtcgccgcccttcagggcgtacggatcgtcataatccgcggacacggtcggctcgtcatgaagaatgaatccacggcccttgcaggtcgggcattcctcggagaaagcctccaccaagccctgtccgatgcgctttcgcgtcatctgcaccaggccaagcgaagtgacttcggccacctgatgcttggtgcggtcgcgggccaggcattccaccagtctgcgcagcaccagatcacggttggctggcatgaccatgtcgacgaagtcgatcatcaccatgccgccgatgtcacgcaggcgcagctgacgtgcgatctcttcggaagcttcgaggttgcagcgggtcaccgtctcctcaagactcttgccgcggccgatgaaacggccggtattcacgtcgatggtggtcatggcttcggtgcggtcgatcacgatcgagccgcccgacggcaggtagacctgacgttccatgcccttgcgcagctgggagtcgatctgccacttgtcgaacacgtctttgccttcatgttcggccggatcccacttttcgagcttgtccttcaagtcgggagccatggtgtcgaggtattcctcgatacggccgtacacgcggtcaccttcaacgatcatcttggagaagtcgtcgttgaagatgtctcgcaccacgcggatcgccacgtccggctcgccttgcagcagcttcggacgcttgccgtgcaggaattcgtctcgcttggaggtgatgcgttcccactggcgcaccaggctttcaagatccttggtgatcgcctcttcggaggcgccttccgctgcggtacgaatgatcacgcccatgtctttcggcgcgaccttcgacacgatgttcttcaggcgggaacgttcacgctcgctgagcttgcggctcacgcccgtcatgccaccggatggcacgagcaccaggaaacggcccgcaagggtgacctgcgaggtcagtcgcgcacccttatgtccgatcggatccttggtgacctgcacgagcaccgggtcccccgacttgaacgcgagttcgatgcgacgaggctggccttccaaccgtgcggaatcccagttcacctcacccgcatagagcacgccgttacgcgcctgaccaatgtcgacgaacgcggcttccatgctcggcagcacgttctgcacgcggcccagatagatgttgcccacagtggcgacttcctgaatgtcggacacgtaatgttcgacgagcacattgtcttcgatcacggaaatctgcgtgtggcgttcgcgttcgcgcaccaccatcaggcggtcgacatgctcgcggcgagccaggaagtcctgctccatgagctggctttgacggctgcgctcacggcgattgtcacggcgacgctgcttcttggcctcaagtcgggtggaaccttcgacgtcggtgatctcgtcgatgtactgctgcttgcgggaacgacgcacgagcggctcttccgtctcatccgtcttcgcaccgccacgacggcgacgacggcgacgggtcaccgtgccttcatcctcgtcatcgtcctcacggcgacgacgggactcgccttcatcgctatcccgctgctgttcgtcggcttcctcacgattgccgcggctgcgacggcgacgacgggtgcgcgtcggctgctcgtcgtcatcatcgtcatgacgattgcgggtttcgtcatcaatcggcgcatacgtaatatcgtcgaggatcaaatcctcttcgatctgttcgacttcagctgcggcacgacgctcctgcgcgttcaaacgacgggaacgacgcgacttgcgagatccgccttcctcatcattgtccgcatcatcattgcgattatcccgattatcgcgttcattgcgattgtcttcggaacgctcttcgtcggcaacgtcgcgattgcggcggcgacggcgacgtgacggacgatcctcatcctgctcatcctcatggtcctgcgtattgcgatcattacgctcgccgcggtcattacgggaatcgtcgcgatcgtcgtctgccctgtctcgggaatccgcaacggacggcaaaaccggctcctggaaaagcagagacatcatcggacgcggattgtggcggacctcatggccttccggcaacatatcgacggcatccaaggcacgctccacagacgactcctcatcatgggaatcatcgacggaagcgcgacgacgcggcatctcatcgtactcatccgcatcatcggcgaaacggctgcgacgacgcgacggacgatcctcgtcctgctcatcctcaacctgcaccgaacgacggcgacgagaacgcgtcggccgttcgtcggcaatctcacgaacatcatcatcggactggaccggacgacgacggcgacgggtcggacgggtcataccctcggaatcagcggaatcaccggtatcatgcgcaggttgcgcaaccggcaacttcggctcctcgaacagcggagccgaagcatgctcctcgaccttcaactccaaggacgcaccggcagctcccacgccacgcaccacgcgacgaccgccacgacggcgacgcggggcaggatcggactggaccgactcgaatttcacaacattcacggcatgctcaggcgatgccgaagcttcgacctgatcgaagccctcactggtattaggcacaatggctcctcgacgacacgctgcaatcgcgccgcccacgcttaggcctcatacggttctcacaccacgctctcaccgtggccgcgcatcatggcgcccgtaggaagcaacttccgtcaaaagtcctcatcatgcgacggcggacaccagcgctcgcggacacacatgaacttcacgcgaggggatcaacgccatcggatgcattggtgatttgcagaaccaccgtctataagtatgacacaaaaaacaacggaacgtgacatgacgggaaattttccggatcctgcaactcaccgcctgctttccccgcccgcaaatcccaggccccgtctacacaagtcgttgctccgtctgcacaagtcgaaagaaatcacgattcgcgagaaatgcagacacagattacgactcgtgcagacagccgatccgacttgtgcagacagaagacggaaaacaacaaacagccgatagcaggcagaaacaggaggcagaaaaaggcagcagacagctacttcagccagtcttcaagcaagttggccatcagcagcagatccgattccggcagctgctcgtcatgcttgtgcgccagcaacggactgcccgcacccagattcaccgcgggaatgcccagcatcgagaatcgcgccacatccgtccagccaagcttggccagaggctcacgccccgtgcgctcgcgcaccaatttcaccagcgactgcgcgagcggcgacgtcaaccccggacgtgcggaaggcgactcgtccttcatttcaatgccgaagccttcgaatacgccacctgtggcaacatgctcgccattgcccaattccgcaccggcatccgcgccaatcatcagcgccttcgcctcagccaacgacttgtcgggggcaaaacggtagttgacatgcacgcggcattcgtcggggatcacattcgtacctttgccgcccgaaatcagcgtggcattcaggccttcctgatacgtcaggccatccacttcaatcgcacgattttcataagcgttcagccggttcagaatctcagcggccgcgtggatggcgttcctacccatccacgcacgcgccgaatgcgccgcaatgccgtgcgtgatcacgtcgaaacgcatcgtgccattgcagccgccttcaataccgcaatcggttggctccccgataatcgcaaaatcgccggaaatccaatcaggatgcgcctcgaccaccttgcgtaggccgttcttttcggcggcaacctcttcgtggtcgtagaacacgtatgtcagatcgtatttcgcatccgtcaacgcggccgccaaatacatcatcaccgcgtcggagcccttcatatcggtggcaccgcgcccccatatcacgcgctcccgcccatggccggcggcaacatcctcgcgaatcagcggatcgcccggttccagccaacgcggcgggaaattgtcgatcaccggcaccgtgtcgagatgcccggcgaggatcacgcgacgctcacgcccaaaattcgtggatgcgaccagcgtatcgccatgcctgcgcactgtcagatgctgctgtttattcaaaaacgcttcgaccgcgtcggtcaacggcccttcgtcgtcgctcacggaataggttcccatgatctgttccatcagctcgttcagctgctcctgcctggtggcggaagcggaaaatccaatctcaagttcgttcataccgcccattatccagcaccaccggaaccgacatcgccgttcgacaacgcttttgagacggatcggatgttatccatatgcatggtgcaacactggatagcggccaaaccaacggccgagagcgaaaggaagagtgtcatgcctggtctgttaagcgcattggaaggcttctgcgtcattggcatcgtcatcggcaccggttacgtggccgcgcgcatgcgcataggcggacctaccgcgcagatggtgctcaacaggttcagctttttcgtatcgagcccgtgcctgatgtttgccatcctgtccaaggagagaatcttcgagatattccactcctccattgttgtggcgttcttctcggccgtgctggtcggattggtgtttctgatcctcaataggctgttcttccatctgaaggcggcggatgccaccatcggcgcgttgaattcgctgtatctgaactccaacaacatcggtctgccgatcgccacgtacattctgggcaatcccgctttggtcgcgccgattctggtcatgcaacaggcggtgttcacaccgatcggcctgaccgtgctcgatgtgaccaccaaaggcaaggtctccacgagggagattctgaagcagccgctgcatcagccgctgcttatcggttcgctgctgggcatcgccgtatccgcgatttccgcaaaaaccggtcatttcgtggtgccggactgtatttacgatccgatcgacatgatcggcgattccgcagtgccaatgattttgatggcattcggcatgtcgttgcacggcacgaagccgctgcaggacaagtcgaatattcccgcggtgttcacggtggcggtattgaagaacatcgtgatgccaattatcgcgttcctgctgtcgtatttcgtgatgggcttccgcggcgccacattgtacgcgtgcgtggtgctcgccgccctgccgaccgggcagaacgtctacaactacgcggcgcggtacaacgtgggtctctcgttcgcacgcgacggcattctcttctcgacactgacctcaccgatcttcatcgcaatcatcgcggtgctgctcggctgacctcgccagtcctcgccgcggtatccacgaccgccgcggcgagaccatcaatcgtccgtacggtagccggcatgaccgagcccgtgcgccgcatgattcgcggcacaccctccgagcaccatcagcgcataacacaagccgattcccgcggccaacgtaagcaacgaagccggattgagcaacgacgttgccagaatcggaaacagcaacaacaccgagcaccctaatgaaacggccatcaccgtgttgagcggggtgatcacttccatcatgcgtgccttgtcgagcgtcgcctcatccgtgccttccaacgcaagcatgcggtactcgtcggcctggtcgtagacgttgctcgtctgcatcacgccggaactgacggcggcgagcaccgcggcaaaggcgagcgtcaggaaaccacccatcgctatatcgcgcatgtacagcatagatgggtcgaacgggtcgtggttgcctccgattccggtggcgagcaatccgcacaccgacgtcatccccgcgatgaacacagcgagcgccacgccggacacgttgcgccaagcacgcttgggattgtcgaggatacggcgcatggcaatcatagtggccgcgtccttcgggtgtttcgcacgcgatctggcgcgcatcgccaccacccaggtaccgacgacgttcaccatggcgaagccgaggaagaagacgccgaagatgatggcgtagaccaccatctgacccaagtgcgcgaatgcggagatgctgttgagcagcaggtagcctacggccaacacggcaaggaaaatcagtgcgcgccatgcggacggcatgggttgtccggtacgttgcgtcacgccaagcggggtgaaggccacgcggcgtagggcggccagcgcggagaccaaggcaagcagcgtgactccgacggtcacagccgccagggcaggcagtcccacccacaactgttcgaaggtgaaatgctggttttggaagtcgagcagcatgatcgctggtatcagcgcgaagtagccggccatgccgaccagcgcgccaagcagagcctggccacccgcatcgagcgcggtgagtttcgtgacctgcgcggtggtggcgcccgcaagtcgcagtgcggcgagacgtgcgtccctgcgggaggccgcgagacgggccgccgaaccggcgagcgccacgaacggcacgatgagtagcagactggcgaatgcggcgagcatcacatagccgtcggaataggtgttcatgacggctgtggcctggtcggccgtccaatggccgtcgccgaccgtggcgacgagcttgtcggcgtgcgccagggctttggaccatgtttcgtatgtaccgggcgcgcacctgttggaatcgatcatgcaaccgaacgtgtggtcggcggaggcccgccagatgaagccatgcaggcctccgagcacggttaggaagacggcggtggcggatgcgaaggcaacgatggccagcgcagaggtgcggccggatgtgccgcgggtgccggagcggtggaacaatcgccataatcggaacatgttcatcgtgcgcctccggcggtaggttgggattgctgcggcgagctcaacctgccatcacgcatggtaacggtggcatcgcaaaatgcggccacgttcgaatcgtgcgtcaccacgaccacggccgcgccggtctgtcgtgcggtccgcatgagaatgctcatgatttcgtggccggtggtctggtcgagcgcgccggtcggttcatcggcgaagatgactgccggctgcgcggcgagcgcacgtgcgatggcgatgcgctgcatctggccgccgctcatttcgccgggacgttgttgcgcgagctggcgcaatcccaatcgttccagccatagcatggccatgtcggtggcctgctggtagcttgcgccgcccagcatcatcggcaacgcgatgttttcgatggccggcagttctggcagcagttgtccggattggaagacgaagccgaaggcgctgcggcgcagtttggtgcggtcagcgtcgctcaaccgcgctaggttggcaccgcgaaacatcacattgccggctgtcggggtgatgatgccggcgagtgcgtgcagtaacgtcgatttgccggaaccggacggtcccatgaccgcgatgctttcgcctgcctggatgccgaaatccacgtgattgagcgccagcatgtgtgtggcgtttggtgtcgcctgttgggtcgaataatccatgaccagatcggtcgcctgaagtatgtgttccatgtttcctacggtacggaaacggattggtcccggccatcagacggcgggatgaacttacaggtttccttccggcatgcatcatccgcaaggattagcgtaatcgcggactgcggatgagatgccgtatgtcagacgaggtgccaggacaggcggtgcaggtcgctgggcccgaattcagcgatggcgtcacggtgtgcggccgaaccgtaacccttgttgtgggcccattcatatggttcatattggggttgcgctcccagttcgaccatgagccgatcccgggtgactttggcgatgaccgcggcagcggccacggcggcgcaataccggtcgcctttcactttggtggtaacgttcgccggcaccggcacttcgggcgcgtcgaaggtgttcagcgtcttggtgatgtaatcgttcggtccgtcgaggatcgcgccgaccttcaccggtttgccggagagcatgccgttgccgtcaatgccgagcttcgcctccgcctgtgccaacgcacgtaacgcggctacgccgagtgcatgggaaatgccccactcgtcaatctccttgttgctggcggcgccaaccgcccaagatgcgcaccaggatttgagttcgtcgaagatggcttcgcgcttgtgttcggtcagcattttggagtcggccacgcctttcggcacttccagatgcgaagattcttgcgagcctccttgcgaagctccagccggcccgtctaagtcacgcgcccaaatcgcagccgcaccaaccattaccggccctgcgagagatccacgccccacttcgtcaaagccgacgatcacatcgtagccttgttcggcaatagcacgttccaaatccaatgtgggaattacggaaaccgccatcaggccgccgagcctccttccggaacgtcggcaaacacttcatggtgcgcatcgagcccgccgatgcggttcaacggccaatatttcgcgagtccgacacccactacgtcggaaataggcacaagtccatgtgaggaatcaccctgatgatagcgtgaatcggcggaattggcgcgattgtcgcccataacgaacacgtgtccttcggtcacggtcacgttgaacgcgaatgagctgggatccacgtcggggcgaatgtatgcgctttcgtcaatcgccacaccattgatggtgatcggcttacctggcccttcgcatgccacggtgtctcctggcaatccgatgagccgtttgatgaggtagtcaccgccgagtttgctactgtcttcctgccgcagccagtggtcggggtccttgaacaccaccacgtcgccgcgtttcagatcgaagactttcggggtgagtttcgaggtgatcacgcggtcacctggttcgatggtgttcatcatggatccggagggaatcacgtagaatccgagcaggaaaatgcgtatcagcagcacgataataataggaattccgcaccagaccaaggtgtcgcgcaagccaaagctgtcgccgctattgttttcttctttggcatgcctcatacatgattcctttatcgtccggtttgcacactgacccctatcatagcggccaagaatagaaaaaggccctccggccgtaaggctgagggccaatttcacgctttatttgcgtttgaaactcacttctcggagttgtcgcggcgctcaacgatacgagcggccttaccgcgcaggttgcgcaggtagtacagcttggcgcgacgcacacggcccttgcggaccaccttgatggagtcgatgaccggggagtgcagcgggaagcgacgctccacaccggtgccgaagctgatcttacgaacaacgaaggtctcacggacgccgccgccctgacgagcgatcacaacgccggtgaaagcctggatacgggagttgttgccttcctggatcttcacgttgacttcaacggtgtcacccggacggaatgccgggatttcctcggccggcttcatgtgcttggcgtcaaatgcctcaatagcgttaaccattgtgtttcctcgagtcgccgccgcatatcagcgcacaggtaagggcttcacgatttttcaatttcgttctgcctcgtatgttctccgcaggtctgcctgcgaaggattgccaatccgccgaaaatcacggtaacttgcgtttgtgcaacattccgttcaatcttgcaattgttctcggctggacccgaagggaatcaggattatgcggcgtcctgaatcccggcacagcaatattcaaaaatacctcacccgccagaccttttgaagatggccaggggtagcaaaaagggctctgcatcccgtgcagagccctttcgaaggctatttaatccttagagaaatcagaacttgcgatttgcgcggtagaactggatcagggactgagtggaagcgtcctgagcggccagtgcttcgtcatcctgggagatggccggggtgatctgcttggcgagctgcttgcccagttcgacgccccactgatcgtaggagtccagaccccacacggtgccttcaacgaaggtgatgtgctcgtacagggcgataagctcgccgagtgcgaacggggtcagtgccacgccgaagatggaggtggtcgggcggttgccggtgaacacgcgggccggaacgatctcttccggagtgccctctgcacgcacttcgtcagcggtcttgccgaaggcgagagccttggtctgtgcgaagtagttgccgaggaacagctcgtgcacgtcctggtcgccgtccttggtcgggttcggggtgttcacgaacgcgatgaagtcggccgggatcagctgggtgccctgatggatcagctggtagaaggcgtgctggccgttggtgcccggctcgccccagaagatttcgccggtttcggaggtgaccggggtgccgtcccaacgcacggacttgccgttggattccatggtcagctgctgcaggtaggccgggaagcggtgcaggtactggtcgtacggcagcacggcgtgggatgcgaccttgaagaagttgcggtaccacacgttcagcatgccgagcagcacgaccacgttcttctcgaacggggtgttggcgaagtattcgtcgatctcatggaagccgtgcaggaactcttcgaaacgttccggtccgaacaccacggcgagggaggtgccgacggctgcgtccacggagtagcggccgccaacccagttccagaagccgaaggcgttggccgggtcgatgccgaactcagcgaccttctccaggttggtggagacggcgacgaagtgcttcttgatggcttcggcgttcttctcgtcggagccgtcgactgcgccggcggccttgagggcgtcgagcagccaggtgcgggcttcgcgagcgttggtcagggtttccagggtggtgaaggtcttggaaacgacgatgaacagggtggtctccgggtcgaggcccttggtcttttcggccagatcgttcgggtcgatgttggagatgtagcgtgcggagatgcctgcgtcagcgtacggcttcagcgcttcgtacaccatgacgggacccaggtcggaaccgccgatgccgatgttgacgacggtttcgatcttcttgccggaaacgccggtccattcgccggagcgaaccttgtcggcgaatgcgtagatgcggccgagcacttcgcgcacgtccttgacggtgtcctgtccgtcaacgatgtacttgccttcgtcttcggccgggcggcgcagtgcggtgtgcagcacggcgcggtcttcggtgttgttgatgtgcacgccggtgtacatggccttggtgcgctcgtcgagcttgacggccttggcgaggtctgcgaacagctgcagggtttccggcttgatcaggttcttggacaggtcgaagtgcaggtcgcccgcgtcgaagctcagcttctcgacgcgctcggcgtcatcggcgaaccactgcttgaggctgatgccttcggactgcagctcatcgtagtgcttctgcagtgcggcccactccggggtcttggtggcgtcaacaggaggattgatggccatggtgtataggtcctttcatcatcactatgaagcggatgcgattgcggcttctctgcggatttccgcgtgtcgcattccgtatctcttcacctcacaagatactcacaaaagaagacagaacaacacaaaaatatttcctgagttaacacattcgccaagattcgcaatatagcgcggttccgacaaccttccgtcttcgacatgcgcattttcgacgattactgaaatcgtatgcatggctccggcgcaagtcttcgtaacacttccaaacatgtaataaacgaaacgatcgcattatgcagtgaacgacaagaaaacggcactgcaactaccagcaagcaagcattcaacgacttcgtgctctgcggggtcacaaacaatctcccgcacccggtaaagatctccttgccgctcttatgcgagcgcgacgaacaagaagtgagcgccggtcatcagcagcaaactgataatcgcagtaatcgacagcgtaaaaccagcaagcttcgcattaccaagcaccttgtcggtaaacagcgtggaaaacactgcaatcggcgccaaacaacacattgcagccgcctcacgaatctcagcgccaaacggcagcagcagccaagccgcagtagcaaacgcaataccaaacggcagtcgccagccaatcaccttcaacaactgaagcacatcctgcttgccagatggcaaatccataagcatgcccaccatcagcattgcgcagaacgaattcgcgttcgaaagcggctgcacgagcgcggcaataatgtcaggaatcttcacgttagcgagcgtgagaataatcatcaccaagtacgtgtcgaacggaaccgaaccgaagaaacccttgaacacgttgcgggccaacgccttgcgggcaagacgtttggcatccttgtctttcggcttcacatacgggagcgtgggcgcattgccctgatactgttcggtaagcggcatgccaggcttgatgtgcagcagcgtttgcgtcatcacattcgtaccggcggcaaccattacgcaattgccaatgtcgaacatggcggcgggcacgatcgcgcccgtgccaagaaacgcctgcaccaccgggaaacagaagcagccaacgttgaagccggaaccattcaacatcatgaacgcacggttctgcaccggtcggtggcgggacgtcaagaaaaccacgaccggcggaatgaacgcaacaatcaggccgaacagcgaaatcaacagcatgctggaatcatgcggattcgtagcaaacgaatagacgatcgcgcctggcagcaccagattgaaaataatggtctgcataatgcggtaatcgcgatcttcgaacaggccggcacgtttgaacaagtatccggcgagaataatcagcagtagcgcaacaggctgaatcagcgcagacacgacactcccctaatccctaatcatctctttctcttcctacccgaagccatcttaggagcatcccctgccaccaagccacccatcaccgtcctgtttcttccacccactggaagaaacactccgctcacgcgcccctcagcgtcccaaatcctccacccgctggaagaattcacccgcaaataagcctgccaccgtcccaaattatccagtcagtggaagaatccacccgcaaacgagctccccaacgtcccaaatcctccacccgctggaagaattcacccgcaaataagcctgtcaccgtcccaaattatccagtcagtggaagaattgggacgcaaacgggcaaaatgttttcaacatgttctcaaaaaggcttattgagtggactacaatgaccaagaactggcggaattccgccgttttctgaaagtgcgcgagatgggacttgaacccacacgtcaaagacacaggaacctaaatcctgcgcgtctaccaattccgccactcgcgcaagtagccatatcggggcgaaacgctcctgatatgcgaaaccctagatgctttcacatctagggcgctggagccacttgacagaatcgaactgtcgacctgctcattacgagtgagccgctctaccgactgagctaaagtggcaatgcccggaagcacacgccatccgcgcacaagacataaagcgtaccagaaagtctcaccccacgcaaatccgcgtcgcgccaagcatggctgaaaccccctaaagctagcggcgcaggagtttgtgggccaaatcgctcacgccgtagcgcagcttgctcaccggaagcgtgaattcgcccggcagttcctcaacgtagccgttgaagccctgcttgaactcgagcacgccgcgtccatcgtcttccggatcgtcgaacactcccgaaatgccatagaagttgtaccgcgtcactccgcgttccaagcaacgcgacatcatctcatgctgtaaggcggtgggcgcgtagaacttggcgtaacgatcgtcggatccgctggagaaatacaccagctcgcgttcatgccacatgaacagacctacggcgaccggcaccacctcgccatcacgagcgatgcgctcgttcgcatcctcaatgcggcgacgtgcggactccacattcttctgagccgtatcgagcttcttgcgcacatcatccgggtacttcgtatgctcaagcgaacgctccaagcgttccacgtctttcgagaacttcgccagcttttcctcccaggattgcaaatagcggtcaagatgcacttccgccaccatgaactcggccttgtctccaaacgcatcatatacgcgttcgaagtaatcaaggctacggttggcgaaatgctggcgttcgctactcagctcgcaaatatcgtggaacacgttcagctcactgcgattcaggcgtcgaacctccacgccgctgttccgcgcgatcttgacgttacgacgcgtgttcttcgcatacgaagcgagcagctcgccggcgttcgagaactctctcaagtccttgacgtaattccaacggttcatcagggcatcgtatccacgggtaaagccagcatgcttccaacccagccgctcgtactcccgcaccatctcatcattgggttcggccatggccttgccttgcgaatcacgaacgcaatacacctggttgggccagcacgtcaggctgatggcgtgaacctgttcggcagcctcgcgcaaaccttcggtcaacgcggtcatctgctctctgttattcccattgcacaacgagccaagccataacgagccttccacgccgaaacgcccttgcgaaaaagccaccaacgcgccagccaccggagcatcgtgcgaatccaccaatccaacgtattgcgtttgcatgccgtcggactgagccaatgccgccatttcggaagtctgctggaatccgccgtatctgctcgcggcggaaagctcatcaaactcactaccgctcagctcgcgcacattccattcagacgattcttgctcttgttcctcactcgcattcacttcgcgcatcacgatccgtaactgcctttcactatcccaactggctaaaatcccttttcaccaaaagcgataacctagtccagcctacagtcgccgtcaacagcgttcacataaccctcgcgcacctataagcccccacccagaatcctccaagcggaaggtgagctaatagctagtggcgcaggagtttgcggagggcggtcttgagtttgaaggtcagcgggcgtacgggaagcacgaatgagcccatgagttcctcgacgtacccgttgaagccttgcttgaattcgagtacgccacgaccctcatcttccggatcgtcgaacacgccgttgatgccgtagaagttgtagcgggtcacaccgcgttccacacacaaatgcagcatggcatcatgctgaatgagcgcggaagcgtagaacggcttgtacttttccacactgcctgagaacagatacaccgtttcacgagcgtgttccacgaatagggatgctgccgccggaagcacgtcaccgtctttggcgtactcggccgcctcggtcaaacgtttttccgccgccgccaagtttcgggactcctcccctagctggcgttccgttttggtggtcggatgctcgtcgtacttggcctgcagcacatcgaccttcttccgcaaggcgtcacacttggattccatgtcggcaatgtattcgccgatgtgaatctgcgccaccatgaagtgggctttgctgccgtaagcttgcttgaacttgcggaagtaggcttcaccacgatattcgaaattacggcgttcggcggtggcctgctcgatgtcggcaaacacctgcagctcgtcttcgcctagctcgcgcacatgcacgcccatggatgcggcacgtttcacgctccactgcgtgcgcttgtcatacgacttgagcagtgacttttcgtcggtaatgccagtcaggtctttcaggtaacgccagcgcggcaccgcagtgtagccgatggtgaagccgtcatgcatgaagccgaggtttttcaacgtttctacggcatcatcagcaggagcaccaccttggtcggctggcagttcgccgccacgcgagtcatgcaggcagtatggcatttccggcacgatttccatctgtgcggaacctttcgccttcgcgtgctgcttgagttgggtcatgaaatattcggtcaattcgcgatcgcgatagtcacacaaggggccgtcgtgcaccacactgaaggtggaaaggcggctgcgatgcgtttcgaataatgctcccgcaacgattgtgccgttttcttgaacgccaaggtattccacttcgatcccttggccggcacgcagacggcctgcggcagaggtctgttggaagttgccgtccgcgtgatgtgcggaaaaatcgtcaaacgcctccggactcaacgtaaccagagaaaatgctcgcatgtaatcctaccccttcatgctggttgattacgagattgattgccgtacgcaaccagcatgatggtagcacgagtcaaaggacggtgatttcggtagggattaccgggtcgcccttcatgaggctttgcgcgccgatcggcagttcggccagcgcctgggcgcggtaattatgcgcgttgacgatggcttcgtgtccctgataatcggagttgatttcgccgttgctcacgtagccgaccagcagatccttccagccttcttccggctgataggcggccagctgctcttcggagccggaaatcacatgttcgcagtcggccagcgcatactcgtacgaacggaaggcgagcttgcggcccggaaccgtggccttgtctttcgacttcttggccaccggctgcatgtcaccagcggaattctcgcgttcagtcagcttgtacaccatcgcacaggtcggagcgcccgatccggtgacgagcatggtgcccacgccatacgaatcgaccggcgcggtctgcagcgaagcgagcgcatactcgtccaaatcgttggtaacggtgatcttcgtgttggtagcgcccaacgcatccagctggttgcgcacgcgctgcgccaacgacgccagatcgccggaatcgatgcgcacgccgcccaattcgggtccggccacgtcaacagctgtcttcacggcctcttcaatgttgtacgtgtcaaccaacagtgtggtgttcttgccgagcgcggcaatctgcgattcaaacgcgctgcgctcatcatcatgcaccagcgtgaagcagtgcgcggccgtgccgatggcattcaagccatacatttgcgcggccagcagattggccgtgcccttgaatccgcccactaccgcagcacgggcagcggcaacggcggcccactcgttcgtacggcgcccgcccatatccatgcacgggcgatccttcgcggcgctgaccatgcgggacgcggccgacgcaaccgcggaatcgtaattcagaatgctcagcaacagcgtttccagcagcgtgcactcgccgaacgtgccttcgacttgcagaatcggcgaattcgggaagaacatctcaccttcgcgatagcccttgatcgaaccggaaaaatggaaattctcaagccatttgatagtttcggggcccactactttgcgatctgcaaggaatttcagatcattatcgtcaagatggaaattttcaagcgcgtcaagaatacgaccttggccggcggccaccccatagtggcggccaagcggcagatgacgggtgaaaatctcgaatacgcacttgcgattggcggtgccgtccctcagacacgcgtcaagcatggtgtattcgtacatgtcggtcatgagtgcaggtgaataatccagcatttccaaagcctttctgacttttggtgaaactgaccataagtgtaggcctcgccgtggccaagcacaggttttcgttccatcatacgtgcttgcatgcctgtattacgtgagacaaacgtgagatgcgcgcaaattcgggcacgacgcaaattgggataggcaaattgaggtgcagcaagaggcgagttcaagacggaaagacgggttttcggctggtgatactgttttttcggaaaatacaaacgattgttgatcgtgtgatcaatcgaaagcagagaagtcagcgatggtagcgattaaagacttgttgggcgaaacgatgattcgtacggacggacgcaaggtggatgagctgcgtccggtgcgcatcacccgtcatttcacggatgttccggaaggatccgtgcttgtggaatgcggcaatacgcgagtgatgtgcacggccacgttcaccgcaggcgtgccacgttggcgcaaggactccggcttgggctgggtcaccgcggaatatgcgatgctgccgcgagccactgcagaccgcaccgatcgtgaatccgtgcgcggcaagatcggcggacgcacgcatgagatcagccgactgatcggacgttgtctgcgcggtgtggtcgacatgaaggcactcggcgaaaaccaggtgcagatcgactgcgacgtgctgcaggccgacggcggcacccgaacagcgtcgatcaccggcgcatatgtggcgctcgtggacgccatgcgctgggccgagaagcacaagcacatcaggtccgccgagcgcgtgatcaaagacagcgtttccgccgtgtccgtaggcgtgatcgatggcacaccgatgcttgacctgccgtacatcgaagacagcaaggccatgaccgatatgaacgtggccatgaccggttccggcgaattcattgaaattcagggcactgccgaacaccgcccgttcaaccgcgccgagttgaacgcgctgcttgacctggcggaaaagggcaacaaggaactgcaggccgcacagcagtccgcgctcgcacaggactgaaggctgcaagtcggacgtaagccgaccgcaggctggcctcgcaaaccaatcgtaggttaggcaagtcagggcacgtcaaacgcacgtcaggcaagccgacatcaacgaagcaacgaacagcaacgaaaggaatcggaacgtgagaatcatcgtcgcaacgcataacgagggcaaactcgttgaaatcaaccgcattctggaagattgcctgggtgtggacgcagatcaggtggagctggtgtcggccggttcgctgaatctgccggatccggtggaagatggcgtgaccttccaagagaacgcgctgctcaaggcccgtgatgtggccgcacgtacgggctgcccggcaatcgccgacgattccggtctgattgtggacgtgatgggcaatgcccccggcattctttccgcacgttgggcgggcaagcatggcgatgacaaagccaacaacgcgctgctgctcgcgcagatcgccgacattccggatgccaagcgtaccgcgcgtttccgttgcgcggccgcgctggtggtgccgcaaaccgaagcaggcgcaggcgccgatggccgttatgcgatcgctcaggaaatcgtggaaaccggcgaaatgccgggcgtgctgctgcatgagcctcatggcgagcatggcttcggctacgaccctctgttcgtgcccgacgatcagccggcgcgtgccgtcgaagccggcgagaagctcacgtccgcgcagatggaaccggccgaaaagaacgccatctcccatcgcggcaaggcgttgcgcgccctgctgccatccgtggccactctgctgaagtagggctgaaacgagtcgcagcagtctctattagacgttctgctaggtgttctaaaggtgtggaactgtagtttgcggttccacaccttttattttccgctttttcgccaactgggcgtcaccgcccttcgccaaccagtcttcactgatcttcgtcagtccaccgaacttcactgatcgtcggcgcgaaaatccttgccatcataattcgcccaatccgggtatggcacccccgtttcgatgctgtgctgaatatcgcgatacaagtgcagtttgcgcaacacatgcatgtacgcctcttccagcgcggcccgctgtttcaaaatcgcttgatgccgcgattccaacaattccagcatgtccgcaatgtgcgcacgctcgtctttttcgtatgcgaagaagcgtttgagttcatcgatgctcatgcccgcatgtttgaagcaggcgatcgcctcgagccgcccgatatgcgagtcggtgtacacgcgtcgccccgcatcgtcgcgctccacgtcgcacagcagcccctgatcctcgtaatagcgcaaggttgacgtctgcacatggaatcgttgcgcgacttcacgaatcgtatatgttgccattccccttctcatttctacgattttctaggtttttctagcgattttgcgattccttgcgattgtcaatcatcggaaaacacactatcgacgatacttgcattcaagtttacttgaagtgcgacgatagtatcgtcgacaaacttacgacatgcgccaactcaagcaacacagcgcacagcggaatacgcagagttttcaaggaggaaccatgcttgaaccgaccaccgtctacacgccgtcacccgctcgatacgattccatgacctacaatcatgtgggcgagagcggcctgaaacttccagcggtttcgctcggcttttggcataatttcggcgatatcacgccgtacgccactatgcgtgacatcgtgttcaccgcattcgacaacggcatcacacatttcgatctcgccaacaattacggtcccgagccgggcagtgcggaaaagaactgcggccgtctgctgcgcgaatatttccatcatcatcgcgacgaactgatcatcagcaccaaagccggctacgaaatgtggctcggcccctacggtgatctcggcagccgcaaatatctactcgcctcgctcgaccaaagcctcgaacgcctcggtctcgactatgtcgacattttctaccatcaccacatggattcctccacgccgctcgaagaaaccatgggcgcgttggcaaccgccgtgcaaagcggcaaggcactctacgtgggcctgagcaattacgatggtccgacgctggaaaaggccaccgcgatcctcgatgagctgcatgtgccgttcatcatcaaccagaaccgttacagcattttcgaccgcaccgtggaacgcaacggattgaagaaaaccgccaaaaagcttggcaaaggtcttatcacgttctcgccgctcgaacagggtctgctcacgaaccgctatctcaacggcgtgcccgcagacagccgcatcgcacacgacggccgcttcctcaaagaaagcgcgttgacgccggaacgcctgcagcagatccgcgacctgaacgatcttgccgccgaacgcgggcagacgcttgccgaaatggcgctcgcctggctgctgcacgacggttacgtgacctccgtacttgtcggcgcttcccgcccgcagcagctgctcgacaatatcggcgcgttgaagaacaccacgttcagcgatgaggaattgcgtcgcatcgacgaaatttcgttgcgctaaacgcggatatatcagcagatataagacgcaacaacaataaaaaatctgccgagatggtctctatatcgaaattatttttcgatgattgagattgtctcggcagattttttatatgtaatcactttcggcaatcttcagaaatttcaacgaaattccaagatcaccatacgatgaaagagataaaaaacgattagaaattggaattcatcatttcgtcgtagatacgcttgcaatccggacataccgggaactgcgaaggatcacgcttcggcacccacaccttgccgcacaacgccaccaccggtcggccggtgcgacgggactcggcaatgcgatcgcgcgacacataatgcgcgaaacgatccgcatcgccgttgccgccatcatccagcttcgtctcctcttcggggcgttccagcaccgcagtgccagtacccgcgtcgggattggaaagcggcgagaccgggtcggcctcgtcaatgaagccgtcgcgatcatcgaatatcgaacatgccataatcaactcctcaaatacgccgcaaccgcggcaccactgcctccatcatagccatgaaaacccacatattcgccgacacttcgcgtaatttcacgcaatcgcggtacgcttgaggctatgacaattgcagtttgccccgggtcgtacgacccagtgaccgccggacatttggacgtcatcgaacgttgcgcgcgttttttcgatgaagtgcatgtcgtagtggcggtgaacgcggcgaaaacaccgatgttttccgaagagacccgcgttgagattatccgtaaggcgcttgaagagcggaattgccgcaatatcaaggttgcttcaacaaccggactgattaccgactattgcaagaaggtcggtgcgacggttatcgtgaaggggcttcggcagaatggcgattatgaagccgagttgggtatggcgctggtcaatcgcaagcttgccgacgtggaaacgctgtttttgccggcggcgcccgatttggaacatatctccagttcgatcgtgaaagatgtggcacgtcacggcggcgatgtgaccggcatggtgcccgattgcgtgattccgctactcggagaagcgctcaataatgaaaagagggcatgatgggtgaagaaacgaatgcgtacgatccggccggcagccagtttgacgacgacgtgaccgccgaacgcccgaccgatcgggcggcccaatccggtcagaaggcacaagccacggcacgcgccgccgagccggtcaaaccgttgatttccatgtctgatctgccggatttacgcaacacgttcaatcccaacgcgccgctggacgattccaacgatttgagccgcgacgaattcaccaccgtgtacgacattatcgacaaactcgaatcggcattggacgaagcgaaaccgatactgttcttccccggcagcgtgcgcgtcgaccgcgacgaattcaccgaacagctcgaccagttgaagaaaatgatgccggtgcagctggaacgcgcctcggcgttgatgcgtgagtcggaacgacgtttggaaagcgcgcaaacgcaagccaacgccatcgtcgcttcggcgcaatcgcgtgcggcagacacgatacgtgaggccaacgagcaggcgcaattcctcgccgggcaggaaaacgtgaccgaactggctcggcagaaggcgcgtgctattctcgaccaagcgcaagccagggccgaccatctcacgcagggagctgacaaatactgcaccacggtgatggaaacgctgcaacagcagctcggcaagcttggcaacgacgtgcaggcgggattgaacgtactgtatgatcgccagcgcgaagcgagcacgcatgtgccgcatcttgacgcaaacgactatccggaaagctgaatggaaggctgaacatggcacgtatcgaagattccccgtgggcgatttccgtggcgcaagtcgcctcgcgagccgggcaaagcaaggagatcgacgcaacattccccgcaccgagcggcatcggcgatgagatcgtcggcgttgaggagggtgcggatgtgaccgttgtcggctcgttcgactccattgtcgacggcctgattttcaacgcccgcatcagtgcccccgtgcacgccgaatgcacccgctgtctgaaaccgatcaagcgcgattggacggtgaacgtcacttcgttcttcccatatgaagacaagtccgcaagcgttgcgtccggcaagggcggcaaaaacggcaagggcggcgtcaaggaagaggaagtcgacattatcgccggcgaagacgagtcggaggattcgtatccgctgcttgaaggcggatcctgggccgatattgagatgcttctgcgcgacacgttggtcgaggaactgccgttgcagccgctgtgcaagcctgattgcttgggattgtgctctcagtgcggcgccgatctgaacgaggatccggaccatcatcacgatgtgaccgatattcgtttcgccgctttggaaggcttgaaggcccggctggaaggcaacgagtaaggtccatccgggtgctggcagggctgattttgctcggtttttgcaatttgtacggagcacaagttaagatactgaacgcttaagctcaatcgttcgaacgaaacagaggaaacacaatggcactgcctaagtacaagacctcgcgcgcgaatactcattctcgccgcgcaaactggaaggccaaggccgcccagaccgttacctgcccgaactgtggcgctccggcgctgccgcacatggcctgcccgagctgcggcgcctaccgcggccgcgtgtaccgcgaggctgtccgctccatccacaccaagtgagtggctgccgagtaacggcatgaagcattgaaaccctgccatcgacgggtggcagggttttgtatatttcaggctgcgcacttggccatatgcattcgcatgcacccaaccatctcacctcgcatccgccaagtatcgtatccacctagtatccgcgcatttccctgcatttccgcctcgacatgggtggagagtagactgaacgggatcgttgtttgcatagcaatcggccagattcgctggcttgttgccacgtacgcaacgtcccgaacagcgcggcgagcttcgccgtcgcatacccactacgaaaccgaggacgattatgacccagaacaacgccgacgcatccgccgtttccgaaggcgagatgaccgccaacgcactgcttgaagcgctcggcaccacgctcgaacccgacctgctggtcgaagcgctcacccaccgctccttctcgcacgagaatccgggcgcaaaaaactacgaacgtttggaattccttggcgacgccgtgcttgagctcgtctccacggaaaccctgtacaaggcacaccccgacatgaacgaggggcagcttgcgaaaatgcgcgcgaaagccgtttccgaggaatccttgagcaaaatcgctcgcgaaaagctcaatgcaggcccgtacattctgctcggtcatggcgaaagcgatcagggcggcgctgataaaagctcgattctgtgcgatatcgtcgaatcgttgatcggtgcgacgttcattcagcatggcattgacgaggcacgtcgcgttgtgcatcatcttgttgacgaaacgcttgcggaagtcgcgacggaaggcccagccctcgattggaaaacctcgcttaccgtcaaagcgcatggcatgggcttcggcgaaccgcgctaccagatgtcggtttccggtccggaatatgcgcaagtgttcactgcgaacgtcatgctgggcgaaagcgacgaaatcatcagcaccggcacaggcaccagcaaacgcaaggcgcaactcgccgcagccgaagaaggttggaaggcactggacaatcgcaagcctgaagcacaaaacgtccgtaagcatcgcaaacatcatcacaagcacaacggcaacgaaagtaacggcagcaacggcgaaaacaccagtaagtagtcgcaggtagataacaagcagctacgaatccgccctctcataccgccgcggaacgcaatacgccagaatatggcacgaatccggcatattctcctgtcagccgatagcatagactgattactagcgaaggattgcgattcgcaagtcgccacaagcgattgcgccgctttccgatgatggggttcggctgattgcgtgcaccgaaacgcggcagcatacccctgtaagaaagttccacgagcgagtatgagagggaacatggtgttacctacgcccctgcaggcattcagcggcatgcccaaggcagccgcaaccactgaaaagcagaccattgttgacggcgagaagatgaccggcgccgaagcgctggtacgttcgctggaagatctgggcgtcaaggatgttttcggcgttccaggcggcgcgattctgccggtatacgatgcaatcaatgatgaaaccagcttccgttttgtgctgatgcgccacgaacaggccgcaggtcatgcggctgaaggctatgccgtatcgaccggtcaggtcggcgtgtgcatcgtcacgtccggcccgggcgccacgaacatgatcaccccgatcgccgacgcgaacatggattccgtgccgatggtggtcatcaccggccaggtcggcgtgaacgccattggcaccgacgccttccaggaagccgatatcgtcggcgcaacctacccggtggtcaagcactcctatctggtcacgcgtgcgcaggacattccgcgtgtgctggctgaagcgcactatgtggcacgttccggccgccctggtccggtggtggtcgacgtcaccaaaaccgcacagaccggcgatatgtactattcgtggccgcagcgcatgattctgcccggctacaaccccaccacgaaggcgcacggccgtgtgctttccgacgctgcgaagctgttcgagcagtcgtaccgtccggtgctgtatgtgggcggcggcgcggcacgttccgatgccggcaagctcgtgcaggagctggcggaagtcacgaacgctccgatcgtcaccacgctgcccgcacgcggtgttgtgcctgattccgatccgaaggtgcttggcatgcttggcatgcatggcacgattgccgctaccggtgccgtgcagcgttgcgatctgcttgttgcgatcggcgctcgtttcgacgatcgtgtaaccggcaagcttgacgctttcgctccgggtgcacgtgtgattcacattgatatcgatccggcggaaatcggcaagaaccgtcagccggatgtgccgatcgttggcgatgtggcaaccgtgctgaaggatctcattccggaaatcaagcgcgagcaggccgtgcatggcaagcctgacacttcgcattggtgggagatcatcaacgattggcgtgaaaagtacccgatcaagtgggatgagccgaccgatggttcgctcgctccgcagtgggtcatcaagcagctttccgacctggccgatcctgacacgatttgggttaccggtgtgggccagcatcagatgtgggccacgcagctcatcgatttcgagaagccgcattcttggctgagctccggcggcctcggcaccatgggttacggactgccggccgccatcggcgctcgtgttggttccgaacgtttccatgagggcgagaagccggtgtggctgattgacggtgacggttccttccagatgacttctgaagagctggcgacggcgttccacgatcacacgccgattaagatcgcactgctgaacaattccgtgtatggcatggttcgtcagtggcagaccctgttctacggcgagcattattccgccaccaatctgatggatggagagaatacgccggaaatcgtggatgttcctgatttcgtgaagcttgccgaagcgtacggttgtgtcggcatgcgcgcgttcacggaagaagaagccattgaagcgatcaagaaggccaacgaaatcaacgatcgcccggtgcttatcgatttccgcgtgtggaaggacgctatggtatggccgatggtcgcagctggcgatgccaacgacaatgtcacctatatgcccggaatcaagccgctgcagcgcccgaaggccgctgccgacaacgagtaaacgagcaaacgagtaagtagtaaggaagggtctaccaatgtatcctgcatctcagccgggttccaagcgccatacgctttccgtgctcgtagagaaccgtccgggcgtgctggcgcgtattgccggcctgttcgcccgtcgtgcgttcaacatcaactcgctgtccgtctcccccaccgagcgccctgacatttcgcgtgtcaccgtgaccgccgacgtggatgaagtgccgctcgagcagatcatcaagcagctcaacaagctgctgcatgtgttgaaaatcgtggatttggatccgaacaccactgtggagcgcgaactggtgcttatcaaggtagctgccgacgaatccaaccgttccgacgtgcttgagatcgtgcgtctgttccgcgtgcgcgtggtcgatgtgaatccggaatcgctgaccattgaagccaccggtgccgaaggcaagattgatgcgctgctggggcttttggagcattacggcattatcgagctggttcgttccggcgcggtcgcagtgacgcgcggtccgaaggccttgagcgaaaaggtgctcggctccgaaatcaccggtcgctgatccaatcagcctaatcccaaacctacagggctttcccgtttcaacgcgggaaagccctttttgttgtcagatctgcgatattcagaaaatatctgatcattggagacatgccagctgcagtagcatcttttgcgcaaaacaacagtctcatagacgttcgccaggcgcaagaagatatcaaacaaggttcatcgggctcttaataatgtgttgtcagaggaaagttatcaccttcaccaaggattagttttcggccccggcaacatcgagaccgatcacaacatcacctactaccccatctacctaatcagcaagttttgcagcaactagcccagtagcattatcgcgatgccacaaactatgatgatggcaggacgacagggagcgttatgactgaaattattcatgatggtgttcctttacttcatatacggaaacaacaagatccgtattgccgatattgataatggacaatgaggtggcatctgggaaattcttcgcctgaagagagatcgtttctattccgttagatgtacaggcctccctagtggttagggtatgtggctgtccatctttgtagagaacaagcgaataaggagcttgctccttctgcttacacatggagatgacataatacatattgctgtcatcaactgtttttgtaaatgaaatagcatcatcgccatgtacggatttcgcacccaacttgtttactagaaccagttcatccgaatcattaaggtcatcgacggcaacgcggtcaagagcgtccacagtaaatgctttatatgcctgttttgcggcatcatcattctcgctgctgctctgtgcggagccatcaccggaactttcatgtgcagctttcgcgcagccaacgcatgaccacaacaacaaggtggacaacaagcaacaggcgcttcttcgcatcacttgattcataaggcacctccattggtctctccgacaagaacagctaaggtttcctgcaataacaagaatatgacattggcacatggaatgccacgcatcgctgtcgcacgaatggccaacattcaccggaaacgctggaggagctgcgccgccgccacaacatgcacaccctgtccggtaattggcgcgggcggtacgaatgctactcgagctgttcggagagttccatccattcgagttcgagttcttcggactcgtcggtgacggcttgaagctggtcgttgagcttgcctaggccctcgtagtcgctggggtcgtgcgcggccatttgctgttcaagatcggctttctgctcttcgagtttggcgagtttgcgctcgattgccgatacgcgcttggaggcttcgtggaaggccttgccggaaagcttcggtgtggaagatgcggaagatgcggcttcggcagtcgcggacccgcttgcggagttgcctgcagtgcctccggtcgtggaaccggcagtcccagcgaaaccgcccttcttacctttgccggcacccatcttttcgtccgcaaacggatccttgccgttcttgatggcctcagtcatgtccagataatcctgcacgccaccgggcaggtggcgcaccttgccgccgatcagcgcgaactgctgatcggtgacacgttcgagcagataccggtcatgggagacgacgatcagagttcccggccaagtgtcgagcagatcctccatcacggcgagcatgtcggtgtcgagatcattgccgggctcatccatgatgagcacgttcggctcgtccagtaggatcagcagcaactgcatacgacgcttctgaccacccgataggtccttgatcggcgtcatcagctgcgccgactcgaatccgagacgctccatcatctgccccggcgtggtttccttgccgtccacgatatagctcggcttgtaacggctcagcacttccttgatcttgtatttaccgagcttctccaattcgtcgagacgctgtgaaagcaccgcgaatttcacggttttgccgatattcacatgacctacagtgggggtgatcgtgccgtcaagaatcttcaataacgtcgattttccggcaccgttcgcgccgacgatgccgaaacgatcgcccggcccaatcagccatgtcacgtcgtcaagaatcttacgaccggtaacagtaattttttgcgctgcagaagtaatttcttctgcagaatcatcagtattattttcttgcgattcctgaatttcttgcgattctttcgcagctgcagcaacttgcgccgctgcaacaccggcatccaccaatcgcggatcagtcagatcgtcgacggcaacttccacggaaccatgcacttgcggctcggcatacatggccggcaccacatcgacgcgcgatgccgacgcttccatgtcggcaacgtcaggatcgatatcggcctcgccttgcacatgttcgaaaatctgcgtcacgtcgatcaggtcaaccacctgcttgcccaagcgggatgtggccatttgcttcaattccagcgtattgcgcaccggaggcacgtcggcgatgagctcacgcgcggccttcacatggaatttctgcttggtggaacgggcgcgggcaccgcgggtaagccaggcaagttccttacgagccagattgcgacgtttcgtttcacgcacgtcggcttggcgatcgcgttccacgcgctgcagcatatatgcggaatagccgccttcaaacggctcgatttcgccgtcatgcacctcccacatggattcgcacacttcgtcgaggaaccaacggtcatgggtgacgagcagcagcgcgccggatccggccggccaacggttcttcaaatgttccgccagccagtgaatggtcaccacatccaaatggtttgtaggctcgtcgagtgcgagaatatcccaatccttgagcaacaggcgtgccaaatcggcgcggcgacgctgaccgccggaaagcgaaccgattttcgcttccaagctgatgccgccaagcaatgcttcgacgatttcgcgcgacttggtttccgcagcccattcgtagtcttcacggccttcgagcgcagcttcgcgcacggtggcgttgtcgtcgagcgggtcacgctggtcgagcatgccgaacgtaagcccgccgcgaatggtcacgcgaccggaatccggctcctgcgtgcctttgaacaaatgcagcaacgtggacttgccgtcgccgttcttaccgacgatgccgatgcgatcgccttcaaaaacaccctgcgttacatcgttgaaaatattcttggtcgcaaaagcaagcgaaacgtgttcaagtcccaaatcataagtcggcataagtcaccaatgtagcgggaacatctcccaaacctgcaggcaatgccgcaacttgcgaatcgccaccagcgctacgcagcaatcggaaccgcacgcaactcggcgatcagccctgctgcgcctgagccaaattctgcccatacgaattacaacgagcggcaaaactcgaaaacacctgatccgcaagcggctgcaactgcggattatattcggcgaacgcctcgcgcaactgcgatttcgacccgccggcagccttgagatccttgaccatgcttgactcgtcaagccactcctccaacagagtaggggtaacctccaagtggaactgcatgcccagagcggaaccaaaacggaacgcctgcaccttggtcttcgcggatcgcgccaatggctgcgcgccctccggcaacgacaccacgtcgttatgccagtgcagcacatccacggttttgttccacatcgagaaataatcatgcctgtcgatgcatttaatcggcgcaaaaccgatttccggcgcctctcccgacttcagcttcgcccccagcgcggtggcgatgatctgatgtcccaggcacacgcccaacaccggcttgcccacactgaccgcagcccgcgcgagcttggcctcggcctttaatcccggatacttgtcgtagtcgagtgcgcccatcggcccgcccatgatcaccacgccggaaacctcgccaaaatcaggcaaatccggtttcttctgcttggcgacattgatgatttgatactgcagtcccaaatcatccagactgtctaaaatgcgtcccggtctctcccacggaacgtgttgcaaaatcagcacctgcgattgcgtcatacgttctattgttgcatcacctacgtaaacgatgttcacaaatccaacaaaaaccgttttgccgttcattttcatctcgcatgcatgtccgattctggcaatactctcgtggttatgacgaacacgcaagaaccgcagaatatcaacatttctagcgtcgcaaccgcagttgacgcagtggcgagcgccgctgccgatctgaagctgtacgacaccgcatcgcacgccgtgtcgaatttcacgccgatcaagcctggtcaggtcggcatgtacgtgtgtggcgccaccgtgcagagctcgccgcatatcggccatattcgtgcggctgtcgcgtttgacgtggtgcgtcgctggttcgagcgtttgggctacaaggtcacgttcgtgcgcaatgtcaccgatatcgacgacaagattctcgataaggctgcggccgccggtcagcagtggtgggagcgcgcgtacatttacgagcgtgaattcactgaggcttacaacacgttgggtgttgagccgcctacgtatgagccgcgtgcgaccggccacatgatcgacatgatcgatctgatcaagcagatcatcgacaatggccacggctacgtggtgactgatgagaacggcaatccgaccggcaacgtgtatttcgacgttgccagctggcctcattatggcgagttgacgcatcagaagcagaccgctgtggccgatgccgcttccgaggtggccgatgccatgggtccgtctgtcgacaatacgggcaacgacaagtacaatccggttgatcctgcggacatgtcggaagacaagcatgatccgcgtgatttcgcattgtggaaggctccgaaggattccgatccgcttgacgcgcgttggaatactccgttcggcacgggtcgcccgggttggcatattgaatgctcggcgatgagccaccgctatttgaaggatatgttcgacattcatggcggcgggctggacttgcgtttcccgcaccatgagaacgaaatggcgcagactcgtgccgccggttacgattcggcggctcgttggatgcattccgcatgggttaccgccaagggtgagaagatgtcgaagtcgctgggcaacggcttgtccgtgccggcggttttggcggaaaattccgcttgggtggtgcgttacgcgcttggttccgtgcagtatcgttccatgttggaatggtcggatcagacgttgaccgaggctcagtccgcgtacgatcgtgtgtcgaatttcatcgaacgtgccggtgccgccgttggcgggcagccgtcccgtgaggagatcgtttcggtttccgccgatgagctgccggctgatttcgtcgccgcaatgaatgacgatattaatgtttccggcgcctccgctgcgattttcacggcgattcgttctggcaacacgttgctttcgaagcttgccgatcgtgttgattcagatgttgcgaaggatgaagttcgcgctgttttggtgaatgtgcgtgcgatgctcgatacgcttggtttggatccgttggcggaaccgtgggtaagcgagggtacggccggcggcgccgccggagccggtgccgattccgctgagcatactgcgcttgaccgtttggtttccgaacagttggaggagcgtgccgaagcccgcaaggccaaggatttcgcccgcgccgacgccattcgtgatgccttgggcgcagtcggaatcgccatcgaagacactccccagggtcccacctggaccctcaaataatccgcagcgttcttaataagcaataatcccgtcttctcctattggaagagacgggatttccatttctcatgcaaatagcatcaagcatctcaccgaatatcaaccgaacatcatcaacaccattaattggaatgcgaaatttcccgcgggacggctagactgagggacattatggcagcatttagttctttgacagataggctctcgaatgcgttcaagcatctgaagagcaaaggcaagctttccgaggctgatatcgatggtacgatccgcgaaatccgccgcgcgctgctcgacgccgacgtggcgctcgacgtggtgcgttccttcaccggccgaatccgcgagcgtgcgctcggcaccgaggtttcccaggcgctgaatccggcccagcaggtcgtgaagatcgtcaacgaagagttgacggccgtgcttggcgctggcgttgaccgaccgctgaattttgcgaagaatccgccgaccgtcatcatgctcgccggtcttcagggtgctggtaaaaccaccctcgcaggcaaactcggctactggctgaaggattccggtcacactccgctgttggtcgcggccgatttgcagcgtccgaacgcagtgacgcagctgcaggtggttggcgaacgtgcaggcgtgcccgtgtacgctccggaaaagggcgtgcagtccgacggtggcgaagccgttgcttccccgggtctgaccaccggcgatccggtgaaggtggcgcgtgacgctgttgcgctggccaagcagaagctgtacgacacggtcatcatcgataccgcaggccgtctcggcgttgacgaagagctgatgaagcaggctcgcgatattcgcgacgccgtgcagccgaacgaaatcctgttcgtaatcgacgcgatgatcggtcaggatgccgtgcagacggcgaaggcgttcgatgagggcgtggacttcaccggcgtggtgctttcgaagcttgatggcgacgcccgtggcggtgccgcgctttcggtcgcctccgttaccggcaagccgattctgttcgcttccactggcgaaggtctgaaggatttcgaggttttccacccggatcgtatggcttcccgcattctcgatatgggcgatattcttaccctgatcgagcaggcgcagaagcagttcgacgaggaagaggctcgtaaggccgccatcaagatttccgatggttcctttggtttggatgatttcctcgatcagctgcaacaggtgcgcaagcttggtccgatgaagaatctgcttggcatgattccgggtatggccgcgcatcgtaaagaacttgagcagttcgacgagagggaaatcgatcgtactgaagccattattcgttcgatgactcctgcggaacgtcgtgatccttcgattattgacggttctcgtcgagctcgtatcgcttacggttccggcgtgaccgtttcgcaggtgaacgcgctgttgcagcgtttcgagcaggccgcgaagatgatgaagcgtatgagcaacaaggcgggcgctggcatgcctggctttggcggccctgccatgggcgggggcaaaggcaagggcaaaggcaagaagggcaagaagaagggcggtaagtccggcaatccgatgaagcgcgaggctgaagagaaggcattgcgcgacaagcttgccggcaagaactccgacggtaagtcttccggcggttccgcttttgccaagaagccgcagaatcctgcacttcccgccggattgcaagacttgatgggcgatgccggtgagctgccgccgaactttggcggcggactgtccggcttgctgcactaaagcaagcgacgcgaaaacggtaacgcataaaaaggggatgtgattcaagacgaatcgcatcccctttttgcgtactccaatcagctgttttcagctgaatcgactaccttataatcgccatcaactacttcaacgtcaacgtggcaacaagcgcaagatgatcgctaccttcaacgcagaacgaactcacgtcggaagcgtccaatcccttggtgaaaagcacatggtcgagaatgatgcgcggccacggcagccatgatgggaacgtggcatgacggcccttcgcctcgcacaaggccgcatccttgaagcccgcatccagcagcttgcggaagctcggatgatcggtaccggaattcaaatcacccaacacaacggtgatgtcgccctgcttctgagtggtcgccaactctcccaaaccgatgatgccggcggaccattccctgcatccgcgcatcggagacttcggatgtgccgaaacaaacgtgatgccgcgcatcgaatcgatcgggaagcacacgcccggcacgtcggccgcgggaatcaccgcagtgaccggagacatgtcgcttggttcaatacgaatccacacaccgttgaatccgccattgtccgtccccttgttctcccccaactgacggtacggaagcaaatcagacaatcccgaagcgtccaattgcgcaaccagatcgtccgtcaattcctgcaatgcaagtactgcaatatcatgttttttgaccgcactgacgattgccgcagcgttggcgcgaccaaatcggcagttcagcgtcatcacacggaaacggccatgtttcgcggattccgtaacagcttcattgcctgtttcacgagatgtttcacgcttttccgcaagtttttcggcaaccctctgcgcagtattgggagaattaagattttccatccaatatgcgattttgcgtagcagcgacgcaagacaggccaccgcagcgactcccccgagagccggctcatgcaacgcgaaaccggcgacggcgatcacaagcgtcggaatccacagcaacggaatcaacgcaatcaagtacggcagcggcaaatggccatcccaaccagccggcatctcgccaagcgcaatccatacaacgcaaataatcaacgcaatccaaagcgcgataatcattcaggcaactccccctatgcaaaccgttcactccgaacggacatacgcaaactcggaacctccaagtgtagccagcctgcctgattccgacgattccgccatgtagacccacgcaaacatctcacgaatgccagcaaatgtccgattctgccgattcggtcattcaaggcatcacattcgccgcataattgaccgtttccgcagaatcagacaaacgacttcccggttttgcacggattcggaaagtcgcatagagcgggaaacatcctaagacccatccgtccgtaccccacggttatacttggtaagttattcgcgcgcgcgaggccctctaactatcgcgtgacgtgaggaacatgtgggtttcggattccgtgccccacacagaaaacgaaacgcacacccctagttatacaaggagagccattttggcaaccaagattcgtctgaagcgcatgggtaagaagttctacgcgttctaccgcgtggtgatcatggattcccgtaccaagcgtgatggccgcgccatcgaagagatcggtacctacaatccgaacacccagccttcgaccatcgttatcgattccgagcgcgctcagtactggctcggcgttggcgctcagccgaccgagcaggtgctgaacctgctgaagatcaccggtgactggcagaagttcaagggccttgacggtgctgaaggcaccctgaagaccgttgaggccggcccggatgccgccgctcgcgttgaggccgttgaggctcaggctcagaagctgaaggctgcaaagtccgaagctgacgccaaggccaaggctgaagccgaagccgccgctaccgaggaagctccggccgaagagccggctgcggaagctgagtgatcatgctcgcccaggctgtggaacatctgattaagaacatcgtcgattttcccgacgacgtttcggtgaagtcccatgagaacgcgcgtggcgaactcattcgcgtgcgcgtcaacccggaagacatcggtcgcgtcatcggacgcagcggacgcacggcaaatgcgattcgcgccgtggtgcaggcactgtccgaccacaaggtgcgcgtcgacatcatggacgtgcgcaggtgagatcctagcgtggtgcgtgatatgcattctgacgaccctcaacagcccgagctgctgagggtctgtcgtatcgggcgtgcgcaggggctcaaaggcgaagtcaccgtgcagatctttacggacgaaccggaataccggttcgctcccggtgctgtgttgtacacgaaagacggcgaagaagagtatgtggtggagaactcccgtactttcaagaaccgttggatcatcaagttcgaaggcattgacaaccgcgaccagtccgaagcggccaacggcattgtgctgtatggcgaggcggacgatccggaagacatgcttgaagccgacgagtggtatccgaaagacctcatcggtcttgaggcgcgactggctgaagacaatatgcttggtctcgaaccgggcgtggtggtcggcaaagtcgttgacgtgatagaagtggcccaatggctgctgaagattcgtctcgccaatccggtgaaggatgccgacggcgttgtggttgagaacagcgcgctcgtgccattcgtggacgagctcgtgccagacatcgaccttgaagagggctatctgaccctcgatccgcctggaggtcttattccgggtctgtgatcgtttgcgatcctgcgtaagcattcatgattacgcgctttcgatcacatatccattcaagtgggcattggaatccagtgcccactttttatgtttcctgtcacttggcaggcatcccggtattctgaacattatgaagatcgatatcgtgtctgttttcccggaatattttgaagtgctgaacctcagtctgctcggcaaagcgcagtcgaaagggcttgtggaggttaccgcgcacaatctgcgcgactggacgcacgacgtacatcattccgtcgatgacactcctgtcggcggtggcgcgggcatggtgatgaagccggaagtgtggagcgaatgcctcgacgagctgcttcagcttgagcctgcggtaatcgaaaatacggaaaatattgaggattctgcggattccttcgatactggcaattcttgcgatactgcagattccgacactgcacaatcttccgaaggtcctgagaattccgaaaaaactgatattgcacaatcttccgcaggtcctgtgctgatttttccgaatccttccgccccgctgttcacacaacaggatgcgacggaactgagccatgccgatcatctgctgttcggctgcggccgttacgaagggtatgacgcgcgcattccgcagtattaccgcgcgcaaggcattgacgtgcgcgaatattcgatcggcgattacgtgttgaacggcggcgaggtcgcagtgtcggtcatgttggaggcgatcacgcggctgctgcccggttttatgggcaatgccgcttcgattgttgaggaatcgtatacgggcgagaacgcgctgttggagcaccgacagtacacgaagcccgcggaatggcgtggcatcaaggttccggacgtgctgctttccggcaatcatgcgaaagtggatcgtttccgccgcgatgaggcgctcgagaaaaccaatgagttgcgtcccgacctgatcgaagcgttggattgcgccaagctcgacaaggccgatcgcaagaccttgatggcgctcggttgggaggtttccgccgcccatccgcgcaaacgctagcttttaaacgcttgtttttacgcggaataatcgcaagttttttcttgcgattattgctgaccgttatctgagattggctcgctgggttcaatgtagtagacggcggtttcgccataatcgcgccgatcggtgatttcccagttttctggagccgtgggctcttcggaacgggtggatcgttccagcatgatcaccgtgttgctggaagtcagttcacggctggcaagatcggcgagcagctggttgcaatcattcgtttcgaaggcgtacggcgggtcgatgaacaccatgtcgaacggttcaacggccgaagctgaagccgcgtatttttctgcgcgagccttcaccacgcgggcactcatgccatgttcccacgaacggttatgtttcaacgcggtcagcgtctgcgcgatcaatgcggccgccggagcggatgattccaccgccaccagctctcgtgcgccacggctcaatgcttcgatacccaaagcgccggttcctgcaaacaaatcgagcacgcgggcatcgtccaacactccccatgaatcgagatgcgagaaaatcgcctctttggtgcgatcggtggtcggtcgagtgcccgctttcggcgtggtcaatgcaacgcctttgaatcgtcctgaaattacgcgcatacgcaccactctagcgtgccaggcgattaattaatcgcaccaaactaattactggtcaggaacgtttcattgccgcgcgtgaaatcaagcaccgccccggccaactgcacatgttcgagtaaatcaggatcctgagcgacaagcctcgtagcctcaacccgcgcatgctcaataatcttcacatccttaaccacacgaagcagcttcaaacctgactttccgccagattgcgcgtcgccgagcacgtcgccggcgccgcggaattccaaatcggcctgcgctatttcggcaccatccaacgtgccctgaatcacgtcaagacggcgggcggcatcactgtccgcgggcgcacgcgaaatcaggaaagcccccgaatcggtgccgcctcggccgacgcgcccacgcaactggtgcaattgcgaaagcccataccggtccgcatcgaaaatcacgatgcagctggctttcgccacgtccacgccgacctcgatcaccgtggtcgccaccagaatcggcgttatgccggattcaaaatcggccatgacctgcgattttgtggtgtcatcgtcacgcccggtcaacgtggcgaatcgaatgcctttgaactgcggcagcgattgcagacgctccacgatttccgccacggaatgcaacggggggcgttgtgcgcgctgttcgtcgtcttcgccaagatcgtaggcgtcgtcaaaagccgcggccgacgaacctgcggttttcgagcctgaagccgctgacgccgccagcgcgccgtccgcatcttcggcatcggcgtcaatgcgcgggcagaccacgtaggcacgttcccccgcgtcgatgcgcttgcgaatcagggcaaacatttcgcccatcaacgacgcattgtcttccggcaccacgaatgtgcgaatcggcttgcggccgccgggaagttcggtcagcgaggaaatgtcgagatcgccgaaccaggtcatggctgcggtgcgcggaatcggcgtggccgtcatgaccaacagatgaggcgccgtagaacccttggaattcaacgattcgcgctgttccacaccgaagcggtgctgttcgtcgatcaccgccaaggtaaggttcggcgcctggaaactcttggaaaatgcggcgtgcgtcgccacgacgatacagggcatgcccgatgcggctgctgcgagcacgcgacgacgttcggcaagtcgcatacttcccgtgagaagaaatacaggaatctccccatcttttgtgccaaatatatcgtttcctttgccggaaaatccggtttccacatcatcagatgcggccaaatcaagaaggtctgcaagttgtacacctttatccacagcattattgtgaattgtttttgcgtcgaattccccatctttcgaactttgcgcggaccgtttattgcttcgccgcgcattggcatcatctagatttttttgattatcactcgaatttgcgtcgctttttcccagtttggataccattgtggaaatgctcgcataatgctgttcggcaagaacctgcgttggcgctacaagcacggcctggccgcctgatccgacggcctgcatcatggcagcaaccgcgaccacggtcttaccggaaccgacctcgccttgcagcaatcgttgcatggggtaatcgtgcgccatatcggcggaaatatcggcgatgacctgctgttggccgttcgtaagggcgaatggcagcgacgcgatgaaatcgtctttcaaccgcgtttcagggcatgcggtagccttggatttgcgcgatgcatcgcgtgatttgacgagcgcggtctggcagatcagcgcttcctcatatcgcaacgtttgcaaggcgttatcgaaattcttgcgatcaaccggatcatgaatcgccatgaatgcctcagcacgatgcataagcccatattcctcacgaaaatcttccggaataatatcgggaatagcattaccgagtactttaatctgtatttctcgatcaatttggggaatatcaaaatccccttcttgcgtaggattatctaagaaattccctgcattttgcgttgccaaatattcggctccgcgcaacgcatccatatatttcaataccgattcatgaatatgttcgctggaaattcgcgaagttgcatgatataccggtcgtggacggcaaactcgtttcagcgcttcgtcgatcgtttgcgcatcgtatttcagattgccgagaggcggattcgcaggatcgccgaaaccgtcgttccattccccgttttccgactgcgattgcacgggattgatggtgagcaggtcgggatgcgtgaattgcagacgattgtcgtacacgcttggctcgcctgcgacgacgagcagcgctcccgcgtgcagtttgcgctgcacccagtcaacatacgatttgcgatacgaaaagaagaccagcgacgccaacgattttggggtgttgcgacgcgctgcgaaatcgtcgtccgtgactgttgcgatcaggcggaagcctcgacgtgccatggggaaaacgcgcgtttcgagcacatgcgcggcgaacgccattttctccccgattttcgcttcatgcagtgagcgcgcaggaaccggatcggttacgcggaacggataataggtcagggcgtcgccaactgacaccacaccaagcgatttcagcgcgccgactctgcggcggttgctctcgattgatgaaatcggtgtttccagtgtggtgctcataacgcaccattctccccagttatgccgacagatgcggcttctaccactgggtacgactcaaaccgcccaaattccccactcgctggaggaatacggacgcaaacgccactgtaagcgggaagatttctccatcgagtggagaaatccgaacgcttaaagccctggcgggatcaagataaagcaaaaccccggtgaccattggtctaccggggtttcaagctgttatttcgcgattcacgcttcaacgcgctgaaccttgccagccttgatgcacttgacgcaaacgcgaacgcgaacgttctcgccgtcgatggtggtgcgaaccggctgcaggttcgggcggaaggtgcgcttattgcgaatatgtgagtgcgaaacggtgaaaccggtctgcggtcccttgccgcacactgcgcaacgagctgccataatggactccctataattactattgacttgcaagtctgcgcgttcgatgccccgcaactgaatgcaaggcagaacacacaacttctcaactatacaaccagccccagccaatcgcaaatttgtggatagcaatcgccttaaattccccggaatgccgctgtctggtcaacatgcgtcaggtcggcagacagcacatccaaaccaccatttgccccgcgcatagacgccgccagccagtcatagcccgagccgccagccagtcaaaccgcccagcacaccccacccggcgtcgtcgcgctagttcttcgaacgcccttcggctccaaaacgcaggctcatcgcaaccgcgccgatcacatcaccgccatcgcgcattccaagcatccaagccgcatcctgagccagtagcgggaaaccagcatccgtcaggcaaatcgcggcgcgggcaatcgtatctaacaccttgtcttccggcgcaaccggcacgccgccggatcgcagcgcatcgcacgcatccccatatttcatatccggcgaaggcaatcccatctgcctactcacttcttcggcctcatcgcgcgcggccgtacggaatggcgtgccgccgttgaccatcatcgcatagcaggcgagcgcttccggcagacgtcccaactgccacaatgcgtagccaagtcgatagtagagtacttcgcaatcgataggcagcactgcgattttcaacgcgccgatgagcacgtcggccgctttgccgtattcgtcggttcttgcgtatacctgcgatagttcctcgtagaaacgtacgctggttggggcaagtttgatgcaggcgcgcagctcacgttccgcgcgctcatagtcgccattgtttttggcgagttccccaagattctggtgtacgtcgactacagcatccggcagtttccagtagcgcgtgtgttcgtcgccgtctagcagggagatgatgagtcgcacgcctggacggctgcagtagagcggaatttcgccattttcgccaattttcgctacgcctgtctcgtcagttccgcccgcttcgcacaccccacctgcttcaccgctttcgccaagttgcaccaacgcggcttccaattggagttcggcgaccatgggggatccttcgttttcttccatgatcgcgttcacatcatcggtggaaaccggcgattcgtcatgcatcacgtcaagttcgcaggcacggtcggcacgtaggaatccccgcaatccttcaggcagcgcacgttgatcctgccattcggaaacacgtttctccaagaatacggctgacgttgccagcggtgtgattggcgtcagggcacggttcccatcaaagaaacccacataacgcaccgggcgcagcaaattgagcagcgccagcggatctacatccaacggaaccacgtcgcattgtccgtttttcatggcaggcagcgcacccatcatgaatggcacgcgatcgaatcccatggaaatcacgggaatgccgtcagcatcccccacgcaaccggtcagatcgacttgcgtcagtcgtacgcttgacgagaacgccgcccacgcaagcatgcccgccaatcgcacggcatacgcagaggcgaatccgtcgcgatattgcgacgcaaccggcatgatcgccgtgttcggtatgctgaaacgcactaccatcacgccgctggacgcatcgacgtcaaatcggtaatgcaagcggaaaggcaattcgagattttcgcaaacattggcgaatctggtgctgatatcccaatttccgccgcgcgccccttccgtacccctcattctacggaagttgttttcaccttcctgcagaccgtcgattgccacgatcgcacccgacacgtttcgcagatactgttgcgatttcgcaatatagaagttttcgtcgatgcacgcttccggcatacctccgtgcaccgccctgcgcgcttcgtcgtcggcatagtcgatgcggttaagcgccgattcgaccgcctgcacaacattgaattgttcattggaaagatcgttgccgttgcagcgcagccagaatcgtttcgtcgtgctcagtcggatcacatcaaaatcgttttcggcagcaatgtctcggatgcccgcagcaccggcttccaccaaaagtcgtgccgcgaatcgttcgaatggcgacgcttgcgcggagttcgtgacgccacgccagatgatcatgtcaagcgtgtcaggcaatggctggctcaatatcgagcacaatatttcagcgttcgcaccaagcatgtccggaacttccccactcatacagactcctcgactcttcgcagaaatatgccgacgcaacagcgcggcggcagtcacacacagcaaacttagttcgtgttttcccagtattttgacacgttccaatataccgttctgcgaacgtttttcacgacatcaacatacgacatcaacatacagatgatgcaatctacaatctgcacatgttcatctccgtcatttcagtattcccagtattatttgcagcatttcgatatttcagattttttatgtcgatcacacatcagtcgcaatgttcatgcaatgttcatgcgtaacggcagagcgctccccttacagccgcttaagatgaactgtagtatatacaatagtgaattgacggtttattcgaaagagtcaacaatcatgtccgaacgcgcaacagcgcccgcatccgcacctacgtccgacatggccacagagactgccccagagcatatgccggaccccaacgcaaaacttaccacccgcgaaaagaagtggatcgtctacgatgtcggcaattccgcattcgtgatgctgtcgaccgcagtcgtgccaatctacgcaaactcgctgctgcagtccgccggccaatcgaatatcgtgtcgacatgggggtacgcgcagaccatcgcgtcgctgatcatcgcggtgatgatgcctgtgcttggatccatggccgacgtgcagggcatgaaggtgaagttctttaccggattcttcctgacgggcgtggtcgcctgctgtgcgatggcgttgccgctcagctggctcgttttcttggtggtgtgcattctcgccacggtcggcctgaacggttcgctcacgttctacgattccatgctggtcgatatcacgtcgaatgaacgtatggaccgcgtgtcctcgcatggtttcgcatggggctatattggctccacgattccgtttatcgcctgtatcgcgctgattttcggcggtccgtcgttgcttggatggtccacggtggcatgcacgcgcgcttcgttcgtaatcaccgcattgtggtgggtggcgttcaccattccgctgctcaccagctataagcaggtgcactaccgcgctaccgcgggtcagaccggtgaggccatccgcggcacattcgcagagctcggctccacttttcgtgcaatccgcaagaacaagccgttgtggatgttcatgattgcgttcttcttctatatagacgcggtgaacacggtgatttccatgagcacctcatacggcacgcagctgggcatcgactctacgcatctggtaatggcgctgctggtcacgcagttcgtggcattcccgagcgcaatcgcgtacggcaagcttgccggtcgtttcggcgcgaaaaccatgatcaccacggctgtggtcgcctatatctgcattgtgttgtttgccgcgttcttcttgcgttccgcaacggaattctggattcttgcgattctcgtaggcctgttccaaggcggtattcaggcgttgtcgcgctcgtattatggcaagatcattccaaagaatcgtgccaacgaatattacggtttctatgatattttcggcaagaccgcttcgattatcggcactttcctcgttgcgaccaccacgtcgctgaccggcaacgcttcggtgggcgtgctttcgatcgcaatcctgctgatcgtcgccctcatcttccttctcctgcaaaaagaccccacccgcaagtagcgtaaagtaacacttgcttgcaactgcgcatgcaaatccaatcaccaagactgattgattctgcatgcgaattttgctgcaatagtgaagctttctcttggcaacaaggaaggctccaagccgccgggggtattccccggcatcttcatattcaccgaaagaaacgttggcagagctgccttcatgccgtatttccgatgtcgccttacgtctgaaaagtcgcgcatggcaagagtcggccgcatagtaatcgcaattgcgatttttcactgaagaaagcaagtttggcgcgaaaatcagaagaaattgagggcacgtgccacttcgtcgacgatgtcgagcatggcgctgcgcgcacgttcaggctcccccttggcgatcgcgtcggctacggcatcatgcgcgtcaagcgcgtcggacttcggcttcatcgggtatttgccgagttccacacgcccgcgcagcacggtggcgatggtgtcggaaagcgcggcgaacagctcattgccgctttcatgcagaatcagcgtatggaattccacgtcaagatcatggaattgcgcaagcccggcttcgccttcctcgttggcttcggcgatctgccgcattcgcgccgcatacacggggaatttcgccttgacgtcgaggggggcaagacgtgcggcggaagctgctgcagccggttcgaccgccagtcgcagctcagtgagagatgacagctgccgttcgcgttgcgtggagtggagacgccattcgatcacctgatggttaagcgcctgccattcgccgaatggacgtgcaacaagtccgatgcgacgtttgacgagtaccgcattcatggattccagtgttttcgcgacttctcgcgccacggttctggaaataccgaaacgactttgcaaggcttccaacgtaaggctttcgccagccttccacacgccgtcgagcatttcgatggcgagcgttcgactcaccgaatcctgcatcagctcaccgacggtattttctgcgattaccgtgccttcagccatcgatcgctcctcccttgtccacttcacaccatgcctgctttgtttcacggtatgtttcacgtattctgcgacacgcacggcaatcaccaatcgcagatgattgcgtatctgcgattgcgtgatttaccgccattttgcactatcttcagcatagcaagtcacacgatttttccaattcgtagtactttttatttgactgatactacttttacggtttatagtagtcttattcctggtgcggagcggcacaggatcgtcaatagcaaggagagcaacatgagcattcacgtagtggtgatgggcgttgcaggatgcggcaaatccaccgtcgcagaagccatccatgaacgactcggatacgtgtacgcggaaggcgacgacttccacccgcaggcaaatatcgacaaaatgtcagccggcattccactcaccgatgaggaccgctggccatggctgaacgtcatcaactcctggatggtggcacgcgaggcgctcggcgaaaacaccgtggtgtccagctccgcgttgaagcgcagctaccgcgaggtgctcgccaaaaacgtgcccacattcttcattcacctcaacggcagccacaagctcattcagcagaggctcagcgaacgcaagggccatttcatgccgcccgcgctactaccaagccagttcgccattcttgagccgcttgcccccgaagagaacggcgtggaaatctccatcgaaggcagcgtcgacgaaatggtcgaccgtgccatcaaagcgttgaacgcctatgcgacaaccgtagccgcgacggtggccgcccaaaccgcaacccaggccgcctaacccaccatcccccagtccgcatgtgtccgattctgcagaaacggacaaacaggacccaaaaacatcagcccaactgtccgattcaccggaaacggacatccaaacaccaaaaaccagcctatgaacgtccgattctgcagaaacggacactccacacagcttaagaacgcctatctcgcttatatatggcagacgtcctcagcaaaacagcacttcgggggtacgtttttggctgttttagccaaccgacctgccatatataagcgagatagctccggacaggggtgtgtttctgccatatataaggcagatacacacccctttggcttatttgcgtccgaattcctccagcgagcgcacacagggctcagcggccgtagacttcgtgcacgaacttttcgaatgcggcgatggaacgctccaccttttccgtatcgatgcagtacgccatacggaagtagccgggcacgccgaaactgtcggatggcacgagaatcaggtcgtaatccttggccttcatgcagaacgcattcgcatcatcctcaagcgccttcgggaagatgtagaacgtgcctcccgggcgcaccacgtcgaatccgaggcgcaccagcgcgtcatacaagaggttcatgttcttctcgtacacggaaagatcgctggtttcgtccaccaccttggccacggccagctgcacgctggatcctgggcagttgtggccggttccgcggctgatctgcccgcacatcggcacgatcagttcggcatcggtagcgcgcgggttcaccgccacgtagccgatgcgctcgcccggcagcgacagcgacttggagtacgagtagcacgagagcgtgttgtcgtagaacttgctcgggtacggctgcacacccccatcgaacacgatttcacggtatggttcgtcggaaatcaggaagatgtcgtgcccgtattcgacctgcttggcgcgcaggatttcagccagtcgggtcagcgtttcggcggaatagacggctccggaaggattgttcggcgtgttgatgagcaccgccgcggttcccgggttcagcgcctgttcgaacgcttcgaagttgatttggaagttttcggtgtcggccggcaccacggtcaggtgcgcgccggttccgttgacatacggctggtactcagggaagtagggggcaaaggtgatgacttcgtctccaggcttggtcaccacgcgcagtgcgtgggccagcgcaccggccgcacccgtggtcgggaagatgtagtcggtcgtatagtccatgtcgaagcggcggttgaggctttccgcaatggccgtgcgcaccgaggtaatgcccagcgacggcgagtatccgtgcaacgcgaccggttccgcctcttggtacagggcgatcatttcgtcggtgaagctttgcgggcagggcacgctcggattgcccaacgaatagtcgaacacgttctcgtagccgatttcggcaccgcgcgcggtcgcgtattcgctcagctcgcggatcacggattttccgccgagcatggccttgtaagcttcgttgatcatggacaacctccccgtcgttcgttcatttcgcacgctcgcgtttttccacggaacaatccgcggaaaaacgccgctatatcgtttctaccactggattgtcacagccggctttcgacggtcacttggtagacggcggctgctgttgcgaaatcgccatgccgggtacgaatccttcgctgaagatcctgcgccagtattcaagcatgtccgctttcgacattgacatgaacatgcccgccgcgagtacggcgacatcctcgttgaatacggtgtcgagcggcagtttttcatgcagtttcggccagcgctgcagtacggccagcatgcctccgacggtgaaatcgagcatgagatcggttttcagatcgaggttgtcggcatccagtccaagtacggaaatcatggtgagtcgcccgaattccttgagtgacgaaacgagttccggcgagctgtgcggacctgccagcaaggccaatcggtcgagacgctgacgctgttcgggatcgcgcagcaacgcggtgacgtgcttgcgccattcggtgtcaggattgaaatcccgccctggcacgcccggcattggcgtgtcttcgacggcgtgcagaatggcggagtcggccaattccggcagtccggagaaatgatagtagaaggaattgcgattcacgtcggccgtgcgcacgatgtcggtgacggtgattttgttgtactcgcgttccgaaagcagctcccagaaggcgttttcgagacgatcttttgctggcaggatttccgaatccctacgtggtcgtggcatcagtaccccctaataattagtcatgttgcctcataaccacgttttattgtacaagttgtctagaccgaatttcggcaaatgtcgtatacgaattcacgcttacaacacaagtacgctacgcgaacagtgcccgcccacgttcgcacagtactcacgcctcattcgcgcttcactttcgctgaactttcggattgcgagcgagcgccgcctgcaacagaatcaccaacgcctgattgatgttgcgccgatccgcactgctcaagccaacatatgtgccgagcatttcaggaatcactttcggaccggccgccacgatcgcagaaatactgcccgccccggaagcctcaagcacggagaacagcgcgtcgaccgcatgctcacgctgttctttggaaagtcccgcaagccagccgttcagcgacttgttgaacaccaccgaactgtcggccacatcttcggccttggcgaattcacccccgtgcatctgccacgagaaggcgaaatgctgcatgatgccgtccacgtcggatttcaccaccacgcaacgttcgggggtttcaaacaccatgcccaccaccgaggagtccggcacgattttcacaatgcggtcgctcacgctcgcatattcgaaacttttcaccacttcttcggggaagcccggcccgtcgagcgagtaaatgcgttcaacgcggtccttgatctcgtcttcggcgttcatggccgcatatacggccagattaccacctttggagtgaccggtcagcagtatcggtccatcccacagcgaggcgacttttttcaggtattcagctgcggaaacctgtgctggaaccgggtattggaaggccatgttgaagtcttccttccatccgaccagcgaatcatcagtaccccgaaacgccacaaccagcgttcccgacggcagccggaaagtcactgccgcgaactgcgtttgcgcaccaccatcgaactgctcgcaatacgcgctcatctcaacgtcggaaaaccgcggattcgccgccacagcatggtagaagtcgtgcgtcacctgcggatcgaccaatcccacgttctccacatcatggtcggccacgggcttgtcgtggttcagctcgtcatcggcacgcgcaatcgtcacgccgccaaacgggggcttgcgcagcatacgcaacgatgcgatcggacgccgaatatcgaattgcttcgcacgcgcctgcaacgtaccgtatttcgctaccaaatcgtccaatcgcagcacgcattccggtacttcgtcgtacgaaagctgcgccaacaccaatgcgtcggcctcgcggaacggcaatgcctcgaaactgcgcgtttccgtgcgcgcatagtcaataatattgcccatcacgcatccccctccttgtcgttgcgcagttccccgacagcgactttcgccgcactggctggaatcgccttgaacacgtctttgatgagttcgcgcgtttgcacgtcggtacctctggcggctgccacgattttcggcagcgaatccgtccaatgcgccaccagatcagcgatattaccgtaccccgcggctgcgaagatgtcgtatatctggttgatggcccgttcccgttgttcctggcttacgcggtcgaaccatccgtcaatggttttgccgatgagttgcgcaccgcctgtcagctcgcttgcctgctcgaattcgccggattgcgtcacttgccagcttgatcccatatgctgcagaatgcttatggcgtcggctttgacgaaggttggtttgatttgcgattgcaacagcatgccgataatggaggattccggcacggttttgtcgattcgtgccgcgattgcctgatatgcgcggctatgcaccatgacttgagacattccaggaccgtcatgcgagaagatgcgggagattctgcagttgcgtcccggcacgcttcctccgagcgccggcagcagtccgagccgttgcgcgcgttcgttggtcgcttcaatatcgctttgcgtgatttgcatggccgcatataccgccatattgccgcctttggaatgcccgccgatcataatgtcgggtgattttttcgccgagaggaaacgttccgtcctgtccagaatcgagtccgcatatcgatatgccgattcttgcgacggcactgggcagcgcaccgccatattaaaatcctctttccaaccgacgagcgtgccgtcagtgccacggaacgcaacatataagccgaaatcggcacccaaatcgaaggtcatcgcagcgaattgctgctgctcgccctcatccaaacgttcggcatactcccccacccgcaacccgcggaatcgcggcgattcgcaaaccgcacgcagcaacgaaagccgataatcattcatttcagaggaattcgaaacaaacatctcatcgtagctttcggcgcgcagcaagtcacggatcggcacggtcgccaccgacttggcctcgccgaatgctggaaccaagcccggcaatcgcatgtaggaaagctcggaaagcaccaaggaatcgacattgctgaacgccaattcgccaaacccgcggaactcgcggcgcacataatccacaacattgcccatgcctcaactttagtccgttcacggctccggacacatgtcaccacgcgcattcccacatgttctcgcgcacgcccccgcacacccacgctcaaaccgactcagccacgcactgtaggatatgtgcgaacacaagttgcgaacacgcatcgcagacgcagcgaacgcaagtcgcgcgcaccggtaatgcatgcgaatcaaacttatgaagggacgcttcagaacactatggaaccgattggaatcgttgtggattggctgaaaaccaattccggaaaaatcattctgctcattgtcgttgcactgcttgcggccgttatcgacaaggcgcttacccgaatcgtgagcaaagtgctggaccgttcgcaagtgccgaacgcttcgattttcatcaatattctgcgcgcggtggtgtggacgttggctgtgggcactgtgctgcagccggtgttcggcattaatccgaccacgattttcaccgcgctcggcattggtggtcttgcggtgtcgctcggtatgaaagatacgatcgcgaacatcatcggcggtttcggtctgatgcttggccgtgtaatccagccgggcgatctggtgaatgtggcgggcaccgatggcgtggtcgaagatatcaactggcgtcagaccgtggtgcgcgagcgcaatggcaacgtcaagatcattccgaattcgattctgaacaccgcgtcactggaaaaactcaatccgtccaatgagatgctggttcgtgtgccgtttaccgccaaggccggtaccgacatcgacgagatgacccgtcaggtggttcaggccgtgcagcgcgataccgccgatttggccgatccgcgcttccctccgaaagtaagactgaccggctactccccttacggcatcaatgtcgaagtgtgcgcgtacgccaagccggaatcgttgcttcccgacatgatcaacgccgtggcacgttccatcgccaatgctgattttcttgagaatcgcgccattaacaaagaatcgtaatatcctcgcgaacataagaaatcgcggttgacccatatatataaagtgccgcatgcagtagtccacatgcggcacttttttatactgaaattattgcatcattagattgattgacgtaataataaccgtcactacaatgtaagtaactacaccgacgttcagtattgccgtgctcgtgcgcatgccgcgaggcagttcttccggtgcggtatagaattcaaagttcttgcgattgcggataagcaacactatgcccgcgatgatcagaccgtaatatagcagcatatagatgccgaatatcatcattcccgtcgcattctggcccatccactgcatcatggccgttccgtcgccgttttccgcactggtcagcacgttcatcagactgtcgatgtcaatgttcgtcaccacccacggcgcaaccacgccacccatgaagttgacgatcatgtgcatggccaccgaataacgcagtttgctggtgcgcacgtacacgtagccgaacataagacccaatgcgaatgcgtagaagaactggaacaggttcatgtgcaccaggccaaagaacagtgcggagaacacgatcgcggttttttcgccgtatttgcgcgtgcggctgatgagttccttgcggaagatccattcttcgaacaacggtccgagaatcacgaggaacaccacgttccacacgtcgaattgcatggccagatcgctcaccgaattgctggctttgcctccggacagcagcgacgccaacatattgccgatgagactgcccacatacatgagcgggaagcacatgaccagcagtttgaagaattggcccggcttcatgtcgaacttgcgtgtttcaatgaccgacgatttgcccataatcagtaccgcgagcggcatggccacgagatacaaaggggtatccgatgccacatacaccgcccaattcggcagattcgtggtgtgcagtacctgatagagcatgccggaaagcaccgttgcaagcgcataccagatcaccaccatcaggcacatgcctgcgccgatgcgggagaacacgcttttcacgcgcctgagccacagttcgtagggattggcttgtggctgcggatactgcggttgttgctgatattgggatggctgttgtggattctgctgcgtatgcggttgttgcggccgctgcggatattgggggtactgcggaaacgtcatatttgcctttgcgacgacgtgcacggggtgcatatacgaaaatgctgatattcagcaccttagtacaggaatgctgaatatcagcttacaatctcatgaccgtcgtcatgggcgtccgcaacgaaacagctcatacggcgagcgcggcgatcggacgcggagccaccaccacttcggatccaaccgtcaggccggcaggaagctcattggccggcagctgcacggtgacgggcaggtggcccacacctgcggcaaccgtcaagtcaacgcgggcgagcgcaccgaggaagtgcaccatgtcgacgcgaccatgctcgcctaccatgttgccatcgtttgcggctagagtgatcacaaggttttccggtcgcacgagcacggtggaggcgtcgcgcttggaggcttcgagcaacggcacgcgctggccaaacaccacggcttcctcaccattcgtgatgcctgggagtcggttggtcaggccaatgaaggtggccacgtattcgctgcccggacggcggtacagtgtctgcgggtcggcgatctgttcgatacatccgtggttcatcacgccgatgcggtcggcaacggtgagcgcttcttcctgatcgtgggtcacgaacacggtggtggtgccggcttcgagctggatgcggcggatttcgtcgcgcagctgcacacgaactttggcgtcaagtgcggaaagcggctcgtcgagcaggagcactcgggggttcacggccagtgcgcgggcgagcgccacacgctgctgctgaccgccagacatctgctgcgtgtatttgccagcctgatcggcaagacctacgagttccagcttctccatggcctgcttacggcgttccgtcttgcccatgccgcggatttccaacccgaattccacgttctgcagagcggtcatgtgtgggaacagcgagtacgcctggaacaccatggccatgtttcgcttgttgacgggcacgccagtcacatcttggccgccgacgagaatacggccggcctggatgtcttccaagcctgcgagggaacgcagcgcggtggatttgccgcagccggagccgccgagcagcacgaccatttcaccaggattgatttctaggttgaagttgtcgagcgccttgttggtggctcctgggtagattttgtctacattaagcatttgcacgccgccgccgcgttccgcggagtcgttgaggacttcgcgtgcggctcgggttacggtttcggcgctcggattggcgtttacgaacgcttccgaagtgcgtgcgatggttgctttctgatcagcgagagtcatgattcgttgctttctttggatttacgcagtgcgtcggaaataagatcgagggctaccagcaggatcacgccgaacagtagtgccagcagcgacatggcggtggagatttgggagttggattggccaagctggtagagcgccacctgcaggttcatgcgtccaagcagcgatgcgacggtgtattcgcccagcaccacggcgatggagatgaacgatgcagagaggatcgactgccacaggttggggatgagcacacggaagaacactcgcggccaggaggctccgagcgagcgggatgcttcgcacagcgttttcacgtcaatggagttgaggcccacagcgagcgcgcggaatgcaaatggcatcaccagaataacgtacgcgaagcacagccagatcgggttggtgctgagcacgtcggcgctgagccaacggtaaatcggccccaggccgactacgagcacgatggcggggatggtcagcggcagggtggccacccattcgatggcgcgttccagctgcttggagcgaatgtgcacgatcaccatggtgggtaccatgagcagcagcatgatgaccacagtcaccacacacaatcccatggacgatccaagaccgctccacaatgtggacaagtcagcaccaagcgcgctgccatcgccggtgaaaatcgcaatccacggatccaaactccacttgccggaaagcgggtgtcgaatggtgaacacaaacatagacaccagtggcacgaacaggaacagcagcgtgaacgtgagaataatcgccttgatcacgcgctgcttgcgcacgcgggcggcacgcagctgcgggggcattgcttcagtatgattcactgccattgtccggccttcttttccacagcgtggctcagcatcatcaccagagcaaccacgatgatcatcgcgaaggcgagcacttgcgcgaatccctgctgattcggatccatttcgttgcgcatggcgccctgaatcataagcggcaccagaatcgaacgctgtgagaacaatgcggcggccgtcgcatatgcggagaacgcgctggcgaacagcaacagcaatgcggaaaggaaacgcggaaccagtatcggccccgcaacgcgcgtccaatactggaatgtgttaccgccgagcgattcgcaagcctcacgccactgcggacgaatcgaatcgaccgcaggcaggaagatgataatcatcaacggaatctggaagtagcagtagaccgtgattaggccaggcagggagctcaaccagttcggattgacggtcagtccggtcagctgacggatcagcatggtgccgacgccgttgataccgatggtggcgatgaaggcgaaagcgagcatcacgccgccgaactgtgcgagcaccgacgaaatggcactgaccatgcggcgcagcagtccgttcggtttgctgccaatcaccagcgcatacgaggcaaccgcacccacgaccgcgccaatgagtgcggagatcacggaaacgagaatggaggtggcgaacgcggcgatggtgttcgcttcgaagagtttgctgaagttgttgagggtaaatccgccgtcgacgttccggaatgcgccgacaatcacgataacggtaggcgcaagcaggaagcaggcggtgtaggcgaagaacgggatggtcacgacgaatgtaccgatttcgcggcgatgcgtggcgaaatcggaggttgcggaggggccgtttcctcgagttccgcgggcttcgcgtgcgttacgcccgccgatgactcccgctttgggggtgattgctgcagtcatggttgcatgcgtgctttcatacgattgatatgcggtgagattgcataggattgtgggattccgctattgcgggagacatgcttcaaggccggttgttgcggcagaagacgtcggggaacttgcttcagcccgtcgtgtccgccggtctaccggccttagattgcattattttcgattgcgatccagctcgtttgcgttgcttgcgagcggttgccaatcagttgccgatggtcttgtcccagttgttctggagccattcggtgatgcgagtggaatcatcgtttgtataggtcaccggatcgccctcgatggtgatggcggtcttcagggtgtcctggtcaaccgtgccgtcctccttcatggagtcgaggagcaccggattggcgccgcccttgaaccattcgttctgagcatcggcggtgtacaagtattcctcccacaggcgtgctgcggccgggtgcggagcgtccacgttgatggcctggttgtagtagctgaccacctgggcgttcttgaaggtcttgaacttccagttcacgcccttctccttgaggctcttctgataggaggcctggttgtagctccagtccatcaccacgccggtctggccggaatcgatggttccgtcggtcacgtcaacggtggtgaggttgccagcatccttgagcttcttgaagtagtcgaggcccggctgcaagtcgttgatgtcaccacctgcgagctggttgatcatgaggtaaccgttgaatgcggcgccggcttcggcaggcttgccgttcagcgccacggtgccggcgaacttcggatccatcagatcgtcaaggctgttgatgtcgccgtacttgtcggcgttccaaccgatcgacatgatgccggtgtagtcggcgtaatacttgccgtcagcattcttcacggaatccggaatcttatcccaggcctgcaccttgtaggaggcgaagttgtcggtgctggtggaagccacggccaagccgaggtcgaacacgtcgggggcagcgtcggtgcccttgttagtcttggctgcgtccacttcttccttggaggaggcgttcgggttcagctcgttgatcttaatgttcggatacttcttcttgaagccgttgatgacctcaccatagttggaccagttgtgaggaagtgcgatgacgttaagctggccttccttttcggcggcggcaaccaaatcgtccatcgtaccgaaatcagccaaggaagtggcctttgcggacttttcatcaatcttcacggccttgccggaagtggaatcagcggaggaatccgtgctgcccgatccgcaggcggccatggagaaagccagaacggcagcaagagagccggcagccagtttgcgcagagaaatcatggaaatcaatatctttcttatgccttgttcataacaacaagaaagaagataagccctcaaatcaacgcgatactgaccttacagtaaatatgcagtttattttgaatcgaaaaaactaaattttcccaaactgcaggtaaattggcggaatatgtcaactggcaccaacgcagtgtcagcattgatgccagtctcatgcaaatcgaatcagactaaagcgagcaaccacacaatcgaaatcagcgcagcacgccctcgatcagcatggtgatcaggttggtgtagctcacgccggttgcctcccatgccttgggatacatggaaatcggggtgaagcccggcatggtgttgatttcgttgaccatcacttcgccgtcggccgtcacgaaggtgtcgacacgactcaggccggcgccgtcgactgcgatgaacgcttttttggcggtttcgcgcacgcggttcagagtttcttccggcaggcttgcgggcacttccacatggcttgcgtcggagttcacgtacttgctgtcgaaatcatagaactggtcgtcgccctcggcacgcttgtcaagcacgatttcgcccggccagctggcctgcggagcctcgccggccttcgggcagagcacggcgcattcgatttcgcgcgcgtcgatgccctgttccacgagcacacgccaatcatggtgggacgcttcgaacactgcggcggcaagctcggccgcatcgccctcatgttcgaccttgctcacgccgaagctggaaccggcgcgggacggcttcacgaacagcgggtactgcaatccggcctgctgcaccgcggcaagcatttcgtccgcctcggtggcaaattcggaagcggcatcataatcgcgcacatccaacgtgatgcctggagccacgggaataccggccgcagccagcaataccttcgtataatgcttgtccatgcaagcggcggaagcgagcacaccgcagccaacgtatggcacgttcatcatttcgaacaggccctgaatcgtgccatcctcaccgtacggaccatgcaataccggaagcacggcgtccacgtggccaagcgaagtcagcgtgccgtcatcttcacgagcgaagaaaccatcctggccgagtgccacatccagcaccacatctttggaggaatccgtcttctccaccatcggcaggccttcgctcatgttccacttgcgtggatcctcgccgcctacgatccactcgccgttcttggtgattcccacctcaatggcttcgaacttgtcagtatccaacgcgcgcagcacgcccgccgcagagatgcaggaaatcgaatgctcgtcggctttgccgccatacatcaccacaatgcgctgttttgccatctttgtcttatgctccataagttggtccgttgaacgcacgcgcgcccaataccgtctgccaatactgtctgtactgtctgtcttcgcaatatcgcgccggttcgcacttctgttcgcccgcgataccacgcattcgcaatatcgcagttcagtatacaaaccgcaccccacagcccacacacgacgaatcataattacacacgcccgtcactcatgtcctattttcatgaatcatagaatacggaatcaaacgttggaatgatgcgattgcaacctgaaaaaccgagcttaatcgctttgtctaatcacgattagactaatcacgattagactatttttatacagatttactattattgccgaaatatatggcgattgacgattgacacattccgattgacgttttacgcaatcgcatgcctcgaaaaataaaaagaccgcacctgaaagtgcggtcttatctgcaatcgcgatgttgcggaaagcttattcttcgctgatgccttcgccgaaaagttcggacagcatctgcgcgcaggagatgccatcggaaagcacgtggctcatggccgtggcgagcggtgtaggcacgccatactgcttgccgagcgccaccaccgcatcggtggtcggcacgccttcggccacgccgttgctcaccttggtggcttcctcaacgctcaatcccttgcccaagttggatccgaacgtgtagttgcggctcaacggggatccgcaggtggcgatcaggtcgcccacgccagccaaaccggcgaacgtcttcggatcggcgcctgccgcctcgcccagggcggtcagttcggccaggccacgggtttcgatcatggcggcggtattttcgccgtagccggcgccgcgggccatgcccacggccagcgcgaccacattcttcagcgatccacacatttccaagccgatcacgtcgcgggttacgaacgcacggaaatagtcggtggtgcaagcggctgcgatcttgcgcgcattgtcgagattttcgcaggcgaccacggttgcggccggctcgcggtcggcgatctgcttgctcaggttcggtccggaaatcgcggcgaagcggtcggccggcaggtcgagcgtttccataacgacttcatccatgcgcttgccggtggtgcgttcgatgcctttcatcagcgaggcgacgagcgcggtttcgggaatcaggtccttgaattcgacgagcgcgacgcgggcgaactgtgcggcgatggccacgatcacaatgtcggcgttggctacggcttcggcacggtcgccggtggcggtcatgttgcttggcagcactttcacgctgggcaggcgaacaccgttgtgatggtggtcgcgaatgccttccacaatctccggttcgatggcccacatagtcacattgttgcctgcatcggcaagcacctgaccgaaagcggttccccaagctcctgcgcccagtaccgtcacgttcgtcatatttgctccttgcattactccgggcatcattcataacccggagtcttggctcaaaaattgcttttcctatgctaccgccggctacgcacaccgcgatatatgccgcaatacgcgccatacgtatgcgcaatcggctggcagtatttcgattaccgcatttcagcaatcgcgtgtgcggtctttttcgattcggccttcttcgattcagtccttcactcggctcatcgtacgataatcccaatatccatcgggggcttgttcgctgcggatttcggccatgacttcggtcatacgcacgcggatgcgtcgggtaagttcgttggcgagatcctccggcacttcctcaccccaggaatcgcaatcggcgagcagatccgcataatcaagcgcctcgtcgtagcacatgaccacgtttttacgcggccacggccaccaatggttgatgcttgccgcgccccacgttaccgcgcaatacagcggaatctggtagccgagtcggcgcgaagcctcaagcgcgatcatgcccacgccgtttttcatgctcatcggccatttctgcggatcgcgcgttaccgtgccttccggccatacggttaggggtcggccggaggtaaggatttccacggaggtttcctcgatggctttcgccttgcccgaacggcgttgcacgggctgcatgcctaccagttggaaccatttgccgatcagcggccacgaggccatttcggctttggccatgtagcgcggacggcggccttgatggaacatggagatcatgggcacgaacacgtcaaacatggtgacgtgcgtggccgcggtgatgaacggaccggtttccggcacgtgttcgatgccccacgccttgagtttggtgcggttgcggaatacgatgtcgcatccggtgagcagacgatgggtcgctttcggattctgcgccgcgatttcggcttcattggctttgcgcggcccgcatggaaagtcgtgggttgggtcaacgagatggtgacgctgtgcgagctttgcgacttgttcgtcgcttaacggtttgaccgcggaacgcggcgagggttttcctttggatgccatgcgttccattctgccaccacccattccgcttggttggaacgattgcgctcatgcacgacgcacacacgaaatacaaaaacacggaatatacgaaaaaggcggaactggtggataggctggaggacgattgacgacgaagatgttgcgactatccctagaatccgtctggacatgcagtaaacacaataacgatgagggaaacccttatatcttcggctgttcacctcgttgcaaacgccattcgatatcgacaatcataatgccattccgaaagaatctctgccgaaaatcgacattattttcaaaaacaataaaactttttgcatcactattatgcgccataaccccctaaattaagttcaataatttatacactgaattactaagtttttgagaacgagcaacggcaatatgtaagcaaaaagccggtgcccactgttgtgaacaccggccttaccaagccaatcaagctatatcagcgataaatcaagcaacaaatcagtcgaaatctgcgccgagagcttcgagcttgccacggaaatcggcataaccgcggtcaatcagcgaaatgccctgcacattggacgggccctttgccgccaacgcggcaatcagatggctgaagccgccacgcagatccggcacgtcaatatcgcggccggtcagcggggtcggtccgaaaataaccgcggaatgcttgtaattgcgctgctggaaacggcatggcagcgatccgaggcattcgcgatacagctgaatcgtggcacccatctgcaccagtggcttcgtgaaaccgaaacgattctcatacaccgtttcatgcacgatcgacaggcccttcgcctgcgtcaacgccaccaccagcggctgctgccagtcggtcatgaagcccggatgcacgtcggtttcgatcgcgaccggcttcaaatcgccgcccggatgccagaaacgaatgccgttatcggtaatgtcgaactcaccaccaatcttgcggaacacgttcaggaacgtcatcatttcaggctgcgtagcacccttgacgaaaatgtcgccatgcgtggccaatgccgcggaagcccaggaagcggcctcgatgcggtcggtcagcgaaatgtgcgtgtaacccttcagttccttcacgccttcgatgcggaacgtacgatccacatccacggaaatgatcgcgcccatcttctgcagcacgcacaccaaatccatgatttcaggttcggtggcagcgccggaaagctccgtcttgccctcagcaagcacggcggcaagcaacgtctgctcggtagcgcccaccgacgggtacggcaggtgaatcttcgcgccatgcaaaccgttcggagcggtgatatgaatgccgtccttatgttccttatcgacgttggcacccaacttgcgcaacgtttccaggtggaaatcaatcggacgaccgccaatattgcatccgccgagagccggaatgaacgcctcacccaaacggtgcagcagcgggccggagaacagaatcggaatacgcgacgaaccagacagcgtatccacgtcggccacatcggcaagctgcacattcgtggcgtcgatcgtgaccacgccgtgatcgccatccaccgtaacgtccacgccatgcagacgcagcaagtcggagaccacatgcacgtcgcgaatctccggaacattcttcaacacggacgtacccggggcgagcagcgccgccaccatggccttgctcacgaagttcttcgcgccacgcaccttgatggtgccgttcagcggcttgccaccttcgacgtgcagaatgtcgttgttgttgtcagacacgctcaacctctttcgcttcccttatacggttcaagcttgaaacacactaaccctcagtttgccataaggcatgtagtgggctcgtgaaatgccgcgttcagcgcagtgtctcccaatttcgttcgactttcgaccaaaatacccagccactggaacaatccacccgccaaaccgcatcccagcgggcaaaaacttccagtcggtggaagaatcctcccgatacaagcccctccaccgtccaaaaacctccagtcactggaagaatcatcccaccaaactgcatctcagcgggcaaaaccctccagtcactggaagaatcaggacggacagctacccccgtgctgcactaatccttccagcgaatgggaaaaaaggacggtgaaacgcaacagagcgcaaatcaggcgcaattgaacctgtgactacagtgcggctttaatgtcttgcgccaaacgggcgttccacatggcacccgtagcgctcatcaccgcgtttgcaccagcctcgcggtacgccttgtaatcttccggacgaatcacaccgcccacgccaacgatcgcaaaatcaagacccagcttctcgcgaatcgcattcaggcggccaaccatatcgagacctgcaccacgaatcgcattgccacatacgcccgaacggtcacgccccgcgcctggcaatgcctgattgccgttcgcatccaccagcttcgcggagattgtgttaatggtggagaaaccctgcaccgcgccatggccggcggtttccttcaccataatttccagatcggcatcattcggaatgtatgcgagcttcacgatcagcggacgatcgccgatttcgttcttcaccgcttccgtaatctcgccgaccaaatgcggatcgtggcacaacagacgattatgtccctcattcgggcagctggtgttcatttccatcaggccagcgccagtttcggcaaccaaatgcgcggtggtgacatgatcggcaatatacgcttcacgatccatgccctccacgcgggagccttggaagctcggcaccagcagctggccgtcaccggctgcggcgattgccttctgcatgtccggctgccattcgtcgggatcacgggagggaacgccgaaactgttggaaatcgaaatcggaagctcataacgggtatcggcaagcacaccctcgtcaagttcggcactgcccggaaccagcgaaccatcggcattccgcggatgcacggccagcacgttcgggaacgcattgcagccccatgcgcgggaacgaaccgtcttgtataccgccagatcgaagcccatacggaaagcggccgtggtgaaacgctcattcagcagcggaccagctggaataccgaacggcagattcacacgaaaaccaaggaattcctgcgcttgagcggcctgaatggtctgaacgccctgaacctcactggaggaatcggacgcaacctcagcaacaacagacgtgaccgatcccgcagaatcggacgcatcagcccgcaacacttcggcaaacgcgccgaacggcccttgcaaatagttgtcttcatacgtgcgattgacatcataaaacggcgcaaaaccctggctcatttttctctccgaaagctacgaaagcacgaaacaataagcccaccatagcgcgtctcatatgcaaaacccgcgcaaatctcacataatcagcaatcccaacgtcccaatccttccagtcactggaggaatccggacaatatgagtcccctaatcgtcccaaaacctccacccagtggaggaatcaccccgctacggaccgtctcaaagtccaaaaacatccacctactggaagaatcctcccgctcacgcatcacataacatcccaatccttccagtcactggaagaatcctcccgcgaacaatcatcccgacgtcccaattcttccacccactggaaaaatcctcccgcaaacagcccgcgcaacaacgcaagcggggtgttccttccacccactggaggaatcaccccgcaaacagcccgcgcacctagccagccgccaactcagatgatgccgcgatcggcaagcgggccctgccaatccgggtattcgccttcgcgcgcggacgcgatcaactgctccggctcacgcttcgccggcagcgtcttcggcttgaacgggaacttttcggcacgcatcttctcgtatgtcacaatatcgtcttcatactgcaacgtcagatcgatatcgtcatagccgttcatcaggcgccaacgggtatagtcgttcacttcgaacggcagcgtcacgtcgccgcacgtcaccgtgcgatcctccaggctcaccgtcatatcacggcccggctcctcgtcaagcagcttccacagcaactcaacggattcctgcggcataatcgcagccagcacgccgttcttcgcggtgttgccgtagaaaatgtcggcgaaacgagacgaaatcaccacgcggaagccgtaatcatgcaatgcccacacggcatgttcacgagaagatccgataccgaaatccggtccggcaacgagaatcttgccccgcttgtattccggctggttgagcacgaattccggatcgcgacgccacgcatagaacagcgcgtcgtcgaaaccggacttctgcacgcgcttcaagaacacggctggaataatctggtcagtatcgacattggaacggcgaagcggcacggccacgccggtaagagtagtcagtttttccatttcactatttctttcgatgtaacgattcacagaatgccggaaatccaagatttctcaggttttcaagcattctcaacgattcacagatcagccggagacgagatggtaccgcggatggccgttgcggcggcgaccgccggcgacgccagatgcgtacgcgaccccttgccctgtcgaccttcgaaattgcggttcgaagtggagatggaacgttcgcgggccaccatcttgtcggggttcatgcccaggcacatggagcagcctgcgttacgccattcggcaccgaagtccttgaagatcttgtcaagtccttccttttccgcctgcaaacgcacgcgagaggaggccggcaccacgagcacgcggtgaatgttttcggccttgtgatgccccttcataatggaagcggccacacgcagatcctcgagacgtccgttggtgcaggaaccgatgaacacggtatccacggcaatgtctttgatgcgcatgcccggcgtcaagcccatgtaggcaatggcacgctcggccgcggtgcgctcggtttcatcgttgaacgaagccggatccggcaccacgccggaaatcttgatgccctgccccgggttggtgccccacgtcacatacggctcgagatcttcggccttgatggtcacttccttgtcgaatacggcgtcgtcatcggttttcagcgtcttccagtattcgatggccttgtcccacatttcaccttccggcgcgtgcgggcgtcccttcagatattcgaacgtcacttcgtccggcgcgatcatgccggcgcgagcgcccgcttcgatcgacatgttgcagatggtcatgcgtgcgtccatcgacagtttcttgatggcctcaccacgatattcaatgacgtgcccttggccgccaccggtgccgatcttcgcgataatcgcaagaataatgtcttttgcggtgacgcccttcggcagttcaccttcgatattcacggccatggttttgaacggcttcaggctcagggtctgcgttgccataacatgttcgacttcggaggtgccgatgccgatggccatggcaccgaacgcgccgtgcgtggaggtgtgcgagtcaccgcacacgatcgtcatgcccggctgcgtcaggcccagcaccggcgcgaacgcgtgcaccacgccctgatcggcgtctcccagcgggcacagacgtacgccgaaatccttgcagttcttttcgagcgtgcttagctgcagcgcggagatcttatccggattcgggcggtcgatgtcggcagtcggcgtgttgtgatcttccgttgcgatcagctggtcaaggtgacgtggcttgcgtccggccagtcgcaagccttcgaatgcctgcggactggtaacttcgtgcatgagcatcagatcaatgtacagcaagtcgggagccccatcactacccttgcgtaccaaatgatcggcccagaccttctcggccaatgtcgttcccattgcgggacctcctcgaatttttcctcgctttttcctcgcggtattgccaacccgcgttgttcgtgctataagcctatggtgttcgagcctggttcgaacgcgtttatgccggtatatgagatacttgcatgcaacgcacacatcacatatgggccaagttcactccagatcatgtcaaaatcgccgcgattgtggcatacctccccgtatgtacctacaaaatcgttgaaaattcagatttttttccagctttttccataactgagtaaagattaaaatacctgctctaccgcagtccgacattgcgtacattttgcatttcaatatgtgagatggcataatccctcttatgacttcttcgaatacaagcaccaccatgcctgaatcgcagtcggatgagactaagcttccagctgagacccaccacacgacgtcttctcaaagcaatgagattcattccggtgtgggtgtgcttgacaagaccgtcaaaatccttgacgcgcttgaatccggtccggcaacgctcggacagctggtttcctcgacgggcttggcccgaccgaccgcgcatcgactggcgattgcgttggagcgtcaccgttttgtgttgcgtgatcagcatggtcgtttcgtgcttggctcgcgttttgcggaattggccgctgctgccggcgaggatcgtttgctgaccgcagccgcgccgattttgcagacgttgctggatcgcactggcgaatccgcgcagatttaccgccgtcagggcgatatgcgcgtgtgcatcgccgccgtggagcgcgcttccggtttgcgtgattccattccggttggtgcgatgctgtcgatggaggccggttccgcggcccagattttgctggcttgggaggattccgaacgcctgcatcaggggttgcgtcacgccaagttcaccgcggccaagcttaccgccgtgcgcaagcgcggttgggccgagtcggtcaacgagcgcgatgagggcgtatgctcgatttccgcgccgattcgcaatgcttccggtcaggtgattgccgcaatttcgatttccggcccggacggtcgtatggggtccaatcccggacgccgttacgccccgctggttatggctgccggcaagtatttgaccgacgccttgattaaggcttcttccggtcgctgacgggcaatatacagcctctcaaccgtgttccacgatgcatgcaggacacggttttgctatttcctgccttccgcaagttttgccatttccttgcaagatttgtcatttcgctcttttcagctacttcttacgcagccaagtcaacagtttgctccaccatgtcggccgatgcagcagatccacgccttcggattcgggcttcgattcactggtcatgccgtacgcgtacgccttgcccgcgctcggtttgcccactaattcgccgtattcaagcagctgcgtacgcggctcgtacggatggcggatgtcgaactcgatcagccgcgcggcccgcttctgcggcaccggaccatacgatccgaaaccgctggtgggcgacgcgatcatcgtcagaccgccaaccttgcctggcgaagccgccgtctgcgcatcagccgaggccatttctcgcgaaaccggcactgttccaacgaatgcgttgcggtgatcatgccccgcggaaatcgcaaaatagtcatgctgttccaatatcgcgaattcaccgctgtcggcatccgggcagctgacaccctcccccagataactgccgggaagcgttttttcctcatccaaaacgtaatgttttccagcgaaattgcggtagccttcaatcgcacgcgccgcattcgccgcagtcggcttcaacagttggtaatactgttgcaccggaaaatgctgaaataccatgcacggcactgccttttcctgcgattgcgcggtttcgtgcgatcctgcctgtttctgagattgcgtggccatcatttccggcacttcggcaagaaatcgcaacgcctccgcggacgggcttccgtacccgccggaacgtgcgtaatcgcctgaatccagcaataccaagcccagcacggacatcgtatggtccacatcggcaaccggcaatgcgaaggtgcccggctcgcaagcgaatacgcgctgattcggcaaatacgattccgcccggagttgcacgaaacctgcatcttccgcagaatccatgcttcccacagaatttgcagaatttgcgcccccgaggccgctctcgcctcccgtaggctcagggttcacgcatccgggaaattccctgcaaatgctttcgatttccgcattgctgagcccgcattgaaaatcgtggttgccgaatgtcaccgcccacggaatgccgcgatcggcaagcggacgcacgagctgttcgacagtggcgcgcacggatgcgcaggtgcgttccagcgcagcttcgaaccgttctgacgcttcggaagacttggatgaagcggttttggaggaaatccccgcggcagcgctccaacgacgtttgcgcgtggtttgcgcgtatgcgggatcatatcctgcgatctgattgccggtgaagatgacgatatccggccttgtggcatccagtgacgcttcgatgagtttgacggtgtctttgctgactttcggcccgtcttgaatgtcggcaagctgcagaacgcggaatttgccggattggtggaattgcaatcgtcccagtcgcgcggatacggaaagcgggcgatcgtcgccttcttccgccggttggatgcgcggtcgcgtggcggcggcttttgctgcgttctgcaattcagtcatgcttcctagggtagtgcaattttcttggactatgttgtactggcagacatgcttgcgaaaaaacaaaaaaccctcgcatctgcgagggtcattggctgggatgcctggactcgaaccaagaatggctgaaccagaatcagctgtgttgccaattacaccacatcccaatttggcaggcgtggcaacttcgaaaagttgtccgtcgtacccccgaccggatttgaaccggtgttggcgccgtgagagggcgtagtcctagaccgctagacgacgggggcttgagttattgctgtgattctcagctgagccgcgaaccgcaacgagtgataaatatacgcgaatccgtaggagtgcgcaagtcacggcgtgtcgcgccattttccgccattcttaaacagcatcccagaacaacaaacccgctggaacggaacattccagcgggtcgacagtcatgcgatcggcaaaatcacaccatcagcgcatcacaggtgctcgcgcaagccctgcaagcgtgcgacggtgatctccttgccaacaatctccatggattcgaacagtggcggagacacgcgacggccgctcatggccacacgcaccggaccgaacgccagacgcggcttgtaaccgccatcttcgatcagcgacttgttcagtgtctcatgcaggaagtcggtcttccaatcatcttcagcaacgtcggaaagcgccgcaatggcggcgtcgagcactgccggagcggaatccttcaactgcttcttggcgtcatcatcaggctcgatgtagccctcggtggagagcagcgagcccaccatgccggcgacctcgcccagcaggcgcacgcgcggctgcacgagctccacggaagcggacagcacctcacgctcgcgatcggtcagcgcatcccaggaatcggcggagaccacgccatcgcggttcaggtacggcacggcacggttcaggaagtcctgcggctcaagcatacggatgtgctcggcgttgatggaaatggccttgtcgaggtcgaaacgggccggattggccttgacgtcacgcacgtcgaacttttcgatcatttcttccatggagaacacgtcgcggtcggcggcgatggaccaacccagcagcgccaggtagttcagcaggccttcgcgaatgaaaccgttgtcgcgatgcaggaacagattggattccgggtcacgcttggaaagcttcttgttgccctggcccatcacgtacggcatgtggccgaacagcggcatttccttggccacgcccagctcgatcaggtaacggtagagcacgatctgacgcggggtggagctcagcaggtcctcgccgcgcagcaccacgttgatgttcatcatggcgtcgtcgaccgggttggtcaacgtgtacagcggatcgccgttcgggcgcacgattacgtaatccggcacggaaccagccttgaactcgatgcggccacggatcagatcgtcgaacgcgacatcctcatcgggcatgcggatacgcagggcaggcttgcggccttcggcacggaaggcggccttctgctcttcggtgagatcacggtcgtagccgtcgtaaccgaaagccttcgggcggccggcggccacgttgcgggcttcgatttcttccggagtggagaaggattcgtatgcatagccggcttcaagcagcttggctgcgacatccttgtagatgtcgccacgctcggactggcggtacgggccgtcggggccacccacgttgatgccctcgtcccagtcgatgcccagccaattcagggcttcgatgatctggttgtagctttcctcggagtcgcgctgggcgtccgtatcttcaatacggaacacgaacgtgcccttggtatggcgggcctcagcccagttgaacagtgcggtgcggaccatgccgacgtgcggaatgccggtcggggacgggcagaaacgcacgcgaacatgctcaggaagttctggtttggtgttttcagcttcagtcataagctccattgtgccccgcaaaccggacgtgccatccagtcccacgcaccaactcgcttttcgcggtcatgaacatcctgcagctaattgacccgatgatcgcagccaccaatccttacaacaccatgctgggcatgagccgcgccatcgacggacttccccaacgcgtcagaagatgccccacgtcaaaggggatttttgcggggtctgtcgggattgtcccacactgcaatatttttcggtatttttggcgatgcaagagtattgtgttaatcgacttcacttttttgatgtcgattcactttccgaaagggtaatctaatgacggaccccaaccaatataatccgcagaacccgcagcaggcccagcaatatggcggttacggctcctacggtcagaatgattacggccagcaggcaccgcagtatggcgcgcctcaatacagcgcaccgcaatacggcaatgcggccggatacaaccagcagcagccgcaatacggcgcaccgcaacctcagccacaggggtccggcagcttcttcgcactgaccgctccgctcgaccagccggcctacaactgcaccatcggcgaggcgttcatccgcttctggaaaaagtacgccacgttcaagggccgcgcctcccgcggcgaattctggtggtgggttctgtgcacattcatcatccagatcgcgtttgccgtcatcttcgcggtgttgggcgccatcatcgacagcaatacagccaatggaatgcgaagcttcgtcaacaccatttgggcactggcaacgattgttccatcccttgcgctttccgttcgccgcctgcacgacaccaacaaggccggcaccacgctggtcatcctctacgcgattgacttcatcggtggcgttctgctgagcgtcggcctcgtcatgacgggacttggcgccatttccgtaatcggtggcggatcgagctcgactggcgtagccggcatactcctgttgatcatcggtttcatcgcatgcctggccacgtcgatcgtgctcattgtgctcatggccaagaagaccgatccagccggcgcacgcttcgacgatccggcagccggcaacggctacgccccagccccgggcatgccaccgaccgcaaccgcacaatacgccccgaacggcactccggcaccggtcgccgacccgtacgcagcggctgttccgacgccaaccgctgatccgtatacggcagccgctccggcacctgcaatgcctgcgccgactccggcaatgcccaccgcagacccgtatggcgctccgaccccagccccggcagccaccaacactccgtacggcaacccgtatggcgctccttacggaactccgaccgatcagtacgcagcacctgcgatgccagccgctccagccgcccagtacactccggccgccccggcaactccgcatgcagccccggcacccgaagccccttccatgccgagcatgcctccgctgcctacggttccggaacagtccacccagcttgaccagacgcagttcgatcgccccacgttcggcaacgattcgcagggccagaccccgtacggatccgacgattccgacgattccgacgatcctaccgcgtacggcaacatacagcactgacgaaatatgcctgttcagcactgaacttaagaaccgaacttgcaataatcagtactacataaagaaaatcccggcaccgcaatcgcaagtgccgggattttcttattcctatatcgataattcccactaattcggattatctcggattgcccacgtcacgcagcatccgcaccttcgcctgaatcaccagaatcatcggaatcatccatgtagctcatacttttcatagcgtccgtcatcaaattgaacttttcagcgagcgcttccttgctcttacgttcatcctcatctttggcttcctgctcggccctcttcggatcccaacgcaggcactccgcatgatgatcccactccatgcccgcgcacggaatgacattgtccgcggttatggtgaatgtgttgtcgcagaaggaattctcctcgagtggcgttgccctgcccgcctcacgcacagcattacgcagcgcaaccattcgagacaaggtcacgtcgccgacatagatcggcggaacagccatctgctcgcacaactcgttgatgtacagcatcaccggcagcacgcgcacggtctgttcgtccacatcgtcaatgccttcgcacatgagattcatcagaccgtcacccaccgcgagcgccgcgaggaatcgcccggtgagcgtccttggggtcgtggtgaaagcgtagcagtagttgacatcttccagcgctccgccgtcgaagcccaggctgacgctctgccgaatgtactccacgatcttttgcagtatattgcggacttccgtctcgacatgggcgtcgatgaagatgcccagaatgtcggccgcttcgaagaacaggtcggcattgttggtttcggaataattgcgcatcacatcgtatgcctgattggcccgcgtgagcgcttgcacaatttccggatcgcaacccggaatctcgtccattccctcgtacacggcttccgccacggacgggttaatcccgtgggacaatcgcagcattgcccttgccatggtgcaggagaatcttacttgcagatcttccgtgtactttgcgtcattctccatctcctgaacggtttgcagcggccataattccaccactccaacacagctttcgatggcaattttcatatgaggcctatcgaataattgataaagcgctccgttgttgatagtgaaagccatgcgtgcccctttgcagcttcgacattttgttttcctcactggacccaacagcatccagcccttccatgattgcatggaatccccgttctttcaacaaccgccgcactcattgtcgcgtgtctcggtcaaaagtttccaatccggcgattccatgccgcattatgcgctatttcacgtcggccgcgggatcgacgtaagcgatcgacaatactttgcgtgtatcgcaatcgtacgtaatggaagtgatggaggcgagtgccgtatggcgtagcagcatattatgttccgggtgcccggtttccagcatgtgcctgtagctccagatgggcgattcatggctgactacgatgatttgctcgccgggatgctcccccactttttcgagggcgaacgcttgcacacgatgcgcgatcgactggtagctttcaccccagcttggcttccacaggttgcgtaccagcttccagttgccgtttttccagagtgcgccttcgccgtagccgatgcgcgtgccgcggaattcgttgcgcgcttcgatgatgcgctcgtcggtggtgagtttcagcggctcctcgccacgggtttcacgcacttcgttgagtgcggtgaggatttcgccggccgtttcgcgcgtgcgttccagcggcgacgagtagatggcggaaactgtgttgagtcgtggattgacggcaatgtagtgcgcggtcgcctgcgccatgcgcacacccacttccgacaggtggaatccgggcagtcgttcgtagagcaaatgccctggattttcgactttgccgtgacgtacgaaatggatggttgttgcgggcatccctaccgcctttccgcaagatgctgccggactgctgacgttgaccgatggaacgaaaattctgcaatcgcaagctttggaagcgttgcgcaaccattttgcaacaaccgtctttcgcccgccggacatcttttcgtccaccaagtgaacgtgtggtgagtacttacaaaatagccaatcgaattatgtctgccaacctcaatgcaccgcgtgttgcgacagtacctccgcataaagttgtctagttcaagaaaatggcacacaaccagtctccaccccctatgcaacacgcttgaacgtcaatcgattgacgttcaagcaaggttgaagtgagagactggggctggagagcaaacaatcaagacagaacgagggtatatcaagcggtccgcggcaacgcaacgcagcggacgcaagcaccaaccgtgagcagaaaggagcggcaaaacatgaccaattcagtcctcgccggcgccaaaagcatcggccaacatcttttcggagggtacgcggagcttcttcgcataccgcacaccgcccgattttcggtcggttcagtgatcgcatgcatgccgttcccgatggtcggcatgacgattacgatttccgtgcagcattattacggcaattattcgctggcaggcgcgctgacggccgtgcaggcgatcgcgctggccgttgcgagcccggtgctcggcaagctggttgacaagttcggccagcgtcaggtgtcgattccgacaatcatcgtgtggatgattgcggcgaccgcactggtttcctgtatcaccgcccgagtgccgtcgtggattctgttctgtatcgtaccgttcatggcggcgattccgccgtggggcgcgatgagccgtcagcgttggaccacgctgcttaaaggtgacacggagaaaaccaaccgcgcgctttcgctttccggcgtgttcgacgaatgcatgtgggtgatcggcaatccgctcgcctccacactggccgtgatttccgggctgttggcattctcattcactggcgtgtgtgtggtggtcggcgcgctcatgttcctcaccgaactttccaccgagccgaaatcgcagacgcagctggctcgcgaagcgggcatgacccgcaaggaataccgtgagcgcgaagccgcccgttccaaggcgttgcaggcggaagcggccattgagtacgctcgcgatcgcgcacgttccgaaggcaaaacggctgcggaagtgcaggccgccatggatcaggccgccgccgatgtgaatgccgggcgcaaggaatcgatttgggggccgggcctaatcgccgtatgcgtgacgtggttcggtttgggcgcgttccagtcggccgccagcatttcgatcgtcgcgttcgccacggaagcgaatatgaagcagtacaccggtttcgtgttcgcctgcttctcgttcagctcgctgatcggcgcgctcgtgtatggcgcaaagaattggactattccgctgtggaagcgtttctacttctgccttgccgtggtcgatctaggcatcggctcgttcatgttcgccaaacatctgtgggtgatcatgatcatctacctgttcatcggcgtatgccaggcaccgacgtgggtgaacggcaaccagctgatgctgcacttggtgccgcccacacgcttcaccgaaggcatggcctggatgggtgcgatgaactcaatcggcggttccgtcggctcggcgattgccggccagttcatcgaccgtatgggatcacacggtggtttcattgtagtgacggctctggcgctcacctcgctggcgatcgccctgttcggcttcaagcagatcaaggactccaccgagcagcccatgcttaccaccgtaagcgtgtgacctttcgcacgtaaagcatgcagagcatacgaaaaggcggtgcttatacctttataggtgtaagcaccgccttttcatattcaggactgtccggccgtctgcgcgagtcgggaatcagggcagatttgatcagggcagatttccgggttgtgcaggcagattttccgaattcaggactacttgggccaaccgttgggagtgtgttccagcgaccatatgccaagcttgtgcgagaagctgttctgccacttggcttccagctcttccggcgtgaggcggttgtcggctttgcgcaaacggttcatggcgttggtgtgcgtatcgtcgagcaaccatttgcgtgtcaggaagttccacaccatcaccacggcggtggcgatgagcttgccgacgttggtgcggatcaggtattcggtgctctgcgacacgtaggcatcatggttcatgccatacgtggagatccagataatggcgtcgttcatgaacaggccgatcagcgcgccaatcacgaaaatgaggatttccatccagcgggccatgtcgtcacggtgcttgaacaccagtttcatgctggcaatgtagttgaaaatcagggaaataatgaacgagatggttgcggcgagcacgttgtgcatgcggaatacgccgacgagaagattcagaatgccccagtcgataatgaaggcgatcacgccaacgaggccaaatttcataagctgttcaatcagttttctcacaacgaatatttaacacgcgcacgcagaccaccttggcagccattcagacaaagcccaaaatttctcacgcaaccaccccgactgcgccgttcgacgcctagactggaggtgaaccgcaaaggctgatttcaacaattcaaggagagcaccatgccagtcattcatacccatgtttccgtgtccaccaccgccgaacagcgcgaggcgctgaagtccgcatacggcaaggcgatcaccgccgttcccggcaagtccgaaggctggctgatgtgcccatttgaagacaatatgccgatttatttcggcggcgacgattccaagccagccgcatacgtcgaagtgaacgtgttcggtcgttccgtgcccggttccgcctgggagaagctgaccgagcagatcatggccgcattggagaaggaactgggcattccggccgaccgcacgtacatccgttacaccgccaccaccgactggggctggaacggcggcaacttctgacgaagtttccaccgttccttcgaggttcgcccatattgcgaacctctcacctcacctacggggaaacacaccgtgtttcccgcctcacggttcggggcgacaacttctgacgaagttaccaccgttccttcgaggtcatggcgttgcgacgttcgctagaaaccgccaaaattagggtgcaaaagggcggccgcctacgcatatacgtaagtggccgccctaaaacgttgcgatcagaacgctacgactcgtttatcacacgatcttcggcatcggcgtggtcagggacgtggtgaggttcacgtgcaccaggccggcaccggaatgcacttcgaccttctttagcgtcaccgtacgctcggcttccggagcgcggtcattgtcggtcatggtggccggggacttcacggcgaccaaagcaagcgaaccgaaatcgatgcccgcgctggcgcataggttctgagcggcggccagcgattcggcgaaaccgtccttcaaaatcacgcggtcagatggaacgccatacgcgttctcggcgacccaacgcacgttctccaccagagccatgcccttgtgactgtgcggttcggccggcatggaaccgttcgtcacggcatcgacgaacgcatcgagctgcggggcgagcgcgtcgccaccgtcgcggtacaggttgccgatgatcgggtcgcggaattccagttccttggcggtgtccttgagcgccggaatctgatcatcctcgccattccacaggttgataagcgggaaggtaggaatatcaagaccttcgaggcgctggacgtggaacgggtagcgccatgccagatccggatcgtcgcgccacgtggaagcgcgggtcacgacgatggctgcggacggccactgtgcgccatactcgcggcaagcaatgtcaagccacttctgagcgcccgcatcagtaccataaccagcctcaacaatcaccacgtcgtgcagagcgcacgccatttccacggagaccagcgtcggaatgccgatggacacgttggcgaacgggccgccgtgcacgtacaccggagagccgttcacggtctctgtcttggctggcttcacggcgtcgccgaggatgccggtgatacgccacagatcaacgaattcaccgaaggtcacggcctttccatccttcgtgccggcgaccatcttggcaacgcgctcggaaatctcatccatggaacgcgacagcacaacgatctgcataagctcgcaggtcggagtgagcaccacgcgctcagccacatcgcccttgccacggtccactgcgatctggcgcagggaacgggacggcacttcggagacgcgcggcacgagaatggtgtccagcttgccgtcatcaacagccttctctgcaaaggagaccaacaggttctgagccgcttcgatagcacccatttcgccgcacagaccccagtcgatcagctcagggtgagtcagggaagccttgccgccacccgaagcaccacccttggaaccggcagcggtaatgcccatgctcggctgacgcagcacagcggccgcatcgatgccacgctcacgcagcgcatcgatcaacgcgatcgtagtggtggtcttgccctcgccgcgagacgccttcagcggggtatcggcggtgacgagcacgaccttgccatgcttgcgtggagcatccggatcattcttcaaataatcgagatagccaaacgcatcaatcttctgcaccaagccgtactggctggtgaaatcctcaatgctggtcactggggttttcctttcttcgatttggaatgacgtcattttagcgacgttgtattgcggggaaaaatcggctcccgcaacgtggtcacaggagccgaatagtgagatattagaagtccgacatgtggaagccgttcttcatgttcatgctggcggtgtacagcacggaatcaagaagcttgtcggtttcctccttgagttgcgcggccatgttttcgttggctgcggcaaggatttcgcgggcgtcgtcgttgcgcacggcttcgatgatttcatccggttccatcggctgcacatcgccgatttcgtcttccgcatcgaattcgtcggtaacgtcacccaccaagcgttcaatctgctcgtcggtagtggcaaccatgcggtggcccatcgcgccggtcttctcctgatagcgttccacagcgttggcggtgtcggcgaagctggaatcgcacagggccgcgataatgcggttctcccaatagaagttttcggatgtgacgcgcgtggtggtgtcttccaaatacttcggcgtggagttgacgttcgggaagaacggcacgagtgtgttgaacgggttggaaccgtaggcgatccactggatcgcgcggctcacctgcgggcggtacgggcggatctgcattaccgcaagctggctctgacggttgatgccgatcgggcggaacatatggcgggtgcgctggtcgccaagctttccatacggatcgtacggggtgccctgatagtgggagctcagcacatacttcacatcttcgatggtgattttgcgttctggttggcgagcccacggaatatcgtcggaaaccggcttgtggtcggcatcctgaccatcccactgctcgtcgtacgggttgaggaaacgctgcatgtaccaagcacgaggagtgttgtacacgtgatcggaatcggagtgagagccaaacgcgtcacgcgggttgaacggcgtagtgctctccaccgacaggtcaagatggttgcgttcgatgaactcggccagatcggcggaacacatgtggtcctcctgctcgccaaacgcatcttcaagatcaaattcgtcaatgcccaactgattcggcatggtcacatacgcttcgtccggcacacgcttggcgatccaatgatggccgccaacggtttccagccaccaaatctcgtcaacgtcggagaaagcaacgccgttcatctcataggtgccaaattcctcaagcagcgcacccaaacgttccacaccctcgcgggcggtggtgacgtacggaagcacgagtgtgaggaaatcctcttcgccaataccaccggcgacttccggttcaaagccttcttcgccttccttgcccttggcaggcttgagttccacgaacggatcggcgccaagcacacgctcgttggtggtgagcgtttcggtggcactcatggcaacgttcgcttcattcacaccagcttcgccccaaatgccttctttcagatcggcattcggcacagccgtatactgcagcggattgtcaggaaggtcgatttcaacatgcgaaagcacgctcttgtacttgcgcggctgatcttcaggcttgactacgatgaagcgcttcgggcaaaattcaccatttgcactatcttcattacgggcgatgatggtcgatccgtcataacttgcgtctttgccaaccaaaatcgtggtacacgccataattattcagcaatcctttcgattattgttaatacgttttcgtcggatatatttctgatttccgcatctttatatcgttatattgctgcggaaatcaaatttctggccttacttgagatcctctttcacaaatcaggcttttccagtgaggaaaatagcgccctgatcaacgattgtaccggaagtacgcagcgcacgttccatttcgttgagccagaatccctgattgaggccggcgagcggagccgtggtaccccacacatgcagatagtagtcatgatcctgatctggcggatatggaccgttgtaacgcatcgtcactgcgggatcactgctgcggccctgcagcaacggcgaggcggcggatgtgcgtccctgaaccgtttcaggaatcatcgcggaaaccgtgcgcgagaaatcagccggaatcgcgagcgcgtgagaatcgttgaaatcgtacatcagcgcatccacgggcaggttcgcgagggaccaatgattccactggaaaccgcataccggaattgaatccggatcaacgaattcccaatgcaggaactgcactgcaggatcaagcgcatcaatgtagaaggggaaggaaacaatcggcgtaccgtcgatgcagttctcaggcggcgccgccttggcaaacgcgtcgggaatgacggtgaaatctgcggaaatcttcatgcacccagtatccctcaagcgtctgactcatacaaggtttcaattgacggcataacgaaacataacgaaacgacccctgcggcgagcctgtggggcacgcgggcaggggtcggtccgggaaacagggcctatcagacctcacatcgcttgaaaaacaaggcgttacaggcgataggcacagctagtacggctcagttggccgggtggtagaagtcgccgttgagggcggcttcggcacgggcctgagcctcttcgaaggtgacttcggcaagggaggcacgcacgtcgtcgagtgccaccggagtcatggacagggagttcacgccaagaccggccagcactacagccaagtccggatcggcagcggcctcgccgcacacgcccaccggcatgcccttggcgttgcccgcgtcgcagatcatcttgatggcacgcagcaccgccggatgccaggcggtctgatagttggcaacggaaccgagcgtacggtcggcggccagcgtgtactgggtcagatcgttggtgccgatcgacacgaagtcggccacgtcggccaccttgtcagccataagcgcaatcgacggcacttcggccatcgcacccacgaacttcagaccgaagctcttgccaagcttcacgaaatagtcagcctcatgctggtcggcaaccatcggagccataacccacaggttcgcatcggtggcggcatcggctgcggcgagcgccttgagctggccttcgagcacgtccatgtgggcgcgcagggtgcgcaggccgcgcaggccgagggccggattcggctcgtcttccggagtgaggaacggcagcggcttgtcagcgccggcgtcgagcatacggatcacgaccttcttgcctgggaactggctcagcagctcggtgtaagcgcgggtctgctcttcgacggtcggcggctcggagttgccgatgaacaggaattcggtacggaacaggccaacgccttcagcgccatattccagcgccttggctgcatcggccggcttgcccacgttggcgagcagcggaatcagatgaccatccttggtggagcctggattgccgcgcagttccttggctgcggccgcgcgggacttggcggcttcggcaacggcgatctcctcttcggtcgggtcaacgacgagttcgcccttggccgcgttcacgaccacggtagtgccgtcggtcaggttttcggcttcggctgcggaaacaaccgccacaatgccacgagcgcgcgccagaatagcggtgtgcgaggtcgggccgccctgcgaggtgacgatggcgagagtcttgctcatgtcgagcgccgcggtatcagcgggggaaagatcttcggcgacgagcacgaacggggtttcgctctgcggcaagcccggagcgggagcgtccataaggtcggcgatcacgcgctgtccgacatcgtgcagatcggcggcacgctcagcctgatagccaccgatggcacggaacatgtcttccactgcggcgaagccttcgagcaccgcacgttcggcggtcttaccctgctgaatcagacccttgatggattcagccagcgacggatcggaagcgaacatggcgacggcctgcagaatcggagcagcctgcttggcaccttcgtcaccattggcggcctcttcagcacgacggttcaggtcggcgttcaccagtgcgagggacttttcaacgcgggcgatttcgctttcggcagcaatgccttccgcacgcggagcgtccgacggttccggcagtggctgcgccatacggatgaccgggccgactgcaacaccgcgaccaatgccaacacctttgataatcatgtgaactcctttgacctgtttccttgtttcgttgtttgcccgcgaggggaacgcgaaccgaacgtttgttgttgtgatttccgcgcttgctttgcgcgtcgagttactgcatgattcccaccgtctttgccggtaaatcattttcagcctgcgcacagtatacacactttaagccgcaacacacaaccggtaaacgttttctgcgtttcgtggaaaaaggtgctatagtaattattagcggcgcaccgaggcatttcgctcggcaagcagcacgactttcaaataacacaaccaaaaatcagtcaacacacgactcaaaggagtgtccatcatggcaacccgcaccaccgtcatcaacgatcccgtcggcatccacgcccgtccggcagcacagttcacccaggccgtcaccgcctccggctgcaccgtcaccatcgccaaggaaggcggcaacccggttccggctaactccatcctgtccgtcatgggcctgggcatcaagcagggcgattccgtggtcatcgacgtgcagggcgccgatgacgaaaccgtggcagacaacctgctgaacatccttgtcaacgccgagtgatcttccttttgctgaagatttcaggatttcgcaagatattcaacaatcttcagttattgcatcgcaattatgaaatcgcaatgcaacatgcatgattgagatacttgcttccagccacctgccgctttcgacgggtggccgttttattcttgaatacgcgattgagatacggcagtaattcgaataatcgagttttttcgagcatttcgaatatttgtggtgaggagagcatggcacgtacaaccgacaacgcttcggcttcggcaacttcggcgaacagttcgatcacgaacgtcgcagcgctagccaacgtctccatcgccaccgtctcccgcgttctttccggcaaacgcaccaaagacgacgacatcgcacgccgcgtgcgagcggccgcggcacacctcaactattcggtcaattatgcggcgagcgcgttgcgcagcaccgtcaccaacaccatcggcctggtgattccgaccgccaacgacccgttctgtgcgcagctgcttgacgaaatcgaacccgtcatcgacgtggattcgcagcaactgctgctgggcatcggcggtgatcaggccacgcagattcaacgcatcgagtcgttggtagaccgccatgttgacggtctgatcgtgctgcccgcctgggaggcctacctttccgcagagcttgaacattacgcctccacactgccgatcgtgcaggtgggcggccgtcaatgctcgttccgcacatccatggtgagcgtcgacgaaaacgcagccatggaaatcgtgatcgggcatttggctgaacgtggcatcgcatccgtggcatacatggccggcaaggaaatctccttcgaatcggcggaactattcaccatgttccacactcagatgcgagcgcaccatcttgccaccgaaaccgaatggaacaagttcggagaccgtagcgtgcagcgcggattcaactgcgccatgcgactgttttccgagccgctcgtgcaaccggaggccgtggtgtgcgccgacgatgcgatcgcgttcggcgtgatggtggcgttgcattcgcttgggcttcgcgtgcctgaagatgtgctggtggttggctacaacgattcgccaatcgcacgcaccaccatgccgccactgaccagtgtgcgcccgccgttcaaacaaatcgtctccgaagcgctacgcctactcaacgacggtcccgacagccccgcacatatatcacttgcaccgcaactgatcgtgcgcgaatccaccaactaccagcgctgaatcgcaatttttgcaattttgccgcacatttcgccttgacagccccacgaactcgccttgccgatcctactgacctctcaccattccatttttcgtctgtaaaccaaaatcgtgcgacaggaaatcggaatcgtgtgattagttctgtaccggaccgacgtctttctgactgcgaatgatgaacttgatctcaccttgttcctgcgtgtgcaatgccacaccgaacgcaatgatagcgccgaattcatcgaccactacagaatccatagccagcaatggcgcaccttccggcacctcgaatacttcagccatatcagcatcggcattctggatacgcaccaccacttcgttttccaccatatgcactgcatactgccgctcaagaaactcatacagcgagccttccgagaagtcgtgttccagcactttggagaaacgcgatgcggaaagaaacgttaccacatgctgtttgagcgtattacccacataacgcagtcgttcaagcctgaccaacggctcattcttgtcgactcccaaattcttggcagcctcggaatcaaccaccgtagtattgctcagcaccttggtgcgcaccacattgcccaaatcctcctgttgacggaagaaaccgcgaatatggtcgctgatcacctcacgctcagtattggcgtcggctcccgtacggaacgtacccttaccctgctcacgcacgatgagatcatcttgaatcaaatcgtcaatcgcatgacgcaaggtgatgcggctgacgttgtactgcttgcacagttccggttccgcaggcagcttctcccccggatccatcgagataatgcgctgccgcaggttctcacgaaccgtaatatatttcggcacgcccgctgccatgaatcatcaaccccttacgtattgtgcttgttctgaatatactcgcccgtggatagcagatgatcggaaagtcagcaattcgcaccaacttcccgatatcatccgcgtatcatttacaggctattcgtatgtcaggcttcgacctgcgcagcctgcttcgccttgtcgcgacgggtcagcaggaaggatgccaggtagaacaccgccactgcaatgagcacgccggcaaccagagcagtctgaccacccaactgattggtgcagccaagcaaaatgccagccacaccgaagtcggcatcggaataggtggagttcaccaagcccatatcgccgagcaccggcagcaggaacagcggcaggaaggtgatggccaagccgttcacgaaggagccgatgatggcaccgcggcgaccgccctgtccgttaccaatcacgccggtggcgccgccggtcatgaagtgggccacaatacccggaataatgatggtggttccagccaggatcatgatgcccatgccgatcaggccgccgacaaagctggagatgaagccaataagcactgcgttcggagcgaacgtgaaggtcatcggcacatcaagagccgggactgcgttcttcacgagcttctcggaaatgcccttgaatgccggcacgatctcgccaagcaccacacgtacaccggcgagaatgatgaacacgccagcggagaaggtggctgcctgcagcacggagaagacaaggaagttctggccgtcactcaggttttcttcgatgtaaccggcaccggcgaacaaagccacgatcacgtagataacagccatggagagcgcgataagaacagtggtgtcacgcaggaagccgagacctgccgggaacttgatgtcttcggtggatttggacgggttcttcttggaacgagtcagacgtgccacaaaaccgcccagtgcgataccagcgccgccagtgtgtcccaaagctacgccatcagtgccggtagcgtccttcatgaatggctgcacgagagccggcgaaatggtaacgatcaagccctgtgcgatggatccccacagcagcacaccccaagtcgggaagccggcaacctcgaaaatcacagcaaccatggtcgccatatagaacgccacatggccggacagataaatgtacttgaagcgcgaagtcatcgacagcagcacattgacgatcatgccgaagaagaagatcagcgcggcttcagaaccgtacttgacgagcacggtaccaacgatggcctcattgttcggcaccacgccctgcacgtgaaaagcgtgctggaacatatcgccgaatgggaccaatgcgccggacacaacactagcgccggcagccagaaccaggaagccgacaagagtacgaatcgtacccttcataatgtcggtgcccttcttgtgctgcacagccaggccgatcaacgaaatcagcgcgacgatcaccgacggctgacggaagatatcgagcagaagcgaaagaattccgttcacgactctctccttattattttctctatatttctcttatttttcgtaatgaattttaggtaagcttcgcccacagcggcacttatacgaccaaaaatcgcggtgattactatgattttgaaaaggtcaaattattatgtgctgtcgctccaaaaacttatggaataagcgaagtgaaatccgaaatatttgttttacttgttcggaactgcaacaccgtgacgttcgagcgcgtcagcaaccttcgtcttgatttcgtccatatcgataaggctgttgagcacaaccacatcacccttgccttcagcggcttcggcgatatcacgccccacgaagagcacatcgcaagtgttttcggtcacggatgcgatatcggtgtggtcggtttccacgccttcaacgccgagctcgccgagagccttttcgatgttgagctgagtcatgaagctggagccgaggccagtgctgcatgcagtatagatcttcattggtgttcacctttctttgtggcgaataatcgcgttggttgttgtgttgtttgttggtattcaaggagtttgtatatgcgattgatgatcgtcgatcggatattgtcgatcagtcaagcactgcacgcagctgttcgacggtggtcgcatgttcgagcgcggtacgctgctgttcatcggtgagcagtcctgccagcgcctgcatcatttcgatgtgcgcattggaatcgactgcgccaaggcagaacatggtggtgatggggtgcttctcatcatcggccagtaggaatggcttgccgacatgcagcaccgacaacgaggtggaaaccacgccggcttccgggcgggcatgtgctaaagcgatgccccaaccaaggtcaatgtaggtgccgccaggagctgcaatggactctttgatggcatccacatagctcggcttgatggcaccgtgttccaccagcggtgcagtgacggtatcgaccgcctcacgccatcccgaaacctcatcggcgtacatcaccgcgtccgatgcgaaaaactgtcctagcactctgcctccttgcttgcgctgatttgcgatgcatagcgttacgttgtttggaaagccgccgtggccatctgcccaactgataaatacatcataacgtcatatcgttataacgtcatatcggcgtgttgcacaatccaaactcagcaacacaagcaaaatcggtgaaaaacagccaatcaggcaaacaagcgaaacctcagctggcgatgagggagcaaaagagagcttcaaagaccagcacaggattgccattgccggccagacggcgacgcgcaacggcaatatcctccagccgccgcaccgctcccccacgcgtaagccgcaccgacagatcggtgatcgacgaacgattctccaaattaatcaagccaaccgaatcttcggcattgttctgcaacacagccacatcacggtaaatactggcaatcgagttcaacgcacggtcgagcacgtcacgcgtaaggcgcgtggtctgtcgcttcagctcgtcttttttggcaatcgcattgtatgcgccacgcagcttcggaggaatacgatccttcgccccaagcccattgactctgcgaaaatcagcttccgcctctgccgctttgaccttcacctccgcttcggcctgcgccttcgcattgtcgataagattgccggcaagcagcaccgcatccgacgcgcgacgcaatccaagcacgcccacaatcagctcgtcgcggtcagacatcacctgctcattcttcgcatacaagcgcgcgatgccgatatgcccttccgcaagacgtgcggcacgcaccgcgattttcggctcgaatccgccattttgctccagaaatgcagccaccgcctgcgtggagggcacggcaagattgacgatgcgagtgcgcgagcgaatcgtcggcaacacgtcctgcgcactcggcgcacacaagagccaaatcgtatgctcactcggctcctcaatctccttgagcaacacgttggtggtgcgttccagcatgcgatcgacatcttcgataatgatgatgcgccacggcgcagtgcttggcatctgctcggacgtagtgatgatgtttcgcacctcgtcgatgccgatggtcactttgttggtggccagcacggtcacgtcggggtgagtgccggcaagcacctgctgcgcggctttggtcggctcgtcgccaagaccatgatcggggctctccaacgccgccgcgaacgcgcgcgccacattggaacgacccgatcccggaggaccgcaaatcagccaggattgcgcaatggctttcggatcgccacttgcgatggctttgagttgttcgacaacctgctgctggccgacaatcgaatcccacacgctcactgggcggcctccgattggaaagttttcatttgactgatttgcgcaaaatcgttctgaatatgcgcccatacttcatcgatggattggctggcatcaatcacgcggaagcgttgcgattccgcctttgccaagtcaagaaacgcctgtcgtgtacgacgttggaaatcgtttcctgcagactccatgcgatcttcatcatgctgcagtcgtgcatgcgattgcacagggtcaagatccagcagatacgtgcgattcggcaatagctcacacgttgcccacatacttaagtcgcggatttcacctgccgtcaattcgcggccgccagcctggtatgcaagagaagaatcaaggtaccgatcggtaattaccacggcaccgcgttccagtgcagggcgaatcacctcggcaacatgctgggcacggtcagcggcgaacagcagcgcctccgcacgcggagcgatatccgcatcggaaccttccacgccgccaagcagcaactcgcgaatcgccacgccaagcacagtaccgcctggctcgcgcgtgaccacgcattcgcgcccctgcgcctcaacgtacgcacgcaaccgttcaacctgcgtggttttgccgacgccgtctacaccttcaaaggagatgaatatgccttgcatattcatcactctacattgcggcgttcgcaacgctaccgctgctcactgctacgaacagtccaccggactgttcatcaccgggcgggaactacggcgggacgggtgtagccttcgttggcggcaagccattccacatcggccttcaccgtggtcggcgtggaaccgatctccttggcgatacgggtgttggcccaacccttatcggccaactcgcgcaccttggcacggcgatcggcacgagccttatcgacggaagccgccttggaagtcttagaagccttggcagcaccagccttcttagccccgcccttgccggcggcggtcttacgtccacgccttttcgacgggccctgcgcacgcttctcagccagcaaacggaacgcctcggccggttcgatcgactcaggagcatactgcttcggcaacgtacgattcgtctcaccatcggtgatatacgcgccgtagaagccttccttgatggtcacctgcttctgcgtttccggatcgacgcccaattcgcgcagcggcggcttcgcagcgccacggccacgcccacggccatacttcggctgggcgaacagttccttcgccttatccacatcaaccgtgaaaatctcatcttccgaagcaagcgaacgcgtatccgacttgccatcggcaccggtcttcgtcaaatacggaccgtaacgaccattattggcctgcacggtaaccgtctgcacttcaccggtctgcgcatccacctcttcatacgaaccgatttcacgcggcaagctcagcagacgcaacgcatcatccaacgtcaacgattccggactcatcgtcttgaacaacgacgccatcttcgggcgatcggcagccttcttagcgctcttgcccttcttcgacttgccaccaccagccacgtcaccgtcagcaccagcatccgaagaaggcatcaccagcgcaacatacggcccgaaacgaccattacgcacttcaacggtgcctccggaaaccggatcgacgccaagagcgcgcggaccgccggaatggttctcgatcaaatcatgaccgacttccaccgtcagctcatccggagcgagcgtatccggcagcgaggcacgcttcggattgccctcatcatccagatggttcatatcctccaaatacgggccatatcgaccgacgcgcacatgcaaaccgtcgccgatctcgatcgtattgatctcgcgagcgtcgatttcacccaactgcgcgacctgctgctgcaagccggcatgtgcctcgtctgcagactgcgcggcaccctcaccggaaccgaaatagaagcgggtcagccaattcctgccggtctcctgaccgctcgcgatctggtcaagaccgctttccatatcggcagtgaactcataatccacataccgcgggaactttgtttccagcaatttgaccacggagaacgcgagccacgacggaatcaacgcacgaccgcgctcatacacgtacccgcgatcgataatcgtggaaataatgctcgcatacgtggacgggcggccgatttccttctgttccaacgttttcacaagcgacgcttcagtgtaacgcgccggaggctgagtttcgtgtccgtcggcaccaaccgccaccgcagcgagcgcatcgcccggattcatcggcggcagcgacacattgtcatccgacttcttatccgctttgctggatttgccggattgcgcggcctgttcaacgcttccagcaacatcacccttcttcgattcggcgaacgctcggcggccctcaccggtcgccttcataaagccggggaactcgataacggtgccggaagcctggaacatggcttccccattcgattcggtcgacgcggacagtcgcacggtcgccgtggaaccggttgcgtctgccatctggcaggcaagcgtgcgctgccagatcagcgtgtacagtttgagctggtcggccggcactttgcttgcgatttccgcagggtcacggaatttcgcgcccgccggcctgatgcattcgtgggcttcctgcgcgcctgccgtctttgtggcatattgtttcggcgcgtccgacagatagttttcgccgaaatgcttgacgaccgcttcgcgtgcggctgcgatcgcctcttgcgacagcgtcaccgaatcggtacgcatgtaggtgatatagccgttttcgtacaatccttgcgcagcacgcatggtctgacgcgagctcatgccgagacgattgccggcggtctgctgcaaggtggacgtggtaaacggtggaaccggacggcgacggtacggcttggtttccatcgacgcgacagtaaacgttgcaaattccaatgcctgcgcaatcgcggaagcctgcgcctcgtccaactgcacgacctgatccttcgcaccggccgcagtcagcttgccatcggcgccgaaatccttggaaccagccaaacgacggccacccaacgacaccatacgagactcgaacgcaacattattgccatcggcatccggcgcctccaacgttgcggtgacatcccaatacggggcacgcacgaacgccatacgctcgcgctcgcgctccacgatcaaacgcgtggcgacggactgcacacggcccgcggaaagacccggcccaaccttgcgccacagcaccggagaaagctcatagccatacaggcggtccagaatacggcgggtttcctgggcgtcgaccatgtcgtcgtcaacgtcgcgagtattgtcaagcgacgctttgatggcttccttcgtgatttcgtggaacaccatgcgcttaaccggcactttcggcttgagcgtctgtaccagatgccaggcgatggcctctccctcgcgatcctcatcggttgcgaggtacagggtgtcggcttttttcaacgcgcttttcagctcggacacggttttcttcttgttgccatcgacgatgtagtacggcttgaatccgtcttccacgtcaacgccgaacttgccgaatttggttttgtcggcggccggcacctggctcggctgcgcaagatctcgaatatggccgaccgaggccatcaccgtatattcggagcccaaatacccaccgattttcttggccttggtgggagactccacaatcacgagcttgctgccggtagccatagccactccttattactagcgtttgcaacgcaataatactcactgaccgtatgcagttggcaaaccgtccgtgtggcgcgagcgaccggtgccggaaattttcggcgtgatcgtacgttttgccgtcagcgtttcggaggggccggaggtgcgccgacaagcccaagtttcgtcaatggcgaggcggtcagctgacgcatggtcaacaccagcccgaacaccaacgacgcaacggaagccgtcagaatcaccgtggaaaggtgcgcaccagaattcgtccattccgcactcatcgcaagtcccggctgaatctgccaaataatgtatgcgccatacagggtgccgagcacgccgaacgtcaacagcacgctgccgacgatctgcacggaaggcgacgacgcacgcgaaccgggctcatccatgccgttcgcaaacgtcgcggcaagcgtgatcattgccactccgccgacgatcagcaacgccatgatcacgtcggtcggccggtgccactgtcccgcaatcaccgacaatccgacgagtaccgcatacagccagccgatcacggcaacgagcgcacggcatacgcgaggcacggcgcatagtaggatcattcctgccgcggcggcgagtatgacatgcccggaaggcgcggaattattgggatttgattccagattgattaagtacggacgtggcagcagcggcttcagcaactctgctgcggcaaagcagattccgccgaataccgccagttgagcaatcaacagccatcgttttcttacgataagtactgcgagggcgattatcgacataatcgcgcttgttgcgattacaacggtggaaatggtgaaaacatgcacgaccggttccagccatcccggcagggccgcatcgaatttcgaccagaccatgtcttcatagctttggccttccatcgtgcgcacgcccaaccaccagacgcccaccgcggcggcaagcagcagcagaccgaacaccacgctgagcataatgctcgacacgcgcggatgacgggtcagcggatcggctttggcaagcccttcgctcacttcacggggggaaagcacctgttcgatcggatcagacggcggctgcggcacgggaacgggcgcgaccggctgttccagcatattcgcggacttgtgcgggtctcggatgattggcttgaattcgtcggtcataatcatcgagaatacggcattggctctacggtatgcgcgaatggcatgaagatataagaaaacctccacgcacccggaagaggccacttacccttgctgcattcctgccctgggggagttgggtgacgtaccgccacgcggaggcaaagaccagtgtacaccatgcccggaccgaaccgcgccgcaagccgcacgaaccgcagcgcaacccgcgccacaggccgcgcacgaaccacacagaccatgccatgatccgtggagcagccagccccacgaccagcgacacagggaaatcaaacgtcaaaatgccgcttccccaagagcatcccgcgttaaggagggcggacgggtatgcttgatgaggaatcgcacacgaatattgtgtgtttgttttaagttcggaaggttgttcttatgactgaagcggtggaatatcccgatctggtggtcgtgggcgcgggcctgttcggcctgaccgtggcccagcaggccgtggagaggctcggcgtgcgcgtggagatcatcgacgtgcgcgaccacatcggcggcaacgcgtacagctacatggacgaggagaccggcgcggagatccacaagtacggcgcccacctgttccacacgtccaacaagcgcgtgtgggactacgtgaacaggttcacctcgttcacgaactacgtgcaccgcgtgtacgccacgcacgacggcgaggtctaccccctgccgatcaacctgggcaccatcaaccagttcttccgcgcgcactacacgcccgccgaagccaaggcgctcgtggccgagcaggccggcgagctggcgggcaaggatccccagaacctcaacgacaagggcatttcgctgatcggccgccccctgtacgaggcgttcatcaagaactacacgggcaagcagtggcagaccgatccgaaggacctgccagcgggcatcatcaaccgcctgccggtgcgcttcaactacgacaaccgctatttcaaggacacgtgggagggcctgccggccgacggctacaccgcgtggatggagcgcatgatcgacgatccgcgcatccatgtgaccctggagaccgacttcttcgacgggtcccagccgtacaacaaggcggctttggccgcggccggcgtgccggtggtgtacacgggcccggtggaccgctacttcgactactcgctgggcgagctcaagtggcgcacggtcgacttcaaggaggtgcgttacgacgagggcgaccatttcggctgcccggtgatgaacttctccgacgccgacgtgccgtacacgcgcgcgatcgagttcaagaacttcaatccggagcgcgccgcctcgcagaatcccgacaggaccgtggtatgggaggagtacagccgtttcgccgagcgtggcgacgagccgtactatccgatcaacacggaggccgacaaggcgctgtacgcgaggtacgaggagctcgcgaaggccgagccgaagacggtgttcggcggccgtctgggcacgtacaagtactacgacatgcacaatgtgatcgacaccgcgttgaccgcgtacgaggaacaggtcgaaccccttctcaagaagtgacgatacgcatcgtttccaaatcgtaattaaaaatccccaatccaccgacggtagattggggattcctcatatcaggcgaactaaaaatcaggcgcgccacacatccttgccagctgccttggcggcggcgacatcggcgtcaagctgctcttcgctgccttcgacctcgcccttgatgaactcctccaccaagcggcgggcctcgccatcctcgtgctgcacggccggcgacttcatgaaataggagctcggagccagaatcgggccggccagatgacggtcgagcgcgatcttggcggcacgcacggcgtcaatcacaataccggcggaattcggggaatcccacacctgcagcttgtattccaagctcagcggcacatcgccgaacgtagtgccttcaagacgcacgaacgcgaacttgcggtcgtcaagccatgccacgtaatcggacggaccgatatgcacgttatgcggatccatatcgtgcggcaccacggaagtgacggcgcgggtcttggaaatcttcttggattccaggcgcgagcgctgcagcatgttcatgaaatccatgttgccgcccacgttgagctggtacgtgcggtccagacgcacgccacgatcctcgaacagacgggcgagcacgcggtgcgtgatggtggcgccgacctgggacttgatatcgtcgccgacgatcggcacaccggcgtcacggaacttctgagcccattccggatcggatgcgatgaacaccggcaggcagttcacgaacgcgcatccggcgtccatggcggcctgggcgtatgccttgtcggcctgctcggaaccgaccggcaggtaggaaacgagcacatcgaccttcttgtcgcgcagcacctgggccacgtcgaccggctcggcgtcggactcttcgatcatctggcgatagtattcacccagaccatcgttggtcgggccgcgcagcacttcgacgcccagattcggcacgtcggcgaatttgatcgtgttgttctgcgacgcttcgatggcttcagacagatccttgccgaccttcagcgcgtccacatcgaatgcggcgacgaattcaatgtcacgcacgcgatatccgccgaaattattgtgcatcagaccgggaatcttatcctcgtccttcgtgtctttgtagtattcaacgccctgcaccagcgaagaagcgcaattgccaacgccagcgatagctacacgaatgctcatctgtaaacgactcctctgttatatatgcatatatgcgtttcacaggtaccaaatttcaagcatacctgcgaaacagcgaaaaggcacctgaaaaactgataaaaccctgaaaataagccgatattgagacaacgacccacaaactgtcgatttgtaaaagagctgcgcaaaaaatgccctcccaagggcaaactcaccccattttcacctgatttctcaagtcaatcagctacggtggaacctatggtttcacacacacgaagcgtaagctcacgctcaagaagcgcccgcagcggcggcgccggcagcaatcgcagcaacgcatcccatagcgcgcccaagccgcagaaccacggatcgcaccgcgccaacggacctcagaaaaagcagaacaagcgcaagcatctcgtgctgaagtgggcactcggcatcttcgcagcgctgctcgcggcaggaatcggcctgttcgcatacatgtatatcaccacggaaatccccgaaccggaaaagttcgccctcgccgaaaaaaccaccgtctactatgccgacggcactacggaaattggcagctacgcggaacagaaccgcgaaatcatcgactgtgcggtattgccggattatgtgggcaatgccatcgtcgcgtcggaagaccgttccttctacaccaacaagggcatcgatctgtatggcatcgcgcgagcgctgtatacgaatctgaccacaggcagccgtcagggcggttcgaccatcacccaacagtatgcggaacgctactatttgggcgaaaccacgtcgtattccggcaagctgagggaagcgttcctggccatcaagatcgcgcaggcacaagataagagccaggtgctatgcaattacatgaacacgatttatcttggtcgtggcgcatatggcattcaggcggcggcgaaggcgtatttcaacaagaacgccagcgatctgaccttgtcggaagccgccatgttggccggtatcattccggcgccgagctcatgggatccggccgtcaatcaggaacaggccgaaaagcgatatgaccgcgtgctcagcatcatgaaggaagacggctacatcaccgcccaggagaagaaggaagcgcagttccctgccgtggcggaaatacagcagagcaaccagatggccggcgcgaacgggtatctgctgaccacggtgaagaacgaactggtcaattccaaggcgttcaccgccgatgatctggaaaccggcggctacaagatcgtcaccacgctcgacaaggacatgcaggacgagattcagcaggtcggcgacacccgaccggagggcatgccggaaagtattcaggtgggcggtattgcggtcgatcagaagaccggttccgtgaaagccatgtatgcgggcaacgattacctcaccaagcagctcaacaacgccacgcaggccacgttcgaaccgggttccaccatgaagccgttcggcttgctgggagccgcgcaggagggtgtgaatttcaacaccatcttcaacggcaattccggcctgacgtttgaaacgacgccgggaaccaccgcgcaggtgccgaacgcgttgaacaccaattacgggtatatcaacctctatcaggcgaccgcgaattcggtgaacacggtgttcatggaggtcaacaagcacctcggcgccgcgaatctcgccaagatcgcgcatcaggcgggcattgaggaagacatcgccgaagacaccacctacaacattctgggcatcaacggcattaccgtgtgggatctggcgcaaggccactccaccatcgcgaacgatggcgtgaagaacacgctgcacatcgtcgacacggtgctcacgtccgacggttcgaaggagctgtacaagacggctcaggagaaccagcaggtgttcgatgcgaacgattgccatctggtgcagaaggccatgcagggcaccaccacgtatggcaccgcggctggcgtttcgacacgtctcggacgtcaggtggccggtaagtccggtaccgcaaacgacgagaaggccgcttcgttcgtgggctacacgccgcagctgctcaatgtgtgggccatttggaatcctgcggaagacggcagcgcgcaggaagtgccatcgttcgcaggctatggcgtttcctccacgggctacccgtcgcatctgttcgaggagttcatgtcgctcgcattgcagaatcaggaggtgctgaccttcaccgaaccgaccgacaacggcaagatcggcggcccggacggcacatggggcaccggcgcgcagaagaccgagacacggcagaatcaggagatgccgaaggccgaagagaacaccgagcagaccacacccgatcctacgcaaaacagcgatcagaacagcggcggtaacggagacggcggcaactccggagacggcggagacggcggagacagcggcaataacggcggagacggcggagacagcggcaataacggcggagacagctccggagacggcggcaacggcggcaacagcagtggcgacaactccggagacgaccagtcaaacggagcccaataaccgtcgcaacgaccgtcggcggcaggcaagacacccactcattgacggcaaccgacgccagccggaacggcaaccggtaaagcaaccgcaaaaacattgtggcggcaacgaataccatcgttgccgccacaatgcgtatcagcatcctccaatcaccggatcgccatggcagacgcccccggacggtcagtcgtctgccatatcgcgattttcatcgctgcaatcctacttatgcaatcgtagggcggtgattttcgcgccgtcatgcgccgaagccgagatgcgtacgatcgcagcgtcgtcagcattgtcgttttctccggtattctcaatattttccgcggtttccgcagtttctatggcatccggcagcggatacacgtcgattgccgtgggatcgccgtcgatgcgacgatgctcgccacgctgcaatggcaggccgtcgagcgtcacttcatacgccgcgttttcaccgtcgctttccgcggaatcggcaatcacctcgatttccaaacgatgcgcctgaccacgcccgcgcatcgcatactggaattcgccaccagccaacgcgcgacgccaatgcaacgtgccgtcggcacccatcatgtcgttatcgcccgaataccgatgatcgacttccgattgctgctgaccgcatgcgatggtgtcgacaacggtctgctcgctagcggcctgacgcgcatcgatatcggccagttgcgcgcgcaacgcacacacgttgccatcgtcggcaaccggcagatacacggaataccggcagccatgcatactgctgaactcatgcatgtcgaacagcatggtacggccggaaacgtccgtcgcggcaacggtgaggccatgcacgtacggtctggaaacctgcgcgcacgccttgaccggattgccgttgatgatcggcatggatacgagcggacgcaacggaccggtggcaatatgactcatacggccggcgtccgcgaattcgccgtccatatcgtcgctatccgaagccagcgccattaccttcggccccttcatgaaactgacccaaggcgaaccgtccggcatacgctcgacggtgatccgcggccgcaaccgcatcaccacttccgcaacgccgttccagcgcagacgcaacggcagatatccttcgggaatatcgttggtgcgtgccggatcaagcgtgcagacggcgcatgtggcctccatgacgccgtaatgctccgcccaccacggacggcgcagaaacagcgtggtttcccgcaaaccaccgggagtatcgggaacatgctcggccgtggattccaatgtgaacgtcaccgtgtaatcgacgccatcctcaatgcgagcggcgcgctgcgtgatgcgcagaccctgccccgggcagtcgaaggtggaatcgatgtacagattgaccagcaggcgcgtagcttccgcctcggcattgtttgaaacggtattgcccgtctcggcggcagaactggcaaaaccagcagcagccgaatcagccgaatcctgcgcagccggccgctgcagcgcgtaaatcaatcgtccatatcgggcgtgattctccaatcccgaaccgacgcaacaccagaagcattcctgaggtgtggaataggcacgataatgctgcgatcgcatcggcgtgaaatacacgaatcccggctgcttcggattgatggtggacagcaggtgattttccagcacccgctcgtagaagttgatatagtcggcgctgccggaacgcagccacagtcgttccgcaagtttcgacatgttgtacgaattgcaggtttccgggccttctcgcgattcgatcatggatgaaaaatcgtccgtcgggtggaaatgctcggacacggaatgcgcgccgatgcttacggaacggtgatgtaccacggaatcccagaaggtgttagtggcggcgtcggcctgttcatcgttgcaaatcgcgcccaaacgttcccatccaagcactttgggaatctgcgtgttggcgtgcatgccggtgagcacatcctcgccttgcgccagcgggtcgaagatggcgtggtctttgaagcggtcggccatcacatggtagcgctcctcgccggtacgcgcgtacagttcggcgaacgattcgcacatgccgccgaattcgctcaccagaatcctgtcgaaggtctcgtcgtccagcggctcggcgatacggcaccaccaatcggccagatcaagcacgacggtacgtgccagctgcgaagtctgttcatcgatagaagcaaaatcggcccatgtatccaacaaaccggcgaacgttttgtgaacgttatacatgggcacccatgcgtcgttcatcgagaaattctgcgattcaacatcgcctacggcaaggcgcccgaacacggtgcgagaatcaggcacaccacccacatacccgcgcatcacagcatcgccggcaaacgactgctggcattcatgccatgaccgcaccacggtggcggcgcggtcgatgaacggttgcggatcgtctgcgacttgcgcgaatccgacgcaagccgacagataatgccctgcgatatggccgtcaagccccgtttcctcccaattcgggtacgacgttaccggattgccgtcggcatcggtcggctgcggcagtcccgcctccctgcggaagggatatagcaggcgatcgacgtcgagatcaagcaggtaccgcgcgccggcctgctgcgcgtcaaaatgttctcctggcagtagcctcacctgctgtagggggacccgttcgagaatatgcgaagtcatatgcgcgctcctttgcgtcgtctacatacgtgtatcgaatacgtgtacaaacgttttttacgagaatacagaacaaggccgccaccgtggggaggagccacgccgacggccttgttctatgcaccaaacggtgcggttatcgaaggaaggaaaacaaggttcaattatggattttcaattatggattgtttgatcaggcgatgaagttgggctttacttcatgccggtcatggcgatgccttcgacgaagcgcttctgcaccaagaagaagaccaccagcagcggcagtgcggagatcagggcgcctgccatcaccacgccgtacggggtgacggaggaaccgtggccggtcagcattgcgaggcctgcggtgatggtgcgggtctccggcttggaagtcatgatcaacggccagagcagatcgttccagttgcccatgaagttgaacatgcccacggtgaggatggccggcaccgcgttcggcaggatgatctgcgcgaagatgcggaattcgcctgcgccatcgatgcgggccgcgttgtcgaggtccttcggaatggagatgaagaactggcgcagcaggaagatgccgccgacgtcggccatacgcgggatgatgatgccccagtagctgttgatgaggcccatgttggcgagcagcttgtacaccgggatgagcagggccatgcccgggatcatcatggtggcgatcagcacgccgagcagcaggccacggcccttgaagttcacacgggacaggccgtaggcggccagggagtcgaagaacacggagatgatggtcacggcaccggcgaagatgacggtgttgagcatttctcggccgatcggcaggcgtttgaacagcgactggtagttttcaagggtgaactggctcggaatgagcttcggcggccaggtctgcgtgatggcgttcggggtgaacgacaccagcacgacgatcagcagcgggaagatcatcaggatggtgatgaggatcaatgcgaagtagctgaagcccaggccgatgcgacgcttgcgggtcgcctgcttgcgaagacgctcgttttcggcgttgatgcgggcattctctcgctcttgtgcggaaagagtcgcggtgctcatgcgatttcctccttctcatgcttgttgttggtgtacagctggatgaggcccacgatgagcgtcatgatcagcagcacgtacgacagtgcggatgcgtaaccgagcttgccgttgccgaatgcctcggtgtagatgcggtacacgatggtttcggtggcgcgtgccgggccgccggaggtcaggatgaagacctgatcgaagacctggaaggaaccgatgaggccgaagatgaccacatagttgaaagttgggcgcagcgccggaagggtgatgtaacggaacttctgccatgcggaggcgccgtcgagggaagcggcctcatacagttcggcggagatgccctgcagacctgcgaggaagatgaccatgaagtagccgaagtttttccacacggtgatgaagacgatggccgccatggcggtttcgcgggtgccgagcagatcgacgtgcgcgatgccggtcagctgctggatccagtacggaaccaggcctagcgacggggagaggatgaactgccatgcgatggcggcgacggtcagggagatgacgaacggcaggaacatgcaggtacggaagaatccgacgaacttgaggtccttgcggttgagcagcagtgcgaacgcgagtgcgacgatcacgacgatcggagcgtaggccactgcgtagacgagggtgttcttgacgtcggtccagaagtcggcgctttggaacagcttgacgtagttgtcgaagccgacgaacttgccggcgcggttgatgcggtcggaagtcagagacgtgatgaacgtcttgattgccggatagaaaacgaagattgcgagaacgatgagagccggtgcggtgaacagcaggccggtgcgcaggttgcgggcctgaatcgccttcttgttctccttggccactgcggaatgcgcggatcctggggcggcagttgcttgtgccattatctcctccttaatgccaccagggatgtgtttttaagacagcaaagaccacgtcgctggcgtgagggccagcaccgtggccttttgctggggtggtgagcgggtcaggcccgctcacttatgttgattgtatgtgaatcccgcttcgatcactcggcgtactcgtcgagatagccctggatctgggattcagcgtcatccagcagaccctggatatcgtcgtcggtacgggcggtattggaggtcagggtgtcgacggaggcggcgatgtcgccgaagccgcccttgaggcctgcaataccgatgaaggacttgctggtgttctcaccgatcttggcgatcagcggacgctcggagagctcatcggcggtgacggtggtgttgttcggcgggtaagcggagccaagggaccaggtcacctggttgtcgtggttgttatagaacttgaagaagtcgtagatgccctgcttcttagcggagtcgccaacctgggaggtgacccaccagtacagaccggtggagccggtgttggagcccttggtgccgtccgggtacacataggtgccgtcgccgttcggaaccgggaacaggtcgtggttgatgcccttgtcggtggaggcctgatcctcccacggtccgacgatcaccattgcggactggccggattcgaaggattcacgagcagcggtctcatccatgccggacacggagtagccgcctttgtagaagtcacgcatcttctcgaggaaggccttattctccttggtattgatggagaccttgccatcggtggtgtagatgccggagccattgcccttcaggaacggagcccagccgagatccggcagagcgatgccgtactgggagccatcggacttggtgagcttcttagcaacttcgagcagctcatcccaagtctgcgggtagtcggcgtcagtcaggccggcggactcccacatatcggtgttgtaccacacggcggtcggggcgtagcccatcgggacgccgcacttctcttcggaaccgtcgatgttgaaggtgatctggtcaacgacgttctcgatgtactcatcggtgccgttgtccttgtcgtcgtagaaatcggtgacgcactggaaggtgccgtcgatggaccagccttggccgttgtcggcgccggtggtcacgaagtccgggccgtcgccggaggtgaccttggtcaccatggtctcgccgatggtgctccacggctgcagctgggcgtcgatctcgtacttgtcctgggacttgttgaagtcgtcgacgatggactcgagggtcttgccatcggcctcagagaagccgtgccacatcgtgatcttgaccttgccgtcagcggtcgtctcgacgtcgttgctgccgccaccgcaggcggacaggccgacggtggccatcatggccagggacgccgcggccgcgagagccttggtgctcttcttgatcttcatggatttctccttttcttcttggtctcccaagacatttcctccaaccgttgcagtgacattcatcaacaaccttgtttgcgatgtcgttcacgcttcgtcagctgcactgccgtttgcaacgttgtaattttgattatacagcttttccatcgttgtacaaatcggaaacacgccgatggaaaagctgttttctttataatcttcaattattcgtttttgttggaatcgcaacgtttcttacgattacgcaagtcagttcgctaccggcgttcccgcaagagcgccgccgtcggccggcaacacatccgtcgtgtccggagtccacagattgtcaggttccggcacgccgaagtcggggccgttctccgtccacttgaccacgccgacacgggcatgacgattcgggtcgaacagcggatcgcccttgatttccgtgtagttgcggcaatggtagatcatcaggtcttcggaatcgtcctcggacttggtgaacgagttgtggccaggaccgtactggccgttttcggcgcaggtcttgaacaccggcaccgggctcttggtccaggaatccttgctcagcaggtcgctgccgcgctcggcggtcagcagaccgacgacatacggcacaccggtgccggaggcggaatacgtgatgtagatcttgttctcgtggaacaggaaggccgggccttcgttgacgaggaagtcgatgcactcccagtcatattccggcttggagagcatgacgggctcgctttccagcgtccacgggttggccatcttggcgatgtacaggttggaattgccttcgatcgcgggatctttctgggcccacaccaggtactgcacgccgtcgatcacctcggtggtggcgtcgagcgcgaaggagtcgatcggagtgacgatctggcccttctccacccagttgtcggtggtggggtcgtcatcggtgttctccagcacaaacatacggtgggtcggtaggccggaggcctcgaaatccgttgcggcgcctgcgaagtagatgtaccaagcgccattgatgcggtgcagttccggcgcccaaatatagatgctcgccggtccggactcatgcttgcgccacaccaccgtttcgggggctttctgcaggtcgttgatgttcgatgcgtgacgaatggcgatgcagttgtattccgggtcggagccagtgaagtagtactcgccgtcaactttgaggacccaaggatctgcgcgctgaagcacgatcggattgttgtaaacagccatgtctattccttttcaatccgctgttccagtaatttacaacgttgaatatatcactattacaacgttgtaacaaatcggaggaacgcaccgcgtgtttctcgcatccgactcctcggaagaatcgaatcgcagtacccggcaacagacaatcgccagaaagggaaaacaaaaacctcggcaccggcaatccgtaaaaaaccggacgcaagcgccgaggcaccaatcacttccttccttccaaaagaagaagaaaaagaaggaagaaaaatcacaccaccaaggaattcgtaggcagcttggtggactgacgcaccaccaacgacgacgaaaccttgcggaacaccttctgctccggcttgagatccttcgacggcgaaaccccgtcgatacgatccttcagcaatttcaccgacagacgcgccaccgcctcaagaccgggagcaatcgacgtcaacgcaggagacaaatactgcgaatcgtcggaattatcgaaaccgatcaccgaaatatcttcgggaatgcgcagattgtgcatctggatcgcatgcatcacaccggaggcgagcatgtcgttcagcgcgacgacgccgtcgggaaccacgccggaatcaagcagcgcgttcatcacgcgcacgccatcgctacgatgccacatgcccgactcgaccaccaaacgctcgtcgaattcgacgccggcctcttccaacgcctcaaggtagccctgatagcgcagcgcggcggagccgaccttctcgcccggatgcacgccgaccacggccacgcgcttgcaaccggtctgcagcagatacgacgtggcgcgcttggcaccttccacgttttccgtggcgatatggtccaccttgtcggtgaagatgcgttcgccgacaagcaccagcggatagtccacgtccaattggtcgacatcatcctgatcgagttccaatggactgtagatcaggccgtcgatcatcgtctgctgggagccgtgcagcgcctcgatctcgccttcgcgcgagtattgcgtcggctcgacgatcacgcgcaggcccagcttcttggcctcttcgatgaccagtgacgaaagctgcgcgaagtacggcatctgcagatcgggaatggcgaggccgatgatgccggtctgccccctgcgcagattgcgcgcggacatgttcaacgtgtagccgagctcgtcgatggccttgttgaccttgtctcgcgtggcctgcgacacgaactcgtagtcgttgaccacattcgacaccgttttgatcgatacgccggccgccttcgcgacctcgcgcatggtcaccatgtgctcgccgttggcgccattctgcttcggcatgtcaaccccttttcaccaaaacgtctcatacattcggccccaacaccggctttcgccccttgcggcgctgaagccaacggaatcagcctttattgccggaaaccacgattttcatcgttatatcagcatagtccggattgagctcttccgccgcctgcatgtccagtatcggcataccctccttggaccagtgcacgcggcgcacctgggcgtcgcggccgccataccgtccattctcgtattccgcattgtgaaatacatagatgagattgccgtcctcgtcgttggaccacatgccatggccggtaccgagctgccattgctcgttgtatactccggatttctgtagcggatagtcgagcttcgtccacacgttcggatcggtcaggtcggcgttctgcccagccggagcggtgaccagaccggtggtgtagtcaatgccgaccagcgagccggaataaatcaggtagatcgtgccatcatgcacgatggcgttcggaccttcggcgatcatattgtcccacgcgaattccggcacaacgacctgcttcggctcgcaggtaagccgttccggacaggccggatcgaagctggcgatccaaatgctgccgacctgctgccacgcgtaataccagcggccggaatcgctgatgacggtcatgtcgagcgagatacgttggatgggattgagcacgccgccggtcggtgtgagaatcggcttcggcaccgtccagttttcgggttcgcgcggatcgaaatccgtgccgtcggaatgttgcttgagctgcatgatatggcagctgcccgtccacatgtccggcttgcctgcgcgttcgttgggcgtgccgtctggattggtggccggcccatcgaagcatggcatgaagagcaccgacagttttccatcgatgacatgcagttccggcgcccagaagcagccggtcatggcgcgtccttcagcgttgtaatcaccgcatttgagcagatcgatttccttggcacggccgcccgccgcgtcggaaagcgcttcgatggagtcggcgatgcgcaacggcatatgcgtggcgccatcgttcggatcgacgcagttgccgtcggtatcgtcggtggcgatgaacatgaacatcggcttgccgttgaaattccaagcgaacaccgacgggtccgcacgctccacggcaaatggcaccgggtatacggtttggcggatgcggccgctcaccgtgcgcgtgtcgcccggctggaacttgccttcggcggcgtcctgcgcaatcgcctcaagttcgtctttgttccaatccacggcacgggtggcaccagaaccgtcgctgtagacgagatcggcgcggaccttggcgagtgcctgcacggcttcacgggacgcttccctgcttgccgccatgtcgatatgctgcgtcgccaccgatgtttcaacgttgtaaatacgaccgaatcgttcgatcagtttcgacgcttcttcttcagtgacggcaatcacgttgccaggaatggcattgggaatattgcaatcgcaggaacggcttgattccgccgttaccacagcttccgcaatatcgatcggctcgccggattcggccacggcgacaatatcggcaacggtcgcgacatacgatttgccgtcgttcgacgtccaggaaatcacataacgggaggcgtccgcgtcgaatgcgacagacggacgattgacgccaccgccggtacgcagcatcaccagtccaagctgcgtgaaggaggtcagatcgtcgctgacggccaacaggaacgccgatcgctcggagccatccggctcgccgccgcgcgcggtacgggtggcggcgagcgctaatcggccatccgcaaggcggaacagatacgggttcttcagggatttcagcgtgatgtcgatccccggcatcaccgcgccatatgcgacggcatcggtggccggatgcgcctcatcgaacggatcggcgacgaaatgcgccgccgcgacgcacgctcggcgcgactcggcggtggcggcctgaataggcacgccggcggcgaagaaaataccgtaattctcgttgagcggctcccattgggcggccccatcggcacgcaacgcaaggtgcatgctataggcgatgtcctcattattcgccttttcacggccggtagcttcgcgcgtgtagcacagcaattcgtaggaactcgacatcgagaaaccccttatgattcgacttttctttacaacgttgtacactatacaagaaattacatcgttgtacaaatcaatgtcatccgcaaggaaggggaaaaatgaaattccgtacaacagcaaagcagatcgcggcaggcatcatcgccgcagccatgctggtcggaacgctcgccggatgctccggcaattcgacgaagcaatcgtccgcatcgtcgaaagccgaaaccagcaccgccagcatcaagcgcggcgaatcgcatgatccctccatcgtcaaagccaacggaaaatactatattttcggctcgcatcgcgcttggctcaaaagcgacgatctgatcaactggagcaccttcaccaacaatctgagcaccgactacgagaagatcttcaaagacatttgggacggctgggcgaagcagtcctccaatcctgacgtcaaaggcaacatgtgggcaccggacgtgatctggaacgagaccatgggcaagtggtgcatgtacatgtcgatcaacggcgcgaactaccgttctgtgatcgtgttgctcaccgccgacgacatcgaaggcgattggacgtacgttggcccggtggtctattccggcttcgaacgcgtgaacgtgaagaagaccgacgtgccgcaggtgcttggcgaggatgccgacatcacccgttacacctcgcagaccgacaccggcatcaacgccatcgacccgtgcgtgaaaaccgatgacaacggcgacatgtggatgaccttcggctcctggttcggcggcatgtggatgttcaagctcgactcggcgaccggcctgcgcgactacaactccacctaccccaccgaagcgaacaagtccgacgcctactatggcgtgaagctcggcggcggcttcggcaactccggcgaaggctcctacctgctgcacgacaacggctactggtatctattcgcctcctacggcgcgctgcagcagaccggtggctaccagatccgcatgttccgctccaaggacatcaccggcccgtacgttgacgaagccggcaacaccgcgatttccaccaaggccatcggcaacaactggcaaagcgacatcggcgagcgcctgatgagctcgatccagtggagcggcaacgacaacgcgaacatcgaagtctcccagggccacaattccgcgttcgttgacgacgacggcaccgcttacctcgtgtaccatacccgtttctccggttccggcgaaaagcatgaggtgcgcgtgcacgagctgctgccgaccgccgacggatggctggtggccgcaccgtacgaatacacgggcaccaaggccgacaagaagggctacaagaccgccgacatcgccggcgattacgagatggtgacgcacgacaagtccagctatttcaagggcccgaagaaggtcaccgataagacgagcaccgtctatcgcggcgtgaacaagcccatcaacatcaccctgaaggaagacggcaccgtgaccggcgaccagacgggcacttgggaggccgtggaaggcgccaaccagatgacgcttaagctcaccggcgacgagggcgaagtcacgtattccggcgcgttcgacaagcttccgcgagacaaggatcgcaaggcagtcatgaccttcagcgctctgggcacgaacaatctgtgcatttgggggtcgcagaagtgagtgaaaacggcgcaacaaccgtgaatgctgcagtgcaatcgtctgcagaaccactatctgcggcaccggccacctcgcccaacggcatcgagcacacgctcgccaacggtcgggtggccgtgcacgatcccgcaatcgtcgaggaaaacggtgtctactatctgttcggcacgcatcgtcggtgcgcgcgcagcacggatatggtgcattgggagcggttcgataacaatctgagccgcgacccgtacgcgctgctcggcgatatttggcaggcatggccgaaacaggattccaatcccgacctgctcggcaacacgtgggcgcccgacgtgatctggaacaagaccatgggcaagtggtgcatgtacctgtcggtgaacggcgaccagttccgctcggtgatcgtgctgttgaccgccgaccatgtggacggcgactggacgtacgtggggccggtggtatattccggtttcgacgagagcaacctgtggaacaccgacgtgccgaaagtgctggaacttgagcccaaaaccgatggcaccgtcggctatgacctgacccgctacctgtcgctcaaagacacgcgcatcaacgccatcgacgcggcgcccgcattgtgcgagcacggcgaaatgtggatgagtttcggttcatggttcggcggcatctggatgttcaagctcgatccggaaaccggcttgcgcgattattccgtgcgatacccgctggtcaaggattcctccgatccttattacggcgtgaaagtggccggaggctactggaattccggcgaaggatcgtacttcattcgtgaaaacggatggtggtatctgttcatgtcgtacggctggcttgggcgcaccggcggatatcagattcgtctgttccgttcaaaatcgctgcttggcccgtacgtggaccagaacggcaatcccgcgatttcgtacggtgagattcccgacaatcaggagcgcggcaccggcattcgattgacgtcttccgtacagtgggatggcggtccggcagaacttgccgatgtcgaagtctcgcaggggcataattccgccattcgtcggtcgaaggacggtcgcatgttcctcgtctaccacacccgtttcgcggaacgctttagcgagggcgatgatgaagattacgaatctcacgtacgcgaattactgccgacttccgacggctggctggttgcggcaccgtacgaataccgcggttccgttgccgtcgcgccgaccggcattgccgatatcacaggcgattacaacgttgtactgcatgatcagcatacgttcttcaacggcaagcaagaggatgatggcacgtacgttggcatcaatcgtccgacgcgatatacgttccatgaggacgggcggatcacccggggtgaaatcgtaagtttcttcgatactcccgacgcgaatctgccgaggtcgacggacgggccgatcacctgcggatcgtggaaaccgctttccggcgccgtgaacggattcaactgttgcgcaagcgacgcggaaatccgattggacgacgtgacctacattgcacggttcgcaacactcccccgcgagatcgacggcaagccggtcatgacattctccgcaatcggcaacaatgtctgcatttggggatcgcaatcctgaatttccgagtttccgaataatccggaaaaactggaaaatccggaaactcgggaatcctatgaaatcaaaaagcaaagggcttgtgacgtactcgcaagtacatcacaagcccttcagctacgagaaccgaaaacccgcggaaatcagcgctcggaacggttgatggccgaaataatggccttcaacgagctggtgacgatggacgtgtcaatgccgacgccccacacgatccgcggatcctcttcctcaccgatctggcattccacgtaggaggcggccatggcgtcggtgccgacggacatggtgtgctccacgtaatccatcacggaagcctcgatgccgaagttgctcagcgcgttcaggaaagcggcaagcgggccgttgcccatgccggaaacctcacgctccaccggctcatcaacgccgacgttcacgccacggtcaagaatcctggccttcagcacggtatcggaaccatcttcaccggacgacaccgacaccttcagcagcttcagacggccccactgctcgagggagtcgtccttgctgtcgccgaccacggcaccagccgcagtagcgccggactcttcgaccggcagatactcgtccttgaacagacgccaaatatcctcgtccttgacttccttcttggtctcatcggcgtacgcctgcacaaccttgtcgaactcgacctgcagacgcttcggcagatcaagattgtggttggtcttcagcaggtaggccatgccgcccttgccggactgggagttcacgcggatgatggcctcgtacgtgcggccgatatccttcggatcgatcggcaggtacggcaccagccacacgaagctgtccaaatcggcaccggcacgatcggcggccacctgacgagcctcaagacccttcttgatggcatcctggtgagaaccggagaaggcggtgaacacgaaattgccggcatacgggtgacgctcggaaatcttcagctggttgcagtactcaaccgtcttgcgaatctcaggaacgttggaataatcgatctgcggatcgatgccctgcgtgaggaagttcagaccaagcgtgaccagatcgacgttgccggtgcgctcgccgttgcccagcaggcagccttcgacacgatcggcaccggcaagcacggccagctcggtggcggccacgcccatgccctcatcgttgtgcgggtgcagcgacagcaccacggcgtcgcgcggcaccagattgttcgacacgtattccacctgatcggcgaacacgttcggagtggtcatttccaccgttgccggcagattgatgatcatcggatgctccggagtcggcttgatgacgtcgatcaccgcattgcacacctcaacggcgtactccggctcggtgccggtgaaggattccggagaatactcgtaatacaggtcgatgccctgggcttcgccctcaagctccttgcacagggtggccgcgtcggtggcgagcttcttgatgccggctttatccttgcggaacacgacctcacgctgcagcacggacacggagttatagaagtgcacgacggcgcgcttggcacccttcaggcactcgtaagtcttgcgaatcaggtgctcgcgagcctgcgtcagcaccacgatcgtgacatcgtcaggaatgagctcacgctcgatcagcatacgaatgaaatcgtaatcggtttcggaagccgacgggaagccgacctcgatctccttgaagcccaacgacaccagcagattccagaaacgcagcttgcgctcggaatccatcgggttgacgagggcctggttgccgtcacgaagatcgacggaacaccaacgcggtgcacgctgcagtcgcttgcccggccacgtacgctccgggtaatcaaacggcacctgcttatcgtatgcgacgtacttgttgtacggcatcttgctgggcttttgcggagctccaatataacgcgccggaggcagcagcgggtcgttgttccctccgttggacgctgcagccactgccgcgagatcaaacactgaagattgatcctgacccatcactcctccttatctgtaaagctgggcaggccttctgccgacccacattgttacgtgcatgttacctacctgcactgccgcccatagtagcggcaaccaatcccatatatcgccggcattccgccatatgacggacagaccacgattttcgtctctttttcacctcatatccaaatttgccgcattacagtgagcatcatgaccttgcgattcaacagcgacggcaccttccgtgtgctgcagatggccgatattcaggacggaccaaacgtgcgcgaagacacgatccgtctcatcgaagccgccatcaagaaaacgcatcccgatctgatcgtcttcaccggcgaccagattcgcggatacgaccccgcgtacatcgacacgttcctgcgccgtcgcggagagcagccgggcacgcacatacgagcggtcaccgaaatcgaagcgaaaatccgcggcatcaaacgccatccgctcaccaaagcgttgcgcgcacagcccccgaccgacgataattggatgattgacggcatcggcaccgactcgccgaaactcgtgaaacgcaacaaacgcgacgggcgcaacggatccgccaacaagcttgaatcatgggcgcaatccatcaatcgcgcgaccgccgcgaccatactcgacagcacgcggcagaaagtacgagacacgttcgcagcattccttggacctgcattggaagcgcgaatcccctttgccgcaacctacggcaaccacgatttccagtgcggcattctcgccgacgaacaggatgacatctaccgagagttttccggttgcatgaatcccgttgccgggtcgtctcctttggcgctcgaaccaggcacgtttgcgattccgatcgaggcttccgacgggtctgggcgcattgcgatgagcgtgatgatggtgaattccggcgattatgcggataatgcgtttgacggcgatcgcagtaattccggcgatcgcgagcatgctggggatactggtaaatccggcaatactgttggcaatgctgcaggagaacgggaatcgctgacatcctacgcaaaatacgcgtcgaattcgcgcggatgggatttggccgattccgacggctatggcacgccttcgccggaagcgatcgaatggctgaagcaagtgcaacgcgagttgggcgagcgcaatggcgacggtttggcggttccggcgatcgcgttccagcatattccgccgcaggagttctacgattgcctgcgcgaggtgcccgcatacacgccgaatgcggtggagggtgcgcgaacgttcgcagggcattgctatgtgttgaatcgtgacgtgtgcagacctggctcgaggcttggcgaggcgatcggctgtgcggatgagaacgttggcgaagtgcaggcattgcgcgatgcgggcggctatttcgcgctgttctgcgggcatgaccataagaacgcgttcgtcgggcacgtgcatgacattgatcttggctacgcgccgacctgcggctttgaatgctatggtccgaaatcgcggctgcgaggcatccggctgttcgaattccgcgaaaacaatccggtcagctacgtgacgcgcatgctcacgtggggcgacttgatcgggcgctactccagcaacgaattgcgcgtgttcttcgaagaccattgcgtgaccgatctgatcggcatccgcaacgaattgcgccgcccgcaggtcaccgccacactgctgggcatcggatcggtaatgtgcgccgcagccggccacgccatcgccaaactattcaagcgctaggtgcggcgacgcaaggcgtggccgtcgcaacagtcggacaatcgccaatctgtggaatacggaaaatctgtggaaaatctgcgaaatatcagcagaacgtcagtggaacaaactgacgccgcgacgagacacgcaaaacgcgttgccaagccaagtatgacgggaattcggccataccgcacccaatcgtggcgcgttctggctcatccaaatacttgggacgcgaccatccgcggaacgcgatcccaacaaattgaaaccgttcttctccaacaaccactccggatgctgcgtggcaatcgcaagtccctcttccaacgtaagcggcaaacgctcgtcggaatcgatcaacttgcgcgctacatcgggctcgcgattgatgtagcaggtgccggtatgcggttcgaccaccaggtagaacgggccttccggaggttcgaaaccatcctgcggaaggaaactggcgatatcgcgcggcggcatggtggtgaatcctgccatacggttgatggaagtacgggcaatcagggattcaggagacaccagttcgcgcgtaggcaccaacagaatctgcgtgcccaaatcggaatcctccagcgcacggatgatcgggcgtgccaaagcacggaacgcggcggccgacatatcggccacatccggatagcccaacgccacgatacggtccaactgcttttgcgcttcttctgatgccttcgacatggcttccagtgtacgcgagcgatacgtccaaagtgcgaaaagcctcacagcccgcacaccgggacttgtgcagacgacgcatcagcacagacaatcaggccaaccgcgatgtcctgttactcgttactgcagccataccaatagtgcacgtcattctgccacacacaacaatcgccaaacgcatacttggcgcagaccagcatacggataggagaacatgcttgttccgcggatttcgtaagattaaacaacgcatgtggccgtccacgaagtcgtttggggccggctggtcgacctcaagcgtgaaatcatacgaaaccgttccagcataagcgagaggttgttatgtccgaaaagattaaggtcggcattctcggagctacgggcatggtcggacagcgcttcgtcacgctgctcgaaaaccatccgtggttcgaattggtcacccttgccgcatccgcgcacagcgccggcaagacctacgaagaggccatcggcggtcgctggaagatggaaacgccgatgccggaattcgtgaagaacatggtcgtcaagaacgtggccgacgtggaagacgtggtcaaaaacgtcgatttcgtgttctccgcagtgaacatgccgaaggctgagattcgcaccatcgaagaggaatacgcgaagaccgaaacgccggtcgtgtcgaacaacagcgcccaccgttggactccggacgtgccgatggtcgtgccggagatcaacccggagcattatgaggtgattgaacaccagcgcaagcgcctcggcaccacgcacggcttcatcgccgtcaagccgaactgctccatccaggcctacaccccggcgctcgccgcttggaaggaattcgagccgcgcgaggttatcgtgagcacctatcaggccatctccggcgcgggcaagacgttcaacgactggccggaaatggtgggcaacatcattccgttcatctccggcgaagaggagaagtccgagaaggaaccgctgaaggtgttcggccgcgtcgatgaggaaaagggcgagatcgtgccgttcgacggcccgctgaagatcacctcgcagtgtattcgcgtgcctgtgctcaacggccacactgccaccgtgttcatcaacttcggcaagaacccgaccaaggaagagctcgtcgatcgcctggtcaactacacgagcaaggcttccgagcttggattgccgcatgcgccgaagcagttcatccagtacctgaccgacgacgatcgcccgcaggtcaagaaggacgtggactacgagggtggcatgggtgtttccatcggccgtctgcgcgaggattccattttcgattggaagttcgtggggctcgctcacaacactttgcgcggcgctgccggcggcgctttggaaagcgccgaaatgctgaaggcactcggctacatcaccaagaagtgataacgatctgcatatgttctgcagttacgcatgatcatgcatgattgcacatggtgatatctgatttctgcagaacataatattgcggaggattgttgattattcagcaatcctccgctttttcatttgcagattatctgaaaaaaatatctgtaaaacagatatgggaataaaaaagacttggctgagacgcctcaagcaatccagtcaagtcttttttcgattgttattgcgcggtattgcgtcagcgaccagtaccgccatacaccacggcttccacctgctcggcatccaagccgtaggcagtgtgcagcgcgcggacggcgtcctgcagctgctcgagcgggaccagcgcggcgatgcggatttcggacgtggagatcatcagcacattcacgccctcgtcgctcagcgcgttgaagaacttggcagccaagccggagtgggtcttcatacccacgcccaccacggccaccttgcccacgttggcgtcgatgtcgaaggactggtagcccagctcgtcctgcttctcctgcaacacatcccgcaccttggcagcggcggaacccggcacggtgaaggaaatatcggcggtgccggtggaagcggaagcctgcacgatcatatcgacgttcacgccggcctcggccagcagcgtgaacaccttggcggccatgcccggctcgttcggcacgcggcgcacggtggccagcgattcggtgttgtcgtgcgcgacgccggaaatgatcgggacttccggccccagatcggggaacagatctcccaaggactggttgttgttttcgctcatgttcttacctttgttcgtaaagtcttggttttcttgcgattgcctgcgatgtctcgcgattgccgaatgcgaatctcagatatctcagatgttcggcaatgtgcgcggatcgacgtcttccggcacgatcagcgtgccgcgacggtgggagaaggagctgcgcacatgcaacggcatgtcgaatcgctgcgcgtattccacgcaacgcagggcaagcaccttggagccgcaggaagacatttccagcatcgactcgtagtcgatgacggggatacggcgtgcagtcggcacaatgcgcggatcggcggtgaacacgccatcgacgtcggtgtaaatctcgcatacgtcggcgtccagcgccactgccaaagccactgcggaggtatcggatccacctcgtccgagcgtggtggcgtcgccaccctcattcacgccctggaagccggccacgatggccacggaacccttgtcgagcgcacgacgcacgcggtcaggcttcacggccttgatatgcgcggtaccgaactgggcgtcggtcatgaaaccagcctgggagccggtgaaggagtaggcgtgagagccggccgcatgaattgccattgcgagcaaactcatcgaaatacgctcgcctgcggtcatcagcatgtccatctcgcgcgccggcgggttagagtcgatgctgagcgcctgatcgatcaagtcgtcggtggtgtctcccattgcggagaccaccacggccacgtcattgccggcgttcttcgtttcgatgatgcgtcgggccacgcgcttgatcgattctgggtcggctacggaagagccgccaaatttctgcacgatgagagccacaacttatccaatcttcttcaatgtgttgcccgccaacatactaagcaggctggtcaattataggaaaaatccgatttgtcaagcccctgcacgcccaacatgcggaacaatatatgggatcctcgcaaatcctccgcgcgttttttcgtacatacgttccgcacgggtcttccatgatcgcccgcgcaacgtttgcgcaatcgtcagcatatgccggcaatgtaacggatgtggcaaatatgatgtcagaccgcacgacgcccggccagcgcacgcccgagcgtgatttcgtcggcatattcaaggtcgccaccgaccggcaggccgctcgccaatcgcgtgactttaatgtcggtttgcgaaagcagctgcgacaggaagctggtggtcgcttcgccttccacattcgggttgagcgcgaggatcacttcggtgacttcgctgtctttgagccgttcgataagtttggcgatgttgaggtcgctgggctgcacgttggccatcgggttgatgacgccgccgagcacgtggtacaggccgcggtattcgcgcgtgcgctcgatgctcatcacgtctttcggctcttcgaccacgcagatcacgctgtggtcgcgacgcggatcggcgcagaccgggcatgggctggtttcgcacacgttgccgcaaatgtcacagaatcgtattttctctttgacttcggcgatggcgtcgatcagcccctgtgattcctcgtcggatgcgttgagcaggtagaaggcgatgcgttgcgcgcctttcggcccgatgccgggcaggtgcgcgaacgcgtcgatcaatcgttggatggcgccgtcataggccagtgccatggttcacctctccttggtttccataagattcgcgattatgcagtgcttacgattgcgttgattcgtcgattttgctcggtttcgcatttttgcttgcgactgcaccgccatcagtcgtcgagattcttcttctgctgcatgttgcgcgggttttttgcatcgtccggcccgaaatcctcgacttttttcacctcgaacagtcgggtcaggtcgtccacgcttaacgcggttgacgccccgatcgactcgtcgctcatggaatattcgtcatcttccgcggcgacctgcggcattggctgcgccggcgcggagaactgctggctccacggatcggcattcggctggccttgctgcggtgccgcgtcctgccgcagtgcgcgatgctggtgattggcgtgcttcggagccacctcaggttccgttggagcaggcatgggatccaccggtcctgcctgaatcggcatggggttaccccaaggatcgtcgtccaccggcgcttgctgcggtacaggcatcggtgccgcccaaggatcaacgttatcgctgacatcgggaacagccacatgtttcgcatgttgttccggcgctttcacatcgttgacgccgcttgcgaccaccgattgcggttgcatcggctgtgcagatgcaacccaagggtcatcatccggaacaggccgttccggatgatggacttcctgcgtcggggccgcccatggatcgacttcctcggctccaccggcagcagctcgatggccctcctcatcgccggaatctccggcattgccaccgtcttcggcgctcttcgcgcttgtgccggccggctccttgccggaggattcgagacctgcagcagtaccaagattggccgtcagcagcgtggccgctttaagctgttcctgcacgagttgcgcattgatcttgctctgctcttccgggctgagtttgctccacggcaccgattcggacccgtccgccagctttttggcaggcgcgagcgtgacgctcggtccgaacgccttatgcacttcggcgcggacgattttcaccacttcggtattgccgtccaccgattcctttgccaccgctttggcaaacgcgtatttgctgagcgccttgtcgaatttgatccacagacggtcgccgctcagtagcacgcgaggcactttttcacggcttacgtaacgttgcacgtcttccggaagggctgcgaccagcgcatcccacttctggtcgggggtgcgatcgtcatgaatgggagctggtacggaagttgcggcaggcgcagcggaagcgacggaagtcgtcgcattcatcgcctgctgcacgtcagcaagcacggaagccacgccggatgcgacggcatcggcaggattcgtcggcgccacggacggctgcacaggcgcggaaggggtatcgatcacaggcgcagaatcctgcgcccgcacatttcctgcggcatgtcgtgccgcacggcgacgagagccggccatggatccacgcgacgattcggcagccgcggaagttccggcatcgccggcaaaatcaggtacaccggaagatgacgcaacgacagccatcccttcctcacgcccggccaacaagcgcgcggcaagcaattccaatcgcatgcgcggcgaaatcgcaccggtcatattggcaagcgtcgcattgatcgtgtcagccatctgcgtcagcgcagacaatcccaaagcggaagcctgacgacgcaaatcatccatgttctcggcggccgcatcgtcggaaagcacgctttccgcacgctctccacccaacgtgagcaccagcaaatcgcgtacgcgggcaagcaaatcctcaacaaatcgacggggatcgaaaccaccgaccacgaccttctgaatcacgccatacagtgcttcgccatttttgtcgacaacggcgtcgacggcctcgccgatcagagcgtcaggcgtgaagccaagcaacgcaaccgcggagtcgtatgcgatgctgccatcgaccgcaccgaccatgagctggtcaagcacggaaagggtgtctcgcacggaaccgccgccggcacgcatggcaaggcgcagcacgcccggctcggcttcgatatgctcgtcttcgcagatccgctcgaggtacgggcccataacctcctgcggcactaggcggaacgggtaatggtgggtgcgcgaacggatggtgccgatcaccttgtctggctcggtggtggcgaagatgaacatcacatgctccggcggctcctccacgattttcagcagcgcgttgaagccttgcggcgtgaccatgtgggcttcgtcgagaatgaaaatcttgtagcggtcgcgggcgggggcgaatccggcacgttcgcgcagttcgcgggcatcgtccacaccgttgtgcgaagcggcgtcgatttccaccacgtcgatggaaccggggccgcctgtggcgaggtccttgcagctttcgcattcgccgcacgggtgcgaggtcgggcctttcgcgcagttgacgcaacgcgcgagaatgcgtgcggaactggttttgccgcagccgcgcggaccggaaaacaggtaagcgtgcgtaagtttgttctcatcaagcgctcgcatcagcggaatcgtgacctgatcctgcccgatcacgccgtcgaacgtgtcgggacgataccttctatagagtgccagtgccatcgcaattccttccgctgtggtgtcactaggctaccgattaattacgacacgtttttctcaaagaccggccgcacagcctgcccgtaacggtgaagcgcgtgtccccaaagacaagcgccgcggcaacgtttaagctgggagtgacgacatcgacactacgaaattgacattgtgtcaatgtacggtttagactgagggcagtcaagaaattgacagagtgtcaacgtgtcgcgcaggtgagagacgccactcgaacgaaggagagaaagccatggacggacagcacaacgcccccgcaacaacagtcggagatgcacgccgcgcgcaaatcgtgcatgcagcccgcgcaatctgcctggaaaagggcttttcgaaaatcacgatcagcgatatcgcaggtcgcgtaggcatgaccagatctctcttctaccactatttccaagacaaagaccaagttgcggacgccgtgctcgacgacgtcatcgacgaagtcatctcgcaattggaggagtggaacgccaatcgagaagtcggcaacatctcgaaagcgctcgatgacgtggtgcgactgacccgttccctcatcgccgatgagggcccgttcagccaacgcatgatcgaagacggcaacgcgggactgtacatcaaattcatcgaccgcgtggccgatcgcattgcggaatacatctgcaattcgacagtgcgcgatttcgagaaattgcatggcatgcccatcaccaacgagcatgagacgttctatacgctcatcgttggcctgatttcgctgatcagactgcatcccgacattgaagacaccgtcatcagacaggtcgcggcacagacgctgcacctgaacgaatacatgtaaacgcagctcaccccgcgcgcatacgtgttgagagaaaggaagagcgatgttgttccaagtctatggcgacaccgccatataccagtggatcggatggatcctcgtattctgctgcctgatcggcgccaatgagctggcccgtcgcaccaagaccggtggcgtgatcgcgttcctgatcgtgccggccattctgaccatctacttcatcaccatttacgtggccgccgcgatgggtgccgaatgggcgctcagcaatccgacctacgtgcatatgaccagctggttccactatgccaagctatatgcggccaccgcaggctgcatcggcttcatggcactcaaatacaagtggggcaagatcggcaaatccgaatggttcaagtgcttcccgttcgtgatcgtggccatcaacattcttatcgccgtggcctccgacttcgaatcggccattcgcgcttggggcaccacatgggtttccaccgaaggcgtgacgctgtatggcggctggcacaatgtgttcaacggcgttgccggcctgatcaacatcgcctgcatgaccggctggttcggcatttacgtgtcaaagaagaagcaggacatgctgtggcctgacatgacttgggtattcatcgtcgcatacgatatttggaacttctgctacacctacaactgcctgccgacccactcctggtattgcggcctcgcgctgctgctcgccccgaccgtggcgaacttcttctggaacaagggcggctggattcagaaccgcgccaacacgctcgccatctggtgcatgttcgcgcaggtgttccccacgttccaggatgagtccaagttcgccgtgcagtcggtgaacaatccgaacgtgaacctgaccgtgtcgatcatcgcgctcgtggccaacgtgctcgcactcggctacatcatgtaccgcgcgaagaagcagcacgtcaacccgtggctgcaggaagtcttcaagggcacccgcgactacgagcaggccatcgcccgccaggaagtcgccgcctgaccgcaatccgtgttcgatagttacggcgttcgctagttacagaaaatccggtattcgtaagataaagatcttgcgggtactggatttttcgttagtatcgcgaaattatttgcgattgcttacgattgccgatcacgcaatcagttgcatacgtgccatcttcgatatgcaatgttgcggtttgaccggcatgtgcacgcactaccgcgagcgcttcgcgtagtaggtgtcggttttgccggtgacaggatcacggtgatcacgcttgatggcttccagcactttctcttcggtgttggcagcttggctttccgccacggccggcggcaccagcacacgcaacgcacggtcttgaactacgaccttgacaggcaggcgaccaacatattcaccgtccgccatcaagaccggcggctcatcaccctcttgcgcgcgggtgatttcgatatcgcgcacacgcttccacccaaacaccttgcacccgaggatcttgccgctatacgcgtgagacaccgcatccacgcattcggcgacattgggcacgtggtcgagccataccaggtcaagcagcccatccgagaatcgtgaatatggcgaaatctcaatgccaccgccaatatgccgtgaattggccaccgtaagcaacggtgaaataatgtctctttcttccaccgttccatcggccaacgtggctttgatgtggtatccgtaccgcttcatatgcgtcaattccacaatcgctgccacgaaatagcgcaccgaaccgttgggcaagcgggaatggttggcacggtcgttgatactcgcatccaaaccacacgacagcatgcccgcgtagaagcggttgaccgccgggcgcaatggcacgtccgaatcgccgaccagatcatcgccggtactggaatcgacggcatacccgccctgcaacgacgtggccaaacccatatcaacgtcaatatgcgtgccgcgcacaatcgcgccgacgatgccgtcgacagcggtttccacgcgattgaccggcagctcaagaccgcgggcgaaatcattgccggaacccgtcgccacaatgcccaacggtttaccggaacagcccacggcattggctccaagcgcaatcatgccgtcgccgccgaccgccaccaggtagtcgtattcgttcctgcgattcctggcattcgccaaggaatcgtcgaagctctcgccggtcacgtcgatcacgttgaagccatgcttgcgcccggcctcttgcagcagctcaaccacctgcttgccgacctcggcacccttgcctttgtttgacgtcggattgccgacaacggcaacggtcgcattcacacatgacgtttcgctcatacttcagtacgataaccgcgattcgctccacacgccacatgcgaacggctttccatacaaatggccgcgttttgtggaacgaatgttcctttacgtagaaagatccctttttacgaagcgcgatttcccgcacaatgtaccgttccgcaccacgcttattcgcagacaatcggccccgcccgtgactgtttgccgacatgcgatacgaatggcatttgcgtgccgacctgcgcttcgaccagcacatcctcgccttctatcgtgcaggatccgatcgtcgcattattgccggatatagtgcgttccgccacggaacaaggatcggacgatcccgaatacaacgcattggccgccgctaccgacgccaggtcggccgcattctgcgcgcgatgcaagcacagcagcagattgcccgccgacgcggccgcgcccagcatgatggcggccactgcgatcaaagccacaccggatatggtccccgaaccctcatcggacccgcgaatccaagcaaaccaatgtttcacaaggcgtttcacattacccattcctttccgacccgcatccatcaaatggttgccaatagtgtttcacaacatgtttcacacgtcgtatgtcgcaagctccaaacctcacagacctccatgcacaggccacaaccaacaatcccgcatctcactgcgcagagaccagcacgcttcggagcaacgctagaagtagcgggtcgccttgccggtaactcgagtgggcagcacaccggtcggatccggcaccacagggcattgcaccgtgacggtgacgaagtccgccccacgctcgaaccgtaccgtcgccgaacctcccgcagccgccatgaccgcggtcctcgccttcgattcgccgcccgtatcatcaaccgcgaaagccctggcaccggccgccgccgcatcctggcaattcatggacaccacagacgcacgccccaagcacaacaccaaaatcgccaccgccgccacgcaggggagcaccaccgcgaattccgcggtggccgctccctcatcggcatcatcggtatggcgtttccaccattgcctcagcatgaatcacccgacgctcagcgctttcttgatgatgttggtcagcagcgttttgatggcatcggatttcataatgcccaccaaaacggcggcgaatccggtggcggcaaccaaaaccaccgcatattcggcagtggcagcgccttcctccggttcgacggtcagcgtgcgcatacgtgcgtccagcaggcataccgctttgccggcccgttcacgcatggcatgcagcagctgccctgccttgcccatcaggtctggcgagccatcgacgttgattggcgtttcgttgttcatggcgttcctttcgttcgaacaacctcggccagatggccgagtgcacccagtgttgcgcatcatcgtgcccgtcggaacgttttttcagggttgtggtcggaggacgtgggttatccacaaccacggcgtgtcatccacatttatccacaaaactccgtgaattatcgtctcccaacattccccgcttttccgttgtcgttgcgcacacgccgtcattgcacaaacgacatgacggacggaatgattccaaccgcaacaaatgcgggaagaaagcacaatccagtcggcagcaacaaacgaaccgacaatttcgctgcagcctgttcgatctgcgagcgctcatcccaatccaattgttcgaccgctgtttccaaacgttccaccggcgaggcgccactgtgccatgacgaggcgaacgcatcgcgcaccaccgcaagatcgccatcatccggccacgcatcatcccaggaaacacctttgttcaactgttctccggccgaccgcagtcccgcaccgaaatctcccgcagcgatatcgcccacggcaatcagcgcgcgtggaatggaggatccctgccgtatggcgacgctgagcatctccaataccagcggcagcggaagttcccgcactcgtccggcgggcgcaaggtcggctggcacacggaccggcctccactgcttcagccacatcgcctcagccgcgcacaccgccgccgtcagcgtccatatgccagtcattacataattcctttcatatcgtcataccattcatgccgtcttgccgtccatatcgtcttgcctcatcaacgcgcgtatccatacgagtccgaacccgtagcagacacaagcgaatccaaggcatgcccaacccctgacccctgaaaagaggaaggtcaacggatgcgctcccatgccttcccctaaaagtacggtgagctgcggcagcgccatcagaagtttcaccgtcgctttgggcatggcgaacgcgttggcacgcagatcatccaataatcgttgtcgcttcaacgattcagccaccgcctgcaggcatcggccggtttcgcatccgagcgtcagacttaaccggcaggccgcatgcaactcgccgctcaaccgttcgacttggccgcattgctctttggacgggcatcggctgcggatcaccatggttatgcgaagcctggtaagttcgggtatggcgaacggcgttccacccaattcttcgaacgcctgcaccaatgtggctccgctgcgcacggatgcgcggagggaagccacgcacgccacacatccgatggcgggcaatggtttcgacggcatgttcgcctcttcgattccgtcagaccgcccatcgaatcctccgtcaggtttttcatcaaggctttcgcctgcgcgccccactacgtttcccgcccgttcgcccacatcgcatacgtttcggcgaggccacagccatacggccagtccgcacagtaccgcgcaaataatgctgagactttccatctgcccacctcgattcaacgactccatacgcgcacgaaatcaggccactgttgcgaagcccgcatttggttgccgttccacccggccaataggtttccccgcagttttccctctgcgaattcaagccgtcctatttgcgcgatgcgccgcctgcctcccactcggcccacatgcagcactacgtcgaacgcgtcttgcgcgagcgccgcggtggcttgcggattcagcccggagagcaatcccaaggccaccaagcgtgagggaaccgccgtcacctgattggcatgcaaggtggtcatgcctccgcgatgcccggaattcagcgcgcgcagcagatccacgatttcgccgcccctgcattcgcccaccacaatgcggtccggccgcatacgcaacgtcgcgcatatcagctgcgacagccctatggcgcctttgccttccatgttggcgccgcgcgtcaccagcgacacgtggttggcatggttgagcatgccaagttcgcgcacctcctccacggtgatgacgcgctcccccggcgcgcatcgcataagcattgctttgagcagcgtggttttgcctgctccggttccgccggtcacgagcacgctggcccttcgttccacgaatccttccagcaagggcatccatccgcttggaaacatgccgttttccgccaaagattccagactgggcacaacaacgtccggcaatcgtatgctgatggcggcgccttgcggaacgagcggtgcgataaccgcgtgcacgcgcacgccttccacggtggaggcgtcggctatcgggcaggcgtcgtcgagccttctgccaagctgcgagcacagcctcacagcgaaatcgcggatggcttggggaccgctgaatggcacgcgcaatgtatgtggccgcataccttggccgcgatccacccacaccgttccgtcgcaggttaccgcgatgtcggtgacgcccggctcggatgcgatgtcgctaagtggcccgagttccatgactgatgctcttttctcccaacgcttcctgaatgagatccgccaacgttgcgatggctttcgcgttcgtacgattgggtttgcgcagtccaagcccttccaagagttcgctgcaaagcttggcatccggtttgatgaccgcggtgatatcgcagtcgaggtattccgccgcttcctcgattgccgtcgtgccatggtcgcgtacggttccgcgcggttgcacgcctacgagaaactcccgttcctgcgttgcggcatcgtgttctccgattgaaccgtgatgcgcccgcagattcgctttggcccgcgcaagaccaagtaccgtcagttcgaccacggtaatgcggatggccttgcgcagttccgtcaaatcctgcagtccgttccattgccccatatcgacgacgaccacgcttcgcacctgcgatagcgcatgaatgcacgcttgcacttcccacgattgcggattttcggttttccaaggatcgcatgccagcaatggcacaccatcccagattggcagctcccgcagtagcgctttgccgtcgatattgccaagcggagcgctgatttccccgaagcgtgagccgtcctcgttttccacgccaagaagcacatccagcccacctccttgcagatcggcgtcgacgagcacacatttgaggccgcgttcgctcagctcgcgggccagtaaggcggccagagtgctcgtgcccactcctgccaccacggagtcgataaccaccacattgcccatatcgcagggttcctccaccgatgcgcgaccgcattgcgcaaccatgccatacgttccaggcacagcgccaaccagttgcgttccaccgcgattcgatcccggcggcgtatagaaccgttgcgcagagacggttctgcgttgtgtcggcggtgacgcttgcggcgcgatcgcgccggcgaccggcaacagcccgcccgacggcagcggcaccggaggaacattcgaaaaagacgttgcattactcataccgtcgattgaaaagcttcggcgagcaccattgcaagctgaaccggccctgtggtcggaggacgcgagttatccacgaccccggcgtgttatgcaccgttatccacacaacgacgataatcggcgtccgtcgttttcccgaaaaactccctgagaacaggcaaacaaaaaggaaggcccgccgagcgggccttccttgcaagaaccttaagggcagaatctctgcacaacaacatcgtcgtaacggtaagtctatccaatgcccgttcaacgtaacgacctatcttggccatacactctttgtgggctctgctctttaagttgttcttgtacttcgtaattatgctcagcaatccggcaatcgcaaaccgaaaccggctgatgttccgtatttgtcgcaactgttgctttacgatcgcaagaatcataaaaatgctccatcgtgtgcgaaacgcaaggcgtgtttgttcgtttgcgtgcgtttgcgacaaaaacacggcgtgtcgacaccctaatttgcacaatgagcgaacgaatgttaactccagctaaattttgccggctttttacagcatttccagctacttaaggataaagtaggaaagtatggcacagatttttgacgcaccctcgaaggcgatcttgcgcagccagatagctgagcatatcgccgagaccgataaaaacgacaagcgtgagcttcaggccggcgaagagccgttgccgaacgaccgcttcttcgaccgcgagttgagctggctgaagttcaacaagcgagtcctcgaacttgcccaagacgaagatctgccgatcatcgaacgcgcaagcttcgccgcgatcttcgcgaacaacctcgacgagttcttcatggttcgcgtcgcaggtctgaagcgccgcatcgacaccggcatcgccgtgacggccgcctccggattgagcccaaggcagcagctgcgcgccatcagcgagcaggcgcaccgcctgcaggacgagcacgcgcactacatgatcgatcacattcttcccgacctggcgaaggaacagatcgtgctgctgagctgggacaagctcaccgccgccgaacaggagcgcctgtctcgctactaccgtcagcaggtgttccctgttctgacgccgctcgccgtggatccggcccacccgttcccgtacatttccggcggttccatcaacctcgccgtgctggtggagaacccggcttccggcaagtcccacttcgctcgcgtgaagattcctggaaacctgaaccgtctcgtgcccgtcgacgacatgaccgacgacgatgccaccaacgtgcgctacggcttcatcaccatggagaacctgatcatcgcgcacctggaatccctgttcccgggcatgatcatcaaggaagcgcgatccttccgcgttacccgtaacgaggatatcgacgtggaagaggatgatgcagagaacctgctcaacgccatggagaaggagctgctgcgccgtcgtttcggaccgccgatccgtcttgagatttccgacgaaaccagcccgttcctttcccagctgctcgccgaccagttgcgcgtcagcgccgatgaggtgtaccgcctgccggcaccgctcgatgcgaccgtgctcttcgaacttggcggcatcgaccgtccggacttgaagtaccgttcgttcgtgccgaccaccaatcgtcagattgccgaggtggagtcgtcccgcgcgcaagacatttttgcagcgattcgcgaacgcgatatcctcctgcatcacccgtacgattcgttctctacctccgttcaggcgttcctagcgcaggctgcggcggatccgaaggtgctcgccatcaagcagacgttgtaccgtacgtccagcaactccccgatcatcgacgcgctcatcgacgcggcgcatgcgggcaagcaggtgctggcactggtcgaaatcaaggcacgcttcgacgaagacgccaacatcgcatgggcacgcaagctggaacgcgccggcgtgcacgtggtgtacggcatcgtgggcctgaagactcactgcaagctgagccttgtggtgcgtcaggaagccgacggcctgcgccgctactgccatgtgggcaccggtaactacaatccgaagaccgcccgcatctacaccgatctcggcctgctgacctgcgatccggtggtcggccaggatatgacccgcctgttcaaccagctgtccggttatgcgccgaagtcgagcttccaccgtctgctggtagcgccgcgtaccgtacgttccggtctgattcagcgcatccgccgcgaagaggatgcggcacgcgcaggcaaggaagcatggattaagatcaaggtcaactccatcgtggacgagaagaccatcgacgcgctataccgtgcaagccaggccggcgtgaagatcgacatcgtggaacgcggcatctgcgcgctcaagccgggtgttccaggactttccgagaacattcgcgtgcgttccattctgggtcgtttcctcgagcacagccgtatctacgcattcgcgaactccgatggcccgcagatcggtgaaggtccggccgcaggtccggaagtgtggatcggttccgccgatctgatgcaccgcaatctcgaccgtcgagtcgaagcgctggtacgcatcaccgctccggagcagatcgacgagctgatcaagtacgtggatctgcaaatggccgattccaccacctcgtggcatatggcagccgacggaacctacgtgcgtcatgcgaaggatgaggagggtcgcccgctggtcgattcccaggaatatctcatcaagaagcatacgcgccgaccggcaaggcactaaaccgtaggaaatggccgattctgctgttgcagaatcggccatttcctatgttgcggcatacgcgatcaccatcgtgggaaaacgcaggaaaactcggatggcacgattgccgtcgcgcaatcatggggaaacccgtgcccaaccacttacaatgaaagatatgagcgagagcatgagacgtgtcgtagaagccgccgggggtattgtatggcggtggaaaaccggtagcgaaatcgcggaaaatccagcaatcgcagcgcagaaaactccaaaggaacaactcaacagcattgaagtgtgcatcgtgcatcgaccaaagtacgatgactggagctggccgaaaggcaaactcgagcagggcgaatcgcatcgtcatgccgcagtgcgagaaatcggcgaggagacaggcgtttccatcgcactcggcccgtatctgtgcgaagtcgaatatccactgtccgaagaaggcaagaaaacccggcattcacacgatcgcgccgtcgacaccaagcacacgttgtattggatggcgcaaccgatttccggagatgatgcggaacatctgcttgacgcattcggccccgtgcatcgcgcggatgtaggcgaaatcaacgatatcgtgtgggtttccgtacgtgaagcacgtaaaatcctcacgcattccaccgataaagacaccctcgccatttttgtggaccgcgtacaggagggtgccgcgaccgcgcagaatctgatgatcgtgcgtcatgccaaggccgaatcgcgcaaatcctggaaaggcaccgacgcgaaccggccgatcactccgaaaggcgcggccgcggcattcgcactcaaccgcgaactcgcctgctacaacccaacccgcctcgcaacctcaccatggctgcgctgccaggaaacactgcaggtgcttagctggcagaccgaacgcccgatggaacacatcgacgcgctcacggaagacgccttcgccgagcacccgaccatcgcatggctggcgttcttcaagcagatccagctcacgctcgagacccgcgaaaccacggcgatctgcatgcaccgaccggttatcggaggcatgttcgatcacttgcgcggactatgcgcccgcaaagcgctctccaagcagctcatcgccaaaacgccgttcatgcctaccggcaccgccgtagcgctgtttataatcgatacgccgcaaggtcccagcattatcgatattcaaaaggtttcgcccattgtctactagcatgcattacggttccggatcggttgtaccaagccgttccgccggtttcaccaacaccggatcgccgcgtccggcccgcccggggcaactcgaccagatgatggccgacaatatcgcgggaggtgccgatccggcgcaaatcaacgagatgagccacgcttcggcggccgcactgttggaccgcgtgcatcatacgcaggatgccgaactggtggagcgcgtgctcacgctggtggaccgcgagggcgttgacgtgatcgccgaactgtggagcagcgccgagccggattcgctgccgggcattctgtggcggctgtatctgctgcgcacgtggatgcggaagaatcgcgagtcgatcgcgcggttgtggcgcgctggagagccggttgccactaccgcctcggcgattgccggcgtcgatcaggcgcccacggaagatgacattgcgcatattgccgattcgattctcgcaggcgcgttcaccggcgattttgcggttgcgctggaacgtgcggccgcgttcaccgacgtggttgcgttgggattgcgcatcgaggcacgcaatatgatcgcacgattgaaagctgcggaaggttccgatagcagcgattccggcatttccgccatggaaaagcaggtacgtacgaaatcgtcccgtttgatgcacacggccggcaatctgttcgtcacggccaaggattttcgccatggggcgaatctgtggcgtcgcggaaaactggagtaacgcgcgttccgtacctgtcccctgcacctgcctctgcacccacctctgtaccgctaccggaagtgttttacggcgctcgcaccatcaattcgcgacacgacgtagcgtacggtctgcagcatctgtagaataggaatccgcgtcgggccatgcatagccccgggctccattttttgccgctgcgagcggcctttgcgccgacaggcgctttcgtggttcggcgctttccctcttcttaagtttcgttgcttttttcatacgattttcagtttctttcttggctcctttcccagttcccgcgcttttcctcgcgattatggactacgcttagaagacatggatattcatgttttgaaccacccgctggtggaccacaagctcaccgttcttcgcgacaagaacaccccgtcctccacgttccgcgagctcgtttccgaactcgtgatgcttgaggcctacgaggccacccgcgacgtcgaagtcgtggacaagccgatcgagacccccgtcgctccgatggtaggcaagcacatcgcttccccggcgccgatcattgtgcctgtgctgcgcgctggcctgggcatgcttgacggcatgaccaagatgatcccgtccgctgaggtcggcttccttggcatgaagcgcgacgaggagaacccaacccagcagatcacgtacgcgaaccgtctgcccgacgatctgagcggccgtcagtgcttcctgatcgacccgatgctcgccactggcggcacgctggtcgcagcaacacattacctggccgagcgcggcgcaaaggatgttaccgccgtgtgcattctgggcgctccggaaggcctgaagttcgttgaggagaacctcgacccatccattaagttcaagctggtgctgtgcgccgtcgacgagaagcttaacgacaagtgctacatcgtgccaggcttgggcgatgccggcgaccgtctatatggcgtgatcgactgaccgcatcagagctcaaccgaatcaacccaatcagtcaatcaagtaaatcgaataaaaacggcctgccacaacgcaaatcatgcggcggcaggccgaaatcatatgtaaaacctctactgctcgtcggggacgaacgcctcgaaaatatgatggtcgaaccagtcatcgcactgggcgagctcgtcgcggctgcgcaccgtccacgacacgggaacggcacccatgaaacgggccaaccgtacctgcggactgttgccgccatgccaatcgtaggcgacgaaatcagggcgggaaatccagtcgaaaatcagcgcaccggccgcatattccttggcgagcgcagcaggatcagacggcttctcctccccctgcggccaccaggaaagctggccacggcacacttccggacggttctccttataccagttgacggcagccggattgaacgattcgatcacatacgcgccggaataggcctgcagcagcgcgtcgcccttttccatgagctcgacatcgcgcgaaccccacttggaattgtcgtcgaacttgtattcgacgatcagcggcacacgacccgccactaccttgagcacgtcggcgaacagtggcacatgctggaaatacccttccggagcgctgtcaggtgtggtgaccagcggcggattttcaagcgaacccggcaacggcgctgccacggcggcaccgggggcgtcggtcgggaacagcgggatgcgggtcagctcatcgtacgtgagatcggcgatacggcgtggatctccggcgacgcgcatcagatcgccgtcatgcaccaccacgatttcgccgtcggcggtcatctgcaggtcaagctcgatgccatagccggcttcgcaagccgctgcgaatgccgcaagcgagttctccggagcgatcgcaccagtcacgctggggctgccatagccggccttcatggccatgcgacgtgccagcgccacatactcgccgctctcgttggcatactgcgcggtcagaccggaacccgcgtcatgcaggccacgatgcgcgtaccacacgtcgggaatggacggcacatagttgcggcgcttatcggagaaggtacgcggcgcgatcgcccacactgcggcgcctgcagcgactgcgccgccgagcagcgccttgttgacgaatgatttggacatgggctttcctcccttacgcggccgctcgcgcattctctcgcgttggttctcaccgttcgcggccatcgaatctgtctcttctgagattagcccataaatcacaaaaacggcgaccacctacgcgatccgcgatcgtatgtcgccgtctcaagccaccaacagccgagccatatctcgactatatatggcagattttgagtctcgtcacgaggcatctcgcttatatatggcagactggagtcagaaaacatgcgttttcataccccctatatggctttttagcgaagtcttctgccatatataggcgagatgcttcctgacagacccgcaaatctgccatacataggcgagttatgagcaaaatggggtccgatgacgtccgagttcacacaaacgtaggggtcggaccccaaaggtcggcggctgaatacgtgtgcttgatcgtaggcttggccactgagccgtgaagaggaaagcccagtgggttttcctcaggcgaagtgagcggcttgccgcgaagaccgcgtaacggtaccttgagtgcgtcaagcacacatattcagtccagaggccgaggctgagaacttaccacttttatgttggattcagttacgcagcttgccccgcttggctacgaagatgcagcaccccgccgtggccagcaccgtcatggcaatgacgattgccgtagtagcgacgcctgtagagcttagcttcttcttacgttgagactgagattgctgcgatgattgcggtttcgcagaaggcttgacattattaccgtcctgcttgccgttgttatcgatatccggagtcggctttggagttggcgttggttccggctcgggctcaggcgtcggatcgggggtcgggtccggagtcggttcaggtgcatgaacctgccattcggcggcagccggcgatgcactgccggattgaatcaccatgcgcagcttagtggtcttcaccgcgtcagtccaggttgcctcgctccatccgccgttatcggtaccgtaagcgccgggagcattggtgaccaatgtatatgtggcatcgggaatatccacaaacgcattcgttccagcatcccaatactgcagtttccacgacgccggcattcccaagccccctccatcggaggtgaattgcacacggctggaatcgatggtgacttcgcgatcccattcgtagtcgagcttcatttcaccggtattcggccacgtaccccaaatgcaggcgttatcaaccgtgcaatcgcccggaatggttttgccgtcgttaagcgcggcaacaccagctgtccaagaagacgcttttttgtccacgtcagtagcaacggcatcttgctcgatatagccggccaacggcaccgacgtatcggatggaatatctttgacgcccgcagccgacatattgccagcaatgtccgaagcccgatagctcaccgtttcgcgcttcgacgaagaagcagtaatcgccgcgccttcttcatattgctgccattcgccgtttccaacccggtattccaccgttttcacaccggatccagcaccatctgaggcggtcaatgtcatagtgcgggaaaccgtatctaccgaggcggttaccgtaggagccgtagcatccacacgcgcttccgcagcagcgatttcgctcacattgccggccgcatcagtggcacgcgcacgcacactcactataccctcgccagtcacagcctttaccgcagtgttcacattcgttccgacggtcacccatgcgccatccccgaccgcaagttcgagttttgccatcggcgcagccgcattgtcggaagccgtaataagagcgatcggtgaagtgaccagccaaccatcattgccagccgtgccagccaatgccacacgcacggcaggagcaatggtatcagccggttttacgtaatcgtcggaaacatgtacggtcacggctacgttgccggctgccagatcatcagcctgctgcttggtttcaatgccagcaaccacaccttgcacggtgaactcacccgcctgtgcatacgaagaagcagacaccgtgcgccacaaaaccggagtttccactgtttccgagccgtacgcgactttcaccgtgttcgacaattccggcgcgtctccggtcttggcgtagacgtcggctggctgttcagccacaactgctccctgttgcgcgtatacttcccattcaggaacgccgacggaagcatagcccccgtcaacggcttgcgcggtcatgtcaagtttgagcgcagtggtggtcactgcgtcgaatgtcacttcattaggcgcgttcttgcctgtatccacgccgtattcgctggaattgggcacgtccttccaggaaccgtctgcgtcaagatattgcagtttccatgaggcaggggcacgcaatgcgttcgcatcggtatcgaaccagactttcgatccattcacacgtacagcgccattccactggtagatcagtgaatcggaggattgtgtttgtggcatctttcgatagttcgtccaatggttcggcggtactacagcagtttccagcactcgcccgtcgttcacggaacccttgtaggcgggtgtttcggtgtaggtcgcgtccactgacgcatagggggccacgttgcgtgagggttgcaaccgttcggctttggtcggatgcgaaacggcgttcatgcgcccgccattccacgtcacttcatcgatgcagactgtacggcggaagtcagtaccaccagtcttgtctccagtgtggtaggtgacccaccatttgccgccgaatcgttgaatcgacggatgcatggtggtggacgatcccgattcgacgattacgccttggtacgtccacggcccaagagggcttgccgacgtggagtattgcacgcacgcctgatagttggattccacgcaggtcgccactcccgacccgggtttgccaccgtcgtacacgttgtagtaggtgtctccttcacggaacacccatgccgcctcaaagaagcctttgggcccgttggcataagcgccgccgttgttgcccaaggtcagcgacgcgttcacttggttcgcatagtcgctgccaagcacgtctttgctggcatcgtagtcgggtatgttggcgagcgcgtcggcgtcacgcatattgtagattttcggcgctccgtccgccgttccgtccatggtttccacggcaacatatgaggtgcggccagtgttggcgtcccgctgcatttttacggcgagttcgctgttgaaggtgccgaagtgcagatatccggtaccgtcattgtccacgaagaatgcgggatcgatggtttcgatttgcgtctgcatggtagtcagcaacggcgctccgatggcgtcgacccatggtccgagggggctttttgatttggccacgccgatggagaacgggtcggctcccgcggctgcgttcttgtctttgactggcacgtagtagtaaaaccagtcgtcggccgtgtctgcggtgccagcatcgtcgactactacttgtcctgcgtaggctccgtcgccggttgcccagtcgaacaggtcggctttggcgatggtcttgtagtgcgtccatttgccggattccggattgtcggttacgtagacgccccagtctttcatattgaaggacccgtaggttggttcggcctcgtcgtgtcctgtgaatacgaagagtttgccatcgtattcaagggtggatgcgtctgcggaatagtagttttgcgacaggtcgttgggggtattggttccttcgttctgcccgatggggttgcgaagggttgccggcaacgcactgttgtcgatttgcgtgacggtgacgtcgggattgccgaccggcagatcgttgtaggcgtgtccggcgacgctgggcgcggtacttgcgtcggccgcgttggctgtctgcatggttgcgattgctcccgtgcataaggtggctgcggctgcgatgcctgccaccagcgtcttcatcgacgcatgtgagatgtgcgaaaagctcatgaatattcctgttttcacgattggatattgaaaagtcctcttacggattgcttaggttacgttggtattcctcgtgcgatccgtaagaggacttgagcaattgctagcgctagtcgcggttgcggcgcgtcagcatgatggcggctcccgtcagcaggacgatcattcctacgacggcgatgccgatgacattgctgccggtgctgctgattgcggcactgacttcagacttggaaaccggcttgtttccaggcttggcattcggcttggggtcggtcttgtcgtcgtccggcttcggtgctggcttgagttcaagtccggcgatggcctcggtcagctgcttgactgcggcatccgcatcagcttgggtggcgttctcatcgttcaacaccttggaggcggcatccactgcttcagccaacttcttggcgctggcttcggtgtagaggtcaccgctgacgccctgtgcctggtcaagaaccgtcttcaactcagtggtgtcggctttcttcaccagtgtctgctgggcttcttcaagctgcttgatggccgcatccacctgatcctgggtggcgctctcgtccgcatacaccttttgagcgttacccatggcttcggagaatgccttccagctgttcggcgtgaaattagcttgttgcacggaaccggctgcgttgatggtggattcgagcctgctcttgtccacgcttggttccggatcaggggttggatccgggtcaggagtcggttctggatcaggagtgctttccgcagcatgcacgccccactcggcaaccgccagaccgaaggtgacgccctcggcggtcggcggatcaagcaccaagcgcaacgacgtggtcttcagcggagtgaacgtggccacgctccagccttgagcatcgtcagaggcacgtgaggccggggaattacgcacggtggagtattgcgcattctccacatccttccatataccatcagaagccaagtactgaatcttccagctgtccggaacatccaaaccgcccttggcatcattacgctccgcgaagttggcccagaactgcacacggctggaatcgacggtggcttccttgctccaggtgtactgcgcgtacatgccagcggaagcttgaccccagctgccccacacgcggccattcacatcggcgtcatcatcagacggccacgtatcgtcaaccagcacaccatcgttgagcttgccggaagccggagaccagctcgcctcggcactcaccgtggtgtcaatggccctgccttcaatccaaccagtcaacggagtatcgggctccggcttgggatccggcgtcggctcaggatcaggatcggcaccaccattcggatcggcgaccacatgcactgtaatcttggcctgcgagcttgaaccctcagccgtgccggacacctcataatcgccgatggtgtccaacttgacgccggcaacacttgcctcatcccacataaccgtgcgatcgtcaagcatgccgttggggaatcgcaccggaaccacagacggcaaagccaccgacttggaattctggtacaccgtctgttcgatcggctgagccgcaccagcagtctgagactgcgcgtcggaacgcacgccaatagtggccttggttccagcgagcgcgccaacaaccgttccggaaaccgcaaactcgctatcggaagcaagctgatcgtcagtgatggcatcccacgcaacactcaagtcacgacgggaaccgtccgtatagctggcactcaccgtcttcggcagattcacatcggcagccttgctgccagtctgcaccatacgattcacgccatccacgctcaccggatcaagcgcatacgcctcaaattcggtagcaccaacaatggcacccttcgggaacagcacacgcaacttgttcgtctccaccgtttcggcaaaacgaacctcattgccttcaccctgcatcgtggtataagactggccggcggcaagcttcacatcctgccaatcgccattctcatccgcatactgcaacttccacgacttgaccatcggcacaccgccaccgtcagtccagaagaacagcttcgccttcttcaacggaacagtgccatcccaggcaagctgcagccacggctcggtaccggtattgtcaccccaattattccaggtctcattcggagtattggtatacaacacctgaccgtcgataaccttcttggcattgtccttcgcctgatatggattggtgaagctggcgctcgcagtggactgtgaagccacattcaccgtgccgtcggaaggaatgccgtgaacggtgacttccttgaaaccggtcttctcaccgtcgaatgcggtgagtttgagcacatagtcaccctcacggttgaacgtgaccgtagtgttggcagcggttgcgtcgacgaacttcgcttcgccgttttcagggccagacacctgctcccatgtggtggtgagcgtgtcagacggcaggccgtcgtccttcaccgtgcccaccagctgcgcaccggacgaggtgctgctggcaatgtaggcgtcaacgcttggcgcctggttcgtaggttcgccttccggcacaatgtcggtttcgtaggcctgaatctccttcaagccaatggcctgacctgcttgcggagtgaaggtggcacgaatggctttggccacgaccttggagaactgcacgcggttgtagttggctcccgcgtaagtaggcgtacgcacctggttcggcaggacatgccatgcgccggcctcatcctgatattcaagcgtgtacaccgacggctcactgtagccggcaatcgtctggctggacgaggtctggtagaagtacaaacgcacgtcgtcgatgttctgcacgccgttcttgaacgttacggtcagcgaatccttggcgttcttggatcccttggtgccccagaaggattccatcacgttcttgccgtccactgcattggttgccgggtatcccttggtttcgtaagtggcttccacatcggcgtccttggccacgttggcctggctcttggacgcttcgtccacgttctgtccggactgcgcgaagatctgcgtaaccctgctgttcgatgcgtaggtcacttcgttggcgttcggcatggtggcggtggtcgcgccggtgatcaccgctccggaatcatcggcaacctcaacggttccactggccggatcgtagatgaggtgggcgagcttatcggaggtgaacacggcgttgccgtccacatacagggtatatcccttcggaacgttgtaggtgccgtcgttgttccatacgatcgacagatcctgcccgtggtagctcaggttgttgacggtgaagtggttccaaccgggaatctcgatcggattgagttcaatcttgttgtcttcacgcggaaccatacctgccacgtcttccacaatcgtccagttggtggtgccaagctgggtgtggtgaatccaggaacggtaggtgatctttccaccgttcttgctggcgtcggcgttcttctccggaatcgtgcttcctgcggaattattatccatattccagaattcgttctggtccggatactggttgtcgcctccctgataatgcgagaacgccacccaatacagcagtttcttgaacgattcgttcgtgatatatccgttgtctgcagcattataatcacggattcccgcagaatagatttgcagcagcggagttgcattgataatggagaaattgtttgatcctgggaaattcagcgccttcttgtctgcctgattcgcggtgaagaacgggaaaatcgggaattcgtcggcatcttcgaacaagcgcaacgcactatcgtaatcatcattgccgatcggcatcagaccttcggaatacggatagtagttgttgagttccttgtatttcgcgaattgaccgtcgttcagccacttgtgcagcagcagtttgctgtcggaatcccacaggttgtcgagcacatcctgcttgatggcgtcggcgatctgctgcatttcagcggctttttcggtgtctccggcagccttgtatgcttgcgcggcggcattggcgttggcccacatgttggcggaaccgtcggcacggtccatacgctggccggaacgaccgggttcggagaacgacaccgcgtcggcatcgttgccggtcatggaccaccacgaccagtcgatcagcttgttgccgttgctattctggttgtcgttgctgtctggctcgctttgcgaattgagcagacctttgacatcttcggaaccgtaatcacccaacgcttcagccaatgatgacgggccgccgtgcaccttgtaggagtcccaaccggccttggtgatgtactgcgtgtagctgtggttccaattggctggatcgcccggattgtcgtggtagtagtaatacccggactggcctttcttggctgtctgcccggccgacacccaagtgccgtacgagtattcggcgttacggaaccacttggtgtcgttgatgaacatgccggatgtcagcacgatctggttgttgtatccgagcacgccttcgatggaggtcggatactggaacgtattgcccggcatattggcgtccaacatgttgaaacggctcagccaccagcggtagaacacggttttgtcgatattgtgttcctgggtttccacgtaaggaatgttatcgacccaccactggttgtaggtggtcacggaatccttgtaggaagcggccggatcggtgagatcgccgttgaatcgggcttcgtattccgcggtggagtccggcaactcgttggcgatcaggccaagctgcagcttggtggtttgtggcacgttcgcttccaaggtgagggtggaagcgagtttgccgtcctttacggtgaaaccgttgccggagaaccgtggatagatggtggtcagatcgttcttcacattgaagcgaccggtcagttcagtgtcgccgtcattgccgtcttgtgcgaatggcgaggctgctgtcagcgttacgtcaccgccggtggtgctggtgatggtgaaattcgcgaccatcacattggtgtaggtgatgtacttgacttcggtgacggtaatggtcttgtcgccgttggtgaattccgtggtgaagtagcttggcgtctgcttgcgcttgtcggtgttctcgcgcagggtctgcttggaaccgccaatgcttacctcaacggtaaagccgtcgttgccggtctgatcccagtatgcgacatctcctacgaaaccaagtgcttccggcgtatgcgtgtacatgaatgcggcacggccacgtgagaacaggtattcgttcttgtctgcgcccgcatagttgtagtcgccagcatcgttggtgccggtaccgtttggtgcggtgcctgtgcgcgtcagcatcttgtcgatccagaagtcgtgtgcggtgtcggttccggcaccgttggcaacatccgcatcgaacacctgcttgaggtagcttgtcgagggatcgaaagcgacgccggtgcccggaatcgggtcggcggcccccttgaaactcggataccccatggcagagttcggattggccagcgcgtcattggcgtatgcggtcgtcacaccgccagacaacagtgtggccactgccgtcagcacgcccaatgacgtgacaatccctttcttccttgttgatggtgtcatcaattcctcctacatggaccatcgttggcccttggttgccaaggctcgttccctggcatccaactttctttctgtaggaatgagagtcgtgcgatggacatgagattggagcgtccaccgacatttcaagaatacatgacgcgaatacggtttcgcaaattttctttcagttttctccaatgctttctaagtgaactgccatacgatggcttttatgcgaaaaggaaagttttcgcattttcccgtcttatactaggggctatgacaaaaccggccaccccataaggggcagccggtctctcattccagtcagcgcggcgcattcggctccaatcgatcacgccgcgctcacccgcttcccggcaccatggcactcatagcgccgggtagcaagtctttcttttgtttagctgcgcaaccacacgttcatttggccgagttcgcggttggcccatgcgtagtagggcaccagcttgagcgacgtccgctcatctgaggcgtcacgctgagcggacatgtacaacggggcgtccacggcatccgcagcctcacgaacggcaggcaacgtcaccgcgtcaacacctccaagcaaatcactctcgaaagtaaccgtggcatccgcgacatccacgccatcagcaagacggtacgtccacagatcgccggcattatcggcttgctccgcgcaatagacgagcggaccgcgcatcaccgcaacacgacctgcatcgcaacgcacatgagagttggcacgcaccaatcgcactgccatatcaagatccagcaccacatgcaatgcagttcccggagcaactgcgaaatatacgaaaccgttttccggagccgtcttcacagcaacaccatcgcatgtcagcgcataggaatcagccgaccatgtgggaatacgcacgccgaaacgtaccgaatcagccgcctcagcgggcaattccaccatgtactcaatatgaccgttccacggaaaatcggaacgctgctccacatgcaacccggaatcaaaacttgcctgattcgcaatgaactggtgagcgagcaccgtgcgaccgccgtcacgttcggtatacacataacggtccaccgacgcgatcaatcgcgcgacattagctgggcagcatgcgcagccaaaccaatcgacacgatgcgaaagcacatgatgccgatccggattgtccaaaccgtccggcgaagtctccaacgcattcacatagtaatactgcttgccatcaaggctgatgcccgcgatggcaccattgaacagctcacgctcaagcacgtcggcatattcaccattcggttccaacagaagcatttggcgggcaaacatgctcatcgccacagaagcgcacgtttcgccatacatggtgtcgttcggcagatcgtaatcgtacgtgaacgactcccccacatgtgtggaaccgatcgcacccgttacatacatgcgtttcgacacgatgttgttccaaaaacgatgcgccgcatccagcaagccctgatcgccggtaatacgcgccacatgtgcgattccagtgcataaataggccacgcgcacagcatggccgtcagcggtctgctgctcgcgcaccggctgcgcggcttggaagtacgtgggcttgtagaatcccagatcccggaaaatgtagtcgttgtcgacagcggcgatctgcttggcgtagaactgcggatcctgaccacgcacgtcgatgagataccgcgccagattcagatagcgctcctcaccggtcgcatcatacagcttcgccaacgccaattcgatttccggatgtccatcagcaccgtggatcttgccgtcctccgggccgaaattggcatcgatgcaatccgccatacggcacgccacgtcaagcgcctgctggttaccggtcacctcatgataggcgacagcagcctcaatatagtggcccatgacatacatttcatggctttgctgaatcagtgtgaaacgctcacgatgcgcccattcaccggttttgatttggtacggagtgtccaaatatccgtccgattgttgcgcacgtgcgatgaggtcgacggttttatcgcacagttcccgcaattgcggatcaggatgatacgacagtgcgtaagccgcttcctccaaccacttatatatgtcagaatcctggaagaccatgccatgaaattcaccggcctcatcaccggctgcgatacgcagattctccacggcatgacttttattatcggcaagctgattgccagccggatcatccggaacttcagtggcaatctcatcattcatcacaccccactgataaggaatgacggattcaacgatctggtcgcgacgctgcttccagaaaggagaagtaatagttacattcatgatatttccttaagattaaggacttcgccagcccttgacggctcttggctactccgccttcggttctgctcaggccggagcctggaaacagtccactgggctgtctcccaagggctgacatcgccaggtgtcagcccttgacggctccagccataaaccctttgacgtagtacttctggagggctaggaagaggatggctgcggggatcatcagaattacgacgccagcttcggtggcaccgtaatcaatgacgcccatagtctgctgacgcatgttcaccaaagcgagcggcagcgtggcgttcgacgaactcgacaggtacagcggaatcatgaaattgttccaagcctcaaggaaagcaagcagaccgacagtgaccatcgacggcttgacgaccggcaccagaatcttaatcaacgactgcagggagttgcagccatcgaccatggcggcctcttccatatccttcggaatcgcatcgaaagcattacgcatgatgaacgtgctcatcggcagctggaacaaggtaataaccaaagcgacacccagcaaggaatcgttcagaccaatatccttgtaccacaccatcagcggaatcagcagagacgcatacggcaccatcaaaatggacagcgtcaccatgaatccgagattgcggcccggatagtcgaaacgggagaacgaatagcctgcgagcgtgcacaccaccacggagaacaccacggcgaccaacgtcaccaccaccgagttgaacaggtacttcggcaggccttcctggtagccgaacaacgtcagatagttgttcacaccccagcccttggattgtgcggaaccaggctgcggactgaacgagcagaccaccacccagatcagcggcgaaatgaagaccagagccagcagaccttcgagaatatagacgattacgcgcttccacaatggagtagtcatgtgagttccctccccttgctcacttggtgttgtcgcgcataccgcgcatctggatggaattgatcaccacgagggccgcaagcacgatcagcgacagtgcggccgccatgcccagatccttcttggaatcgaatgcgaagttgtagatgagctgcaccacggtcatggtggaattgttcggaccgcccttggtcagaatgaagaactggtcgaacgcgaggatggaaccggtgacgcagtagatcaggcacatcacgatggtcggcttcatcagcggcagggtgatggaacggaaaatgcgccacgtgccagcaccgtccatgcgcgcggcctcatacaggtcgcccggaatggcctgcaggccgatcatcatgagcagcatgtagtagccggagaaacgccagacgatcacaataatggtggcccacagcgcgctctggccggtggcgagcacggagccgccctcatccatcaatccgaagaagctcaggatcttggtgacagggcccacctgcggggagtacagcgcgtagaacagcagcgaagcggaggcgagaccggttgcggacggcagcaggaagcacgtgcgcagcatattgttccacttggtgctttcctgcacgatcagcgccaggccaaggccgagcaccagcaggaaaatcgtgacgatcacggtgtattcaagtgtgaacaacaccgactgtccgagcagtttattttcgaaaaccttgacgaaattctcagggaaattccaaccacggttaccgcccatcaacgaccagcgggaaccggccatgatgacgagcagtacgattggcacgaagaacagcatgatgatcatcagccaatcaggcagcgcatacagcaggccacgacgggttgcctccgccttggccttggaacgatgcgtcttcactggcgcagcgttcttggaaacagtagtcatattccctccttggaacacttttggcgactctctcttgaatcgttcggggttttcgacataaatggccaagcgattggatatgcgtttggaagtgcgattccgtctcgtgcggccgttgaaatccgccatgaagaccgacattgtttttgaagtattgtcgatctccatggcagaccacaactgtggtctgtcgatttttgttttcgatattcagttattcgatattcagttgttcttaagttatgtaaatcggggaaaggagaaaaaggaggagaagtttgttttcagtggctcacctcactgacccagcacgtcggtgatggcctggttgtcggccttgagatcgccatcgccccagactgcgttctggatgagcagctgccacggggaaccggctgcgttgaaggcctcattgaaagctgcggacttcggggtctggccattgccgtcgatgattacggagttgatggtctggacgcgaggatcggcatcgtcgtaggcggtcttcagggtctggatgttggatgcggtgtcgccgttggctgcgaagacttccttctgggcatcatcgctcatgagccatgcgaggaagttccaagcctgagcgacgtgcttgcagtccttggagatgcccatggcatcgccgccgaggaacgtggaggtcttgccttccttggtgcccgggatcggggtgacacccacttcgaagccgccgtccttctcagcttcgaacagtgcggtggaggaggtgttcggatacggcatcacaccgatgttgccgttggcgaacggagcggtccaagtggcaccggtttcttccttggagcctgcgcccaagccgttggtggtgttggcgagttccttgtaggcgtcgagcacggccttcatggaatcgttgtcgagggtggcttcggtgccatctgcgttcatcacggattcgccgtcagcccacacggacgggaacaggtcgaacacgagagcgccaccggactggccggccaagtaggagcctgccacgccgtccttgttgagggccgcgaccgccttggcctgctcaacgaactcgtcgatgctgctcgggcccttctccgggtcaaggcctgcttccttgtacagatccttgttccataccatcacggaaacgtcggtgatgaacggcagcgtgtattccttgccatccacggtaccggcttcaatgtggccctgctgcaggtcggacttgttgtcgagtccgtcgatctgcttggtgatgtcggtgaagatgccttcagaagcccagtacggaatacgcaccacgtcaccggcgagaatgtccggaagggaatcggtctgggaagcaccaccaaccttgccttccatatcgtcgttcggaatgatttccagcttgacctggttcttgtgggaggcgttgtaggccttcaccgcgttcttggcctgacgctccagcggagaacgggtccacagagtgatctcagtgccgtcatcagtgccggctgccggaatatcggccggagccgcggatccaccactgctggaaccaccgccgcatgcagccatcggaataagcaacgcggttgccgcgatgccggcaataacgcgagtgaccttgttgaaagacaccatgtctacttctttctctatgtatcgctcagctttgagccatccggcgggccttccgccgtctgccttcacgatttccggttgttctccttcgattgaaccgtagtgcgaaagccttttctcagtatatggttttttccagattttgcaaaatcgctttcgcacatcagaatgcaaaggtattcatgtcgataaaaccgttataaataaacgattcttagcattttaagaatcgtttatgacagcaaaaaatgacgtgagatgcagaaaatgcgaaagaaaaatgtgttcattttcacaaatgcgaaagtttcgcaatttgcaagtgaaaatgtcagcaatcggctatataaagccgttttgtccactttttgacacgatgcgaaaactttcgcagttttgtcgtataatattacgcaatacaagggcggcgaagcgcatcgacgcgcagccaacgttttcgtcacaccgtaaaaaaggggaacatcatggcaactgcagatactcactcaacagcaaggcttgaagatgtagcagcgctggccaacgtgtctttggcaacggcttcaaaggcgctgcatggcaaaccgcgcgtcagcgaagacacccgcgagcgcgtgatggaggcagcgcggcaactcaactattccccgaacaagctggcgcaatcgttggcaagcggcagaagcggaaccatcggtttggtcacttccgatctgcaaggccgtttctccacgcctattcttattggcgccgaaaacgagctgcgcgcacaatcgacatcggtactactcgccaatgctcgcggtgacgatgcgctggaacgcagccatgtagagaaactgctgtcgctgaaagtggacggcctgctgattgtgcagtgcgagacgaatccgcgcccgtcgctggggcgtgattggggcgtgccgctggtgtatgtgtatggtccttccaccgacaccaacgattgttcggtgacgtgtgacaatgtggacgccgggcgcatggccgtgaatcatctgatttcgtgcggacgcaaccgtatcgccattattggcggcgatgaaacgtatacggcctccaccgaccgcaccaagggcgcgttggaagcgttggccgaggttggtttggaaccggctggcccgattcgctatggccgttgggacgagaattgggggcgtgccgccaccagactgctgctcgaccaaggcgtgaagttcgacgccgtggtatgccagagcgatcagctggcacgaggatgcattgacgcgttgaagtcgcagcatctacgcattcctgaggatgtggcggtgatcggccacgataattgggacgtgctcaccaagagctcccgcccgccgctgaccagcatcgacaatgaaacggaactcatcggccgcaaagccgcccgctacctgatggacgccatcaacggccagccccaccacggcacggaatatctcccctgccgcctcatccaacgagaatccaccctccccctagcctagcgtcatcgttttttgttggaacgtcccttgaagtaaatgtcgaacacgatccagacggacaaaacgaacgcgatcacatagccgaggaaaccaacgattggaataccgaaaatcaccggtttgatgcccgcatagtacacgatcgacgagccgatgaacaatccgacgacgatcagcgccatcgtaagcctgttcaccatgttggcaagcagatggatcggttcctgcgaaccgaccatctccatattcacgcgcaactggccgcgcgtaagcatacgggaggccactttcagctcattggcggcagcgagcaggctgtgcagcgcctgatgaccttcgataaccagcgatttcgcctcatccttggcgaaatccttcttcgacgtgcttgcggcgatatggtcggagatgatctgaatcatattcacgtctggaatgaactcgtcgagcaggccttccaaagtgaccagcgcacgcccgacggtggtgacggtgctcggcacttcaatgccgtgtcgttgcgccatttgcgtcaacgcggtaagcatggcggcgatatccagctcggccaaatccactgtgccgaattccttgacgatcacatccaagtcggccaataacgccggataatcctccggatcggcctcggcaccggcgaaacgcagcagaccgtcggcaagcgcgggcgaatcctgtttggcgaccgcgaaaatcatgtctttcaagacggaacgggttttggcattaagccggcccgtcatgcctaggtcgagcagcacgatctgcccgccgcgcaccatgatgttgcccgggtgcggatccgcgtggaagaagccttcgtcaagcacttgcgtggcgtaattgtcgaccagtttggtgccgatttccttcagatcgtagcccgcttcgatgagctcatcaggatgcgagacggaaatgccttcgacgtagtccatgaccaccacgtgttcggtgcacaggtcggagtatggcttcgggcagtccatgtatttgtagtgttcgcagaatcgtttgaattccgccagatttcgcgcttcgatcatgaagtcggtttcggcttcgaaggtgtcccacagttcttcgaccacgccggagagatcgaccacttgggcgctgggcatggttttggcggctattcgtgcgatggtgcgcatgatggacacatcctgtgccatggtttcgcgcacgcccgggcgttgcactttgacggccacatcttctccggtagtgagtttcgcacgatgcacttgcgcgaggcttgccgatccgagcggtgtggcgtcgatatggtcgaagatttcgcctgccgggcgtccgtattcgtcttccagcacttgcaggacggtgccgtacggcatggggtcggcgtcggcgcgcagtttggcgagttcgtcgcagaacgattggggcaggatttcggagcgcatggacaggatctgcccgactttcacgaaagttgggccaagcgcttcgaacatgagccgcattttgacgggggtcaggccgtgcacaatgtcgaattggttgacgatttgcgcgatttgcgcaagtcgcttcagtttgcctcgacgagtcaggtggtagcgctgcgagaatgagtctttacgcgggccgaacagtccgatggtttcggattgcgtaaaggttgcgtcgttctgcttgccttgcgattgcgggattcccgtttttcccgcggatttggctgccgttgccgcagccgcgtcggacgaggggttcgccgtcggattgatcaccgcgttgactcggtcggaaagtgtgaccggctccacgctttcggggcgggccgcatccggctcgatcggagaattcaaagacatatcgctgctcgcaaacgttggtcggattacgatgagtgggattcatgaggagacttgcgtcccgcgtatttcatgcgattcgcatgtttcgcacgtttcttacgttccgcacacggccgttcgcatgtttcgcaagttccgcataacaaatcgccgtctgaacgtgatgcgacgagcagacggcgatgtgaacgattgaacgttactcggctttggcttcaggttcggcttccttggtttcctctgcagccttggcttcagaggattccttgacctccgcgaccttgtgcttgagttcggcgttgagggccttgccctgttcgacggtcagctcgcccttcttgacgagatcgtcaacgatttcctggctcttctcaaccgtggtcgccaaagcgccaacgccggcgaggaagaccttacgcaggccgtcaccaaaatcaaaatcagccatgattacctccttaggtgatggtggtacccactctatcgcattttcttcacaaataacgtcaacgaaactagtcaatcgttacaattctgcggaagactcgctgccgtatgctcacagcgtacgaaaacgcgaaaactacgaaacagcgcgaaaacaatcagcgcgggcgtgacatggccacgcgacgcgcgttgctggcaatcgtgttgatgcgatcaagttccgcacgctgcgcttccgtctgccctgcagcggccggatcgaacgaaccataccggcgttctgcggcggtgcggatcagaaaatcggcgatcgcggggtttttcggcagcagcgagccgtgcatgtatgtgccgatcacattgttgacgcgggcgccttccgtatgatcctcgccattattgccggtgctatccgcgtcgacggtgccgagcggctgcacgccttcgcgcaggaaggtttggccggaatggttttcgtagccgatgatgtcaccgaaatcggcggaatgctcggtcagattgccgatcatgcgcacttcctgaccgaccgtgtacgcgccgatcacgccgatgccgtcgagccgggagccatccaccgtttcgaaatattcgccgaacagctggtacagaccgcaaatcatgagcatgggggtgccgtcggcggccagcgatcgcagcaggtcggcgcgtttgaagaagtcgtcgatgattttcttctggccggtgtcttggccgccgccgcccagaatcatgtcgacgtgttcgggccacgcgtcgccctgattgtaggcgtgcacgcgcggctcgtagccgtatagggcgagacggcgctggatggtgagcacgttgccggagtcgccgtaaatgttcatgtctttcggatatagcgacacgatgtcgattacctggctcatatcgtctccctcatgcggttcatacgttcttcatgcgttttcatgcgttgcgcggattcacgctgttatttgcccacgccagcgtcggcgacttcggcgattttgccgagcgcggctcgcgttttgagcattgccgtgtatgtgcagtaaatgtgcttgggggtgcccggattcgcgttcacgaacgttgagacggcctcttcaagttccgtgttgacgctattcaccggcacctgatcgtattcgaggcgcaacgccatgtcccaggcacgcacgcccgaaaccatggccacaccggtgtctcgcagcgaggagaagtccacgtcccacagccagctcatgtcacgcccgtcggcgtattcgtcgttgatggcgatcatggtgtcgcagccttcaggggtgaaggatgcgagcgacagacggaatcccatggggtttttgacgagcagcagctccaccggcgagccgttcacgtcgatgacctcgccgcgtccgaacgccggagtgacttcggctgccgcgtcgatcatggcttgcgtggtggaatgcgcgaagtcgatcatgcgctgtgagattcccacttgtcgcaatagttcgtcggttacgttctgctcgaacggcaggaacattgcctgcgcatcggccacgaccgctcgcacgacggccagcgcggccgccgcgttgtacaggttgtacacgccttccagtctcacaccggtttcgtacgtttcaccgtcgatgccgaaactggcacgatggtcgcccacggcaagcaaggtcacgtcagctggtagctgttccgcaattgccgcatcttccgatttttctgcattttccccagttttcgcaatcactgcagcatcgtcaatctcaatatttgcggacgatgcagtatcgactgtcgtgcgcatgtcgtcgtcggacgggaagaagctgcgcaacgacccgtcaagaccgaaatagcgcacttccacaccatcttcagtatgtgcgacgtcagcaagtcgtgcgatgcgtggatcctcacgattgagcactacggttccggtggtcgcttcggcggctttgctcagcagtcgtgcggtattgtcgatttcgccgaaacggtcgagctggtcgcgcatcacgttgagcagcaggcagtagtcgggttgcacttgtttgacgaaatgcaccgcgtacgcttcgtcgagttccagtacggcgatgtcggcgtccagtttgccgccgagcgagacttcggccagcagcgacgagaccacgccgcgggtgaaattcgatccggtcggattggtgaataccttcaatcccaacgattccagcatgcttgccaccatgcgcgtggtggtggttttgccgttcgtgccagacacgagcaccacgccaagcggtagctgctgcagggtgcgtgcgaggaattgcgggtcgatccgttccacgattttgccggggaacgcgctgccgccgccatgtgccaggcgggaggccgcacgcacggccttgccgatcaacggcgttgcgaatgagttccacgccatgctatacctcctgttggctctggtagtcctgcggcatatctttgaacttggagtatgcgccaaggaacgcgagattgaacgtctgcgtcggaccgttacgatgcttcgccatgatgatatcggcctcgcccgggcgatcttccttgtcgtaggcgtccggcctgtgcacgaggaacaccacgtcggcgtcctgttcgatagaaccggattcgcgcaaatccgaaagctgcggctttttatcctgacgcatttcggggccacggttcagctggctcagcgccaccaccggcacttccaattccttggcaagcagcttcaatgcacgcgagaaatcagacacttcctgctggcggctttccacggccttgccggaagtcatgagctgcaggtaatcgatcaccactaatttcagatcgttcgtctgcttcaatcggcggcatttcgcacggatctccatcaaactcatgttcggactatcgtcgatgaataatggtgcgttctgcagtttatcctgcagattattgaggatattccaacgttcctgcgtgatttcttccgctcggcgcatggctgacagcggaatattcgcttccgccgaaatgattcgttgcgcaagttcggttttgctcatttccaagctgaagatcacggacgtcatattgtggtgcagcgccgcagctcgcgcgaaatcaacgccaagcgtggacttacccatggccggtcggcctgcaacgacgatcatctggcccggctgcaggccttgcgtcacgtcgtcgatgtcacggaatccggttggcacgcctttggaaacctcgccgttttgcagtcggtcgatttggtcgagggtgtcggtgatgacggtgccgatcggcgcgtaatcctgcctcactttgccggtcgacatttcgtagacttcggcctgtgccaggttgacgacgtcttcggcttgggatccttcggcggtgtagccgagctgtgcgattttggtgccggctgcgatcacattgcgcaggatggcacgctggtggatgatgtcggcatagaaggttgcgttggctgcggtcggcacggatgcgacgaggctgtgcagatagtcggatccccccactttttcgaggtcgccgtctttgagcagctggttggccaccagcaccgcgtcgacgggctgcgatgcggagaacaggttgatgatggcttcgtacacggtttggttgcgcggctggtagaagtcggtgatgtcaatcatctgcgagacttcgccgatggcgtctttgctcatgagcatgccgccgagcaccgccatttcggcggcgtcgtcatgtggcggcacacggtcgaagatggcgtcgcgaatagccgttcccgacgcgccggaaatgctgccattgcctgaaaaaccgcggttttgcccttgatccaggccattgttccaagaattgctctccgccatgcttctccagctcttcgatgtgtggtgtaccgggaaaaaccataatacctgtgccacttcacgaatgatgttgcgatgagattctggaggaatctccgcattggcaggatcggaatcacccgacacgcgcgaatcggttcgctgtggataagaaagccgaaaaaacccgagttatccacatactggggataactatgtggaaaacataccgagttatccaccaaatggggataaccaagtggacaacttggggacatcttccgtacgggtgcccattcccctggttttgacttgcttaagtgaaccgaaggtgatatgttccccactttttcttaaacgatgggtttccgccgacgcggcgggtaccgcatcggcagccatgtcgctttgccgggcattcgctcacagcctacgcggcctcacatgtggtagcgggtggcgttgtacatggttcggacaagggtttcgcgccatttactccagccgtactgtttggaaatggtctcgccggccgtggcacccaacgacgaaccgtcagcacgagtcagatcgaacagcatgtcaagcagcagcggatcatgatcaagacgagacgccaactcgtcaccaacattaggatcattcggattctgaccagtcgcaaactccgacaacgtaagatgctcacgcaccaacaacgtgacccaccaaataatgtcacgatcaaaacccatgcgcttcaacaccatggacgcatgacgcgcaccctccgccgcatgatcgaaaacccccggacgcttaccgacatcatgcaaaataccagccaacagcaacgcctgataatgccgatcatcatatcgatttccacgaggtgtttcacgaccaagccgcgtgaccacctcaaccgaatgacggtcaatcgtataccgatgcgcagccgaagcactcgggcgattacgaatcgccaaccattccggaatcagccgacccggaatatcgacaaaatcaatctcctcccacacctgcaacaacgcgggaccgctcgcaagcaaacgcaagaacagactacgcgactcatcattccacgtgcgatcatcgatcggacacgacttcagattctgcaacgtgccgggcgcgatcggcagaccaaactcagccgcagcaacagcagcccgcaacgcaaggcacggatcggacttcggatcggcacccggcgcaagcacgatctcctcctcatgcttggcgataccgggcgcaatcacatcaaaagtaggcgcctgacgcttaccgccgccacgaggctggaacacctggaaaaacgcaaaacgaggcttctcatgagtcaacgaatgctcagcgcgggaagccgtggaatcaagcgaaaacgcgatctggcgaccaacacgcgcaagcaacgtctgcaaatcatcaatcgacttcgcctcacgctcgccgctcggcaacgtcggatcagccaaacccagcatcgccgaaaccttcgcctgataaggagcgagcaacatattcgtgtctttattggccaccaaatgaatgcaatcgcgcacatccaacaaccgttcgacggcatcgtcatactggccgtgcgggcggtcggcaagccaagaagcggcaagcgcggagaccagcacggaatcgcgcaaaccaccgcgagactccttaatatcaggctgattgctatacgccatacggccgaactcatccaaacgagacttggcggaacccaacaattcgggcaagcgcttacgggcggccctacgccaacgctccaaaatggagacagccgtggattcaatcagctgcgtatcgcccgcgatcggcaccacatccagccagcccatcgcagcaggcaaatcatggtcggtcaccgcctcgcactgcgcgcgggtacgcaccgactggtcaagatcaagaccagaatcccaaatcggataccacaatttgttggcaagctcgttgagctgctggtcggtgagcgcgtgaggctcataaatgaccaccaagtcaagatcggagctcgggcccacctgaccgcgggccaacgaaccgaccgcgccaagaccaataccagcttgtggaacgtcaaaagacaccgtctggcaagcctcctgccacaattgtttgaggcaatccatggccagatccgtacgagccttacgtttcgccgcaccattgcggtacacgccgtcggcatccggctgactcatatccatgaaacgttgtttaagaccatcaaccgctgaagtcataacaaatccttatgaatcttcgcaaaagcaagcaaatctgagcagataaaagcgaaagcggggaaatccgaagcagacaatctgacgcgaaaatcgtatgaaaatccccgcacggcgcgaagcacgtacggggatctgtctattgataacccgaacctaagcccggggcccttaatatctatccgaatgaattatcagatagcggcagagccggtctcgccggtgcgcacgcgggtcaccgaatcaagcggggcaacccagaccttgccgtcgccgatggtgccggagccggcggacttgacgatcacaccgaccagagtctcggcatcggcgtcatcggacagcacctcgacgcgaatcttcggaatgagatccacggtgtattcggcgccacggtaaacctcggtgtggccacgctggcggccgtaaccgttagcctcagacacggtcagaccgtgaacacctgcggcagcgagggcttccttgacatcgtcaagcttatgcggctgaatgatagcggtaatgagcttcatctcacttcacctccttgagaacagagctggcggtaccagcaaaatcgtaagcacgttcgccctgatcggcaagatcgataccgccgacttcctgagcttcggtgacacgccaaccaatcgtcttctccagagcgaaggcgatgatgccggtgacaacagcggaccagatgatggcaacgagggcaacgatgagctgcacaaccagctgcttccagtcgccgcccgcgaacagaccggtaccttcgccgaagaagccgataagcacagtgccggtgaagccgccgacgccgtggacgccgacaacgtcgagagaatcatcgtagccgagcttgaacttcaggccgcaagcgaggcaggtgagcacgccggcgatggcaccgagcacgatggcccacagcggggaaaccacatcggcggccggagtgatggcaaccagacctgcgacgatgccggaagcggcacccatggcggtgtagtggccggtgcggatcttctcagtgaagccccaagagagcattgcggcggcggttgcagcggaagtggaaacccaagcgtagcctgcggtgccattggcggcaaacgcggaaccagcgttgaagccgaaccatccgaaccacagcaggaaagcgccaagcatcacgaacggaacattgtgcggacggaacggctgggtgccgaagcccttgcgcttgccgatgatcaacacgatcaccagagcggcgactgcagcattgatgtgcacgaccgtaccacctgcgaaatcgtgggcggcagcgccgatagcctgggagatcgcgccgtcagcgctcagcagaccgccattccacaccatgtgggcgagcggagcgtaatcgaaggtaatccacagcgcgacgaaaatcatccacgtggagtacttgacacgttcagcgatagcgccgcaaatcagagcgacggtaatcatggcgaatgcggactggaacgccacgtcgacgctgaccgggtagttgttggagttcagcgaagccgacgtgaagacaccgccgtcggaaaccatggaatccttcagcaggaagcctgtggccggatcaccgaagacaccgccgaccgaagtgcctgcgtaggcgatggaccagccccacagcacccagatcaccattgtgacggacagagcggccgcctccataatcatcatgttcagcacggcctttgcgcggaccatgccaccgtagaagaacgccacacccggcgtcatgaggaacacaagggacgcggacgtcaaaatccacgcggcatttccagaatcaagctgacccatgtcaccctcctctttctttcattttgagttcacatttccggccccatcgtatggggctgacaaaacggtatggaacgccgcccgcgttttgaaaacgttacgacgtgttacagcaaggtaacgccatctcgccattacgtcaaccgaaaacggcggaataaagcggctggcacgttttgtttcagattgcgcaccgctctcaggccaaaccactatcagcccatttttcagcgtatctgccttatgtatgacagatttggaggactgacacgagacatttcgcccatatatggcactctcactcgcaaaaaggtgctttcgggggtaaacatataccttctaagtcgactttctccaaaagcatctgccatatataagcgagaaaccagcggacgaaccggcaaatctgccatatataggcgaaataggactggtcgggggtaaaaagaaagcctcccacgcggggaggctttctcgggagcgcaatcagctcaggcgaggatgccgtcgacgaagccttccggatcgaacggggcgagatcgtccggaccttcgccaaggccgacgagcttgacgggcacgccaagctccttctgcacggaaatcacaatgccaccctttgcggagccgtcgagcttggagagcaccacaccggtaatgccgatggcttcggcgaacaccttggcctgggtcatgccattctggccggtggtggcgtcgagcacgagcagcacctcgtcgaccggaaggttcttttcggtaacgcggcggatcttgccgagctcgtccatgaggttcgccttgttctgcaggcggcccgcagtgtcgatgatgagcacgtcggcgttctcttccttggccttggcactggcctcgaatgcgacggacgccggatcggcgccgtccttgtcggaacgcacgaccgggacaccgaccttggcaccccaagtttccaactggtcggcggccgccgcgcggaaggtatcggcagcgcccaacatgacctgcttgccttcggaaacaagcaggcgggaaagcttgcccgcagtggtggttttgcccgtgccgttcacgccgaccatgatgatgacgcttggtttgttggcaccctccttattggcattgaggcggcgatccgtgtcagtgcctacgagcttcaacagcttgtccttcagcgcggcacgcacttcggccggatcggactggcctgcgattcgggcgtcgttgcgcagttcctcgacgagctgttcgctggcttccgcgcccacgtcggcaagcaggagggtgtcttcgacgtcttcccagtcggcttcggaaagctgatccttcgcaagaatgttgaacagagccttgccgaacggattgccggatttcgacaggcgcgccttaagacgctgcatgcgcgtgccggcggattcgggggtttcatgaaccggttcgggcttggcttcggtggctggtgcaggagctgccgtttcggaagaggaagcttgagctgaggacttctgctgactttcagccggagctttttcagctgcatcaacattggaatcaacggacggcttcaccgtggaagaatcagccgcagccgactttgcttccgcggcaagacgggcgtcagccttggctttcgcatcctccgtggacttatcgacggcgttcttgcgggtcttaccgagccaccaaccgccaatcaccagaattgccgcgataacgacaacggcgacaatcgcaataatcacattcgtatccatgactccagcctaaaaagcgcaacggacacaccggctccgccccgcggacgcaccacgaatgtccgattctgcagaatcggacaacgaaccgtccaaataccgagcccaagtgtccgattcaccagaatcggacagactatccacggggcatgaaaaactggacggcatggccaatacatccagaatgacgtcgtatcagcggcgcgagcagctcatcgaaatcggtcgttcgctgttcgcgtcgaaggggttcgaagcagtgagcgtggaggagatcgccgccaccgcgaaagtgtcgaaacccattgtgtacgagcatttcggaggcaaagagggcctgtacgctgtggtggtggaccgtgagatgcgcgcgcttaccgacacgctcgtcaacgcgctctccgacccacaagcgcacccccgtcaaatcgtggaacgcacggcgctggcactgctcacctatgttgaggagaatgctgaaggattccgagtgctcacccgcgattcgccgaaaaccgatccggccagctcgttcaattcgcttttgggagacatcgccctgcgcgtggaagacattctcgccgaagcgttcaaacgccagcacctgccggccaagggcgtgccatactacgcgcagatgctcatcggcatgaccgtatatacctgccagtattgggcggaccagcgcaaactcagtaaagagcagattgccgcgcacatcgtgaatctggcctggcatggcttgagccgcatggaagccaagccggaactgcgtttcgaaagcgacaaagccacaaaagaggcggaaaagcaggaaaggcgcgaaatcaaggaaatcgcgaaacgcgagcgcaaggccgcaaaagaggcacaatcacaaaacaatacggaaagcccagccgagcagaacgctgaacagaataccgaacaaggcgcagccggaagccaaggcacgcaagccgaacagcagtcgtaaaacccagccgcccccagtcatcgtaagcatcgcagccaacgccaacaggcgtcagacgcaggaatcgaacagtaccagcaacaggggaatcgcaagcatcgcacaagccaacaagcatcgacgaaaacttacaaattgtcaacaacggtacccttaagggaaatttcaggtgcagattgcgctattcagggtgcctattgcgtacaaaccgttcccctgaagcgaacaaggtgctacgttagtttcgttacgcagtgaccacgcgccgcgcgcggcaggtcacctcggccgaccaaggaagactatgcaggagaagaagacgctcaccttcgtggtgcccgcgtacaacatgaccgaatatttggaacgatgcgtcatgtcgttaatcgcagcgaagcgcaacgacgacatcgaagtgctgatcgtggatgacggctcgtccgacggcacgctggaaatggcacagaaattcgaagcccgctatccaggcatcgtgcgcgccatccaccaagagaacaaggggcatggcggagccgtcaacaccggcatcgcggcggcaagcggcatgtacgtgaaggttgttgacgccgacgattgggttggccccgaatcgctcgaacaggtcatggccgtgctgcgcgaagaggccgattccaccgagccgatcgacatgctcgtcactaattatgtgtatgacaaggttggcaaacgcaacaagcatgtggtgaacttccgccatgccatgaaggccggcgagcgcctgacctggaacgatcttgggcatttcggcttggctgaatacattctcatgcacgcgctgacgtaccgcaccgccgtggtgcgagagtccggcatgcagctgccggagcacacgttctacgtggacttcatttacgcgtatcagccattcccgtgggtgaagaccatgaagtatttggatacgccgttctaccactatttcatcggtcgcgacggccagagcgtgcagaccgacgtgatgatccgccgcgtcgaccagctgcgcctcgtcaaccagtgcatggtgcgtgcaactccggaacgcggcacggtgccggacggcctgtaccgttatatgatccacttcctggcgattgaaagttccgtggcaagtgtgttcatgattttgtctcgcgatccggaaaattatgagaagaaaaaggatatgtgggacgacattaaggcgtactcccccactatttacaaggatgtgcgcaagaaggccatgtctcgtgcgttgaatttgcgcgggtcgatcggtcgtttcgtgattcgcaaggggtatttcgtggcggaacacgtcgtcgggttcaactgatcgcgatttccgacgatttgatggtcaatcgacggtctagatagcactatctgccttatatatggcagatgcccttgatagcaaggtgacttagagggtatattttacccccgaaatcgccttgcctacaagcacgagtgccatatatatataagcgaaatgcctcgtgtcagctctcgaaatctgccatatataagcgagatatgggcaaaaactgacgtacgagaatgcggatgcagtcgtgaggctgtcgggagcagcactgacacttccaacagcctacgttcatgcggaacctccccgagcgcggaaacttggcccattgggacgggttttgccgaatttcggggctttatgcttagttccagcggtcggacatggcgaaactgttatgcatgagattgctggacgtgtagagcacgtcgttgagcagtttcgtaacgtgagtgcgcaaatattccgccatttcttcgttggactgctgcagtctggcgatggttgcaatacttgcgttttccgtaatctccgcggcccctgcacgctcctgcgattcggacacgctcgtttgcgcggacatctcacgcaattcggcatcagtacgttccaccagacgatggccgtaagcgcgggccgattccgcaaatccttcgatcgcattgctggtttcgtagaaatgcgcgtcggcgagcgcggcgatcaaacggttcgcccagtacaggttgccggtcgagacttccggcgtggtgtcacgcaggtaggcgggcgtatcgtcgacgttcgcgtagaacggcgtggccgcggtgaaggggccggaaccgtatgagatccacatgatcgaacggcttgcctccggcgcgtacggacgaatctgcatggccaccatatgcccggtgcggttgatgccgatcggacggtagcgatggcggctttccggcgtcccgagcgtaccgtacggatcgtaaggggtcccctcgaagtgtgcactcatcaggaagtcgacgtcttcgagcgtcacagcgttctcaggcacacgacaccacggaatatcgtcggacgcgggcgtgtaacgggcggccggcgaatcccaatcctcgcttggattgaggtagcgctgcatgtaccaggcgcgcggcgtgttgtagatatggtctttggtggtggcggtaccgaaggctgtgcgcggattgaaatggttgtggcccagcgccgcgccgctactgctattgccgccaccgttcatgccgccgtttccgaaagcgctcgtcgactggaatccgaagccgccacttgctgccgcgctcatagtgcggtcaaggtggtgcgcgtccatgaattcgcgcagatcggcactgcacatgaattcgcgttgggcgttgaaggcgtcgtcgaagtcgaaatcgtcgatgccgagctggttggggatggtcgcatagcagtcgtccggcacgcggcgggcgatccaatggtgcccgccgattgtttcgacgtaccagatttcgtttacgtcggaaatgatgatgccgttcgattcgtaggtgccgtatgtttcaagcagttcggcgagacgtgcgacgccttcgcgcgccgtggttacgtaaggcagcacaagggtgatgatgtcttcctctccgattccgcccggaatttcaggggtatcagcggcttcgttcgccggttgcagttcaacgagcggatcagcggctagcacgcgctcgttgaccgcgatggtttcggtggcgctcatcgccacattgcgctcgttgacgcccgcttccgcaagaattccgcggttcggcagcacgttcggcacaatgctgtatcggcatggattgtctggaaggtcaatttcgacatgactgagcacactgcggtaatgtctcggctggtcttgcggtgctaccgcaatgaatttcttgggatcgtaacgtccggaaccggaatcatcgtcgcgtgcgatgatggtggagccgtcgtagctggctttcttgcctacaagaatcgtggtacatgacatgcgttccactgtacgagcagatatgcagaaatgatattgcgattcgcgggaattcgatgatgattcggcaatgacttggtgataatccacgtttttcgttacttacaactgatttgtgtggcgttttgcgtaaatatgctgtatactgtctctctgttgcccctctagctcaacggttagagcagcgtccttttaagtcgtgggttgtgggttcgaatcccacggggggcaccgcgaaacccttggaaacattagcttccaagggtttttcgattcccgcgattttttggctccagacgcgattagtcgcactcacattgttcgcgtcccaaacacggattgtcacatcatcatccgcgccggtaaacaccctgccgtcgccatcatcggattcctcacccttacaggcaagacgccttgccgggatggcgccttgccgattccacaaggcttccgccaatacagcggcaataggaaagtgggaaatcgagaaaagattgcaattccaacgaacacgccctagactcttaaaaagtcgctagggggcagctatcatggtccctcggaattcttatgagggggaactccacgcattcagggcggtatttcgaaggcatcgctttggggcaactagttacgtaactaagaaagggtttccccaaatgtcttttggcaaaaagattattgcgggcgttgcagctgtagcgactctggccgccttggcaccggcagtagcaatggctgatactgcccagaatcagaattctgcaacttcctcgcaggctaaagaagaatacgccacggtgacgttctacaccgctgacggacacagcatccagggagtcacctggcagaaaggcaccgccttctcccagtacgcactcggcatccaggcaccgaccatcgagggcaagaccttcaccggctgggcttactccgagggcaccatgctcaaggacaccgatcaggtgttcgcggacatcgccgtatacgcgacgtacgcggataccccgacacaggatgacaacacccagtacaccgtctccttctacgcaggcgccgaccagctcatccagaccgtcagctactacgccaaggacaaggcaaagttctcccagtacgcactcggcatccaggcaccggccgtcgaaggcaagaccttcaccggctggggcttcgcctccaacgacggcaacgtcgcagtcaacccggactcagaagtgaccggcaactgggccgtctacccgatgtacaaggacactccgacttcggaagataagactctgaacacggtctccttctacaacaccaagaacgagctgatccagaccgtcagctactacgccaaggaccacgtcaagttctccacctacgccgcaggcatccaggcaccggccgtcgagggcaagaccttcaccggctggggcttcgcctccaacgacggcgacgtcgcagtcgacccgaacacggtcgtgaccggcaactgggccgtctacccgatgtacaagaacgctgaaaagaaggatgacaccacccagaacgtggtctccttctacgcaggcaccgacaagctcatccagaccgtcggctactacgccaaggaccacgtcaagttctccacctacgccgcaggcatccaggcaccggccgtcgagggcaagatcttcaccggatggggcttcgcctccaacgacggcgacgtcgcagtcgacccggacgcagaagtgaccggcaactgggcagtgtacgccatgtacaaggacgctccgaccgaggatgacaccacccagaacgtggtctccttctacgcaggcaccgaccagctcatccagaccgtcggctactacgccaaggacaaggtcaagttctcccagtacgcgctgggcatccaggcaccggccgtcgagggcaagatcttcaccggatggggcttcgcctccaacgacggcgacgttccggtcgatccagacatggtcgtgaccggcaactgggccgtgtacgccatgtacaaggacgctccgaccgacgactccaagaaggatgacagcaagccggccgacaccaccaagaagaatgacaccaagggcaacaccaagaagaccgttgcccagaagatcaagaaggccgttctcggcaacaccggcgctaccgttggtggcgttgcggtgttcgccgtgatcgccctgctcggcttcgccggcatcaccgtgctccgcaagcgcgcctgagtctaactcagtcaaggtggcattcgcctgaaagcgattaatttggctccgtgcaacgacttcccctggagtacttgcgcggagccaaattgccgtatttaatggcacgttatggcttcattgaacacaccctgcaataaggtcgccgacatagctaagggtgtataagataagacttggctggctgccggcgagggctatacctcaaacgcagttgataggtgaggaagagccttcgaaaacacttcttcaccctgatgcgctgccctagccagcgaccaaccatccacccctgggaatcgtacgatttccaggggtttcctgtattcagcggaaaaccgccgaacctcagcataccgtagagccaattcccgcgaatatgctcacagccccctcagaatttcctgtcagcccaacagtccttaagacagtaggcaaatcggaatcatcaaggttgttcaacacgcccacgcaaattcgcgctacgcatacttatcattttaggggggtgacaactgaggtcatttgcggtatattaccggtgttttacatatgaataaacagttttcgccgtgccatcaggcaggcattgacgtcaccaagccacccccccctatatacaaccctctccataaaacacgcacgacatgcgcgcggacgtgaattccgtggtttggggtacactgtacatattcgaacaaacgttcgtattttggggaattctggggaattccccactatatacagtgaggaaactcacgacacaccactacctgtagtgtgtatgctagatagtggcttgcgtatgcgagcataaccgaagaacgtggccgacacggctttcgcaaacgacggaagccatttttgcatagggaggaaatcgaatgaccgtgaccgtcttcaccaatccgagcaacccgcaatgcgaagccaccgaacaagagctcgcaaagctgggcgtgcgttacgacaccgttgatctgacgaagaacccatccaccttcgaacagatcaaaaacgctggcttcaagcagattccggtcgtcatctcaccgaactcctcatggagtggacataggccggatctcatccgccagctcgcgcaaagcttcgccgcctaagcgcgtagaagtcgcagggcaccgagtccacaaaggcagtgcgggcacaggtcacatgcagccgcgcacggcgcaaccaatagcggacgcaccatacacgttctttcacaaagcttcgccatctagcccataaagcagtcatccataaaacagtcagacactacatgcggctggccgtggacgggtcgagcgtcatggtctggaaccgattggccatgaagtcgtcgtcgaaatacgtggcgaagaattgcgaaacgggcgaatcctgcgcaatacccgccatacgcgaataccaggaatccagcgccatcaacgtcatcacgccgtcaacgaaaatcagcgcgaaacacaccgccgtcaacgtatagcgaatcttccacggaatacgctgaatcatcgcaagcaaatgcggcagaatcagcttcacccacaccaagccgagtattccccagaaaaacatgtatttgccggatgtgcgcccatcaatcgacagccattgacccgtgtaatcccacgcgcgaataccgaacgcaacctccatgaaccagctggtgaaatattcgaacgcgccgccaatcaccgcgctggcgcagaagatcagcatccaattcgaccgccacaagtggttgagcaataccgtcaggatcaccgcgccaaagccgtagatcggcgagaacggcccccacaaaaatccggcgcgatcctgccattcgccgaacagcacatagtggtatagcgtctccactaccagaccgaacacgcatccgaccacaaacagccaaaacaggttgaagaaatcaagcgaaatatagcccttgccggtcagatcacggccggccatacccttcgaaacagccgtctcatactcgctgcgcgcatccaaacgacgaagcgcgaactgcaaacgtcgctcctcgcgcagcgacggatcagccgtgatatgcaacgcaaccaatacaagcagctgcacggtcggactgatcagattcacacccaaaccctgcaacgacaacgacaataggccttccgcaagcgtgagcggaatcatcagatacgtccattgcgcgatatgccgacgcttgttgagaatcagcagcatgccgaaaatcgcaaggcatgcggtggagaccagcagcactgcagcatgaataaccgacagaatagtggtgagattcagcgcgccaaacgccagtttgccggaaagcgcggcgtggattgcatacaggcaggaaatcacgatgatcggcaacgtcaccacgccttcgatcaacatgacgatgccgtaaatacgtgcaatcagcggcagcctgcggtcagcaggattgccgtcatcttccgccgattgcgattgcgcaatgatgccggcctcttcgattgctgcgatttcggtttcgtcggcgatggcctcgctcacatcttcaatcttgctcatgcttgttcgtccttcccagaacaacgctaccaaaacccaatcgcagtgcgctacacgagatgattgtttgcgcgcaacgcgcacaacctgcgatttctgcctgcgcaagtcacatgtcatcccgcaatcacaagatgcgcagacagcagactcgacttgcgcagacacagaaggcaagttgcgcggtctccaacagcaagattcacagtcctgccgcggtttgtcgtgtttatttcagtcatggacggagcgcatttacgcctgtgcccaaatttgtccgagagcgggtattacgatacgggaggcgtagcgctacgaataacgtatcgctacgcgcgaacacggtcgaacatccattggactggggagacaatgcgcaacgtactgcagattctgcgtcgtgacctcaaacgactcgtcaccgtacctgccgcctgggtcatcatgatcggtataaccatcattccgccgctgtacgcatggttcaacatctacggattctggaatccgtatggcaatacccaaggcatcaaagttgccgtggccaacgtcgacaaaggcaccgacaacgccctgctcggcaaaatgaacctcggcgaccagatcgaagacacgctgaaagacaacgaccagcttggctggaaattcatgggcaaggccgaagcgatggaagcggtacagtccggcgactgctatgcggcgatcatcatcccctccgatttcagcgaggatctcgccaacgtcgtgaccgacagcaagaaccggccgacgctggaatactatgtcaacgaaaaatcgagcccgatctccccgaaaatcaccgatcaaggcgcgaccaccgttgatcgtaccgtcaacaacaccttcgtctccaccgtcagcgaagtactcactaaagccgtgaactccgcgaatgacaccatcaacggcaaaaccaactccttcgtcaacgaaaccacagcagaactcgacaaaacccagaagaacgtaagcctcatccgctccaccatcgaagatcttgacgcacagctcgccaacgtgccgcaacaaacgcaatccgcccgtcaggcaatgaacgacgtgcagctggccgcagcaagcgcgggcaagggcctggcgaacaccgccaccgccatcggcaccgcacaaaacggcctcaataccttcacgtccaacgccaacaccgctttggagaacggttccggcctgatttcgcaggccgccagcgacaccaccaccagcatcaacaaggtgaccacggccgtctcgtccgcaagcggcaccgcacagcaggccgttagcaacatgcaaagcgtgaccgacggcaacgcccggctcatcgagaagctcaagaacgtcagcgacaacgcacagtaccaagacatcatcaagaagctcgaagacaccaacaacacggccgctggcacgctcaacgacctcaaaacgttgagcgagaacacacaatccacgtccgacagcgtgtccaaactcgccaccgacttcaacaccagcacgcaaaattcgctgaaaagcatgggagatgcccgcaacacgttgaattccggtgcgctcccccagctcaactccggtctgagctcgctcgccatgaccgccggcacactgtccggcaccgtaaccagccagaccaccgtggtcaaccagacctccgccgtgctcgaccaactcgaccaggtggcgaacgacacccgcaccacgctgcagaacaccgacaagcagctcgagcaggtggagaacaagctcatcaccgtcagcaccgacctgaaagcgctcggcagcgttgacatgctgaaaagcctgaccggcgacagctccctcaacacggagaaaatcgcctcgttcatgcagtcccccacggtgatcgacacgaaaaacgtgtatccgatgaactcctacggttccggcatggctccgctcatgaccaacctggccctgtgggtgggcgcgttcgccttcgtagtgatcttcaaggtggaggtcgacgatgaaggcctcgaagacctcgacttgaccacttccgaaaaatatttcgcccgctacatgctgctcggcatcatgggcgccatccaaggcgcgatcaccaccatcggcaacctcatcatcggcgtgcagacggtgaacgcgccgctgtacatacttaccggcgtcatcacgtcgctggtatatctgagcatcaccttcgcgctgtcgacctcgttcatgcatattggcaagggactgtgcgtcgcgctgatcatcgtgcagattccgggcgcttccggcctgtatccgattgagatgatgccgaaattcttccgcatggtctacccgttcgtaccattcagttattcgattgacgcgttccgtgagacgattgccggcttctacgacgggcattggctcaagtcgattggcgcgctactgatgttcgccgtggtcgcgttcttcatcggacttgcgattcgcccgctgctggtcaatctcaaccgcctgttcgcccgtcagatcaaggaaagcgacatgatcatcggcgaggaggtacagcttccggaacgcggctacaacgtgtcccaggccattcaagtgctcgccgataagggcggctaccgtgaggcgatcgaggaacgtgcgagccgcttcgccgaactgtatccgaagctcaagcgtggcgcgctggttgccggtttcattgtgccggtgattctggtgctgatcttctccttcaccaacggcgagaagatcgtggtgcttgccacctggatcatctgggtgctgctcatcatcggattcctgatggtcatcgaatatatgcgtttcagcctgcaacgccaggtggaactcggcagcctcagcgacgaagcgattcgcgaacaactggtggaacgccaagctgcaaggctgcgccgcaagaagcgtgcgcaacaaatcaggcgagacaagctgatgcgcaaggcacaacgaagaaaacacgaaaccaaacaggcgatcgccaacgtcgcagacaccagccaagccgatgccgacggcatcgcaacactggtacaggccatgaacgcgaccggcaacaccggcacagcgagcaacaccaatcccaacggtaacagcgaaaggagcaacgcatgaaaaacatctggaaactgttcgtcggcgacgttcgacgcctgaccagcaacatcgtctccatcatcatcgtcatcggactggtggtaattcctggcctgttctcctggttcaacgtgagcgcaagctgggatccattcgccaacaccggcaatctgaaattcgccgtcgccaacgacgatgaaggctacaagtccgatctcattcccgtgaagatcagtatcggcgatcaggtggtcaacaccttgcgcgccaacgaccagatggactggaccttcaccaccaaaaaagaggccatcgacggcaccaaatccggcaaatactatgcagcagtggtgattccgaaggatttcagcacccgcatgatgacattcttcaccgcggacggcgaccatgccacactcacctactacaacaacgagaagaagaacgcactcgctccgaagatcaccggccagggagccgacaccgtggcagcacagatcaacgaaatgttctccgcaacgttgacgagcaccgcgctcaacatcgcctcgcagctggccgatgagcttgacaaaccgaaatcgcaggccacgctcaccaacttcagcaacaatatgaacaacttcgcgaacacgctgaacgacacgtcatccgcgttgaccacgttcagctcgctgacgttgagcgcgcagaacctgctcgacagctccaacagcctgctttccaacgtgagcggcagcgcgaagaacgccgtcaacgagctcaaacagtcgaagaacggcatcaacgatctgaccggagccgtcaaaaccagcacgaatgcgctcagcaccgcgttgagcagctcgtcgaacagcttcggcgctgtctccaccgatattgacagcgtattcaacaatgcgggcacccaagccggcaatacggccaccgccctgcgcaatcaggctgcgaacgtatctaagcaggcgcaaggctatcagaacatctacgatgccctcgacgagctcagcaacaacaatctggtgccggaagtcgcgaaaagcgccatcaatcatctcaaaaccaacgtgggcgcgaccattacgcaactcaacgatctagcgaactcactcaacaccagcgccgacaatatcgacgcgaaagtgagcgacaccacagccgaccgcgagcgcgtgagccaacttgcccagcaggcgaaggcctccatcgacggcatcaaaaccgatttcgacagccagctcaagccgcagctcaacgacatttccgattcgatcagcagcacggccaccgcactgagcagcacggccaccgatctgaagggcgcgttgggagatctcaacagcaccacgaagtcggcaggcaagcagctgaccaatattcgcacggtgttggattccaccgccgaaagcctcactaaggcgggcaccgcgctgtcttcgttcaatggcacgctttccgacgcgctgaacagcggcaatatggacaccgtcaaggacgtgctcggcaacaacaccgattcgctggcggcggctcttgcggcccccgtccaagtgaagcgcacggccgtgttccctgtggagaatttcggctcgcaattggctccgttctacacgattctgccgttgttcgtgggatcgctgcttatggccgtaacactcaagaccacggtgtcgcgcaagaatcgtgaggagctcgacaatccgaagccgcatcagctgttcctcggccattatggcgtgttcgccgtgatcgcactgttgcagagcacgttctcgctgggcggcggcctgctgttcctgcacattcaggcagtgcacccgtggctgttcatgttgaccggctgggtggcctccctcgtgttctcgttcttcacctacacgatggtggcgagcttcggcaacgtgggcaaggccattggcgtgctgacgctggtgttgcagatttccggcgcgaacggcgcgtatccgcttgccgtgctgccgaagatcatcggcgatatcagcccgttcctgccggccacgcatgcgattacggcattgcgtgcggccattgccggtatttacaacaatgattattggcatgcgatcggttcgctgttgctgttcctgattccgctgctgctgattggcttgctgctgcgtattccgctggtcaaattcaataagtggtatgtggcgaaggtggaaagcaccaaggtggtcgcatgattaccggagtgcatgaggcggtttccgaagccgtttccgatgtggtttccgacgcggtcagtgacgtgcatgaggccgttcgcaaggcgcagagccgccgcgagcagcttcgcgagcagaccgatcataagatcatgaaggccacgcttgcgattgtgatttccgatggtgtcggtgcggtgaccattgaagaggtcgcccgtcgttccggtgttgcgaaaaccacgatttaccgtcgctataagaatgcggacgatctgttgcgccgcgtgcagctggaagttgcgggattgccggatttcagcgatgtcgagttgtcgaaaaacggtctgctgacgatactgcaacgcattcagggctgttttttcgacagtgagcttggtttgaaagccgtcggtgtggtgctttcttccgataatccttcgttgaatgcgattgccgatcaagtgctcgttcccgcggaaaagcgtttttctgagtttgttgagcgcggcatgaaggccggagtgttccgtaatggattggatccgcaattcctgttcagcacgatactcggctccatgctcgcctgtaaggcgttgcatggcgacgcgagtattccttggcctgagaacatgacggctgttctgtggcccgttatggccgcctgaaaggcattgcagagcagagttgcacgtagtagtatctgaaactcatgagcgtccccgctacggcctttaatcactctttgagtgaggctgtagccggggcgctcattgtacgtttgcagacttttcgccgctactggacctactggatcgacgcttcctgacgggccacgtccaacgccttgttgaacgcttccgacgtccagctggcaccggccaccttgtctaccttgaggtctttgagcggcttgccgtccaccacgccgttgatggcttcggcgaacgcattctggtgctttttggagatggacgtgaacggatgcccgataacctccacattggtgacggtctggtctttgaccgtcacatgcacgtcgatggtgtcttcgcccaccggcccgtactggccgttgatcgagtaggtaccgtcggcgtagttgccggtgtcttgcttgtcggatgtagtgctgttcggatcgtcggcatggtttttgacgtccgtatccgcagaatcgccggagtcggtggcgctaccgctgttcttcgaattttcttcctgcgattgcacgctttcgccggaatttccggcatattcatcgtccatcggtgtcgccgtgggttcgccgcatgccgacagcagcgcaaggcttgccgcagacagtgcgatcactttgatcgcattcgatgattcgttgctcatgttcgctccgtacgattcgtcagtgctatggcttggattgttcggctgatttcagcttattcctcaccgccggttttcgcggctttggtcggatcggcgaagctgatggccgtctcgccgttctgtgcgccttccgtagtggaaccggtgtatgccggcttgccacccgcctgctcatagaccttccgtgcggcctcatcattccacttctcaccgacgagcacgccatggttgagcatgatctcgcgctgggcgcaggatgcgacgagcgcatcatgggtcacgacgatgatggtagtgccctgctcgtgcagctgacggaacaggtcaagcacgattttctcgttcttctcatccaaattgccggtcggttcgtccgcaagaatcagtttcggacagttgatgagcgcacgtgcgatgcacacacgctgctgttcgccgccggaaagctgtccgggcagatggtgggcacgctccttcagaccgacgcgctccaatgcttccaacgcctgctgctcgttgactacggaatggtagtactgtgccaccatcacgttttccacagccgtcagatgcggtaccagatagaacttctggaacaccaatccgatcatgttcttacgcacgtcggcaagctgcttggcgttcaaatcctccaacttgcggccttccagcatgacggaaccctttgaaggcgtgtccatgcagccaatcatgttcatcagcgtggttttgccggaacccgacgaaccgacaatcgcaagccattcaccttgcggaacggtcaaagtcaaatcgtcgacggcacgcaaatcgccgtaaatcttggaaatatgatccaattcaagcaacgtattcaacgtatgttcggaactcatgattattcctccctcaaaacgatggcggggtcgatacgggttgcgcggcgaaccggcgggatggatgcgatgacggcgatgagcacgctcaacagcagcgaagcgacgcccaatagccagttgaagccaatggcacgttcgaatacggatacgcacagcacgcgggccagcaggtagccgatggcagtgccgatcaggccgccaatcagtccgtagatggcggattccacatagaattcgatgccgatggcgcgcgaggatgcgcctaacgccttgcgcaagccgatttcgttgcgtcgctgagacacgatggaactgatggtggtgcccacgcccacaaacgtcagcacgagcacgaccagcgacacgatccagaacagggtttgcagcatggcgatgatacgagtgtcggatgaggtgattttggtgacggtctgcgctttcacgccggttgacggattcgcattgatcgatttgacgacatcgttgagttcgctgcctaccgcattgacggaatattcgatcacgtccgctccgcgtttgaaaccggccagtttggccacgtcagcgttgaccgcgtagacgatttcgtcttcgctgccgcccgtatcgacgatgcctccgacacggaattcagtgccggtgttctccataatgtcggacgaaacgcggccgttttctttggcttgcgcttcggtttggctaagagcgccggaatcctgcgcatcgtcggatgcgcggtagccgatggttacggtcgaaccgatggagacaccgagcgcgtctgccacgtcacggccgagcatcacgttgccttcgctaggccaatcgccagtcacgttccaatgatggttgagcgccttcacgtctttggttgtgatgccagccagcgtgtacggcgcagaattgatgcgcacgctttcataccggtaagcggcggaacgggcgctgtacgagcctttcaccatctggttcaacgctttgacggtatcggtgtcgatgccgtgggacttttcggctgattcggacggcgtgacgataagattcgcaccatacgcacgcatttcctcgttcatctgctgtggaacggcaatacacgtcgccgcaaggcagaacagcgtggcagcgcccaccatggaggcgatcacggccataacggcccgcgaacgacggcggaacaccgcgccccacagcatggtgaagaacatcttgcgattagtcatctcatgccccttacggactgtcttgaactcacctaccatgcaacacctccgcagacgaacagcacagtgtgccgttcgtgaccgaggccgcagccgcggccgagtttacggaacccaagttgacatcagcggccatgcaagacctccgcaggtttgagtcccagaatcgaacggatcgacgagaacgaggcgatcagcacggtaagcgtcagcagcacaaacaccagcacaaacaccatcggacgcatcgtaatgccggaaccgaataccacatgtcccacaatctgcgcaacaccggaacccaacagcgcaccgacaatcgcaccaaccaacgaaatcacagccgtctcagcgagcatcaggcgagaaaccgcaccatcggtggcaccaatcgccttcagcaacgccaattctgaaccgcgctcaccaatcgaggcggccatcagattcgccactgcaatagcggccgcaaccagcgaaagcacggtcatcagcaccatcaccgcctgcgttttctgcagcacatcgccctgcaatgcggccacctgacgcacctgcttggctacggaaccgggaatgacctcttcgatctgataggcgatggacgaagggtacgcggtgcaataccatgtttcccactcatcttgcgtgagcgcattcggattcttcgacgccttacgcgccaaatcattgtctggcgtggtcagagccttgacttcgatcttgtcgatggaatcaggcagattcgcaagcacctgcgcggtggatgacggaatgtacatcgcattgttgtcgctatcgccggaatcgtaaatgccggtgatggtgatccgctgcttgttgcggctgccgtcggcggtggttttgtagagggttacggtatctcccgtggtcacgccgagtttggatgcgagcgtggtgccgatcaggccttgcgcgctatcgtctttcggccaggagccgtcaagcttccaccacgaacgcatgccgttcatgcccgccaccgtggattcaccggaatccatatgcagggtcttggcgaaccatgtgcccacgatcggcacgccggaagccttgcaggagctggaatccaccgattcggacgcgcagttcacgtcagcatggatattaagttcgggggcaaaattcgtgatgttgaacgcccagaagatggttttgatcttcggtgcgtccgattccttcagaaatgtggtcggatcggattcggaagtgccggaagcgctgctattcgcgtcaccccccgtgttgtacaggtcgttgacgacggcatcggccttgggctgcacggtgatgttggaaccgtacgtcgacagttccgcgttcagcttgtctccaacgtcgaacaccacacccagcatggccacgctgaccgtggccgacaggcacacggtgaccgcgatcagcagtctgcgtttgaactgcctgctgaacgagcggaaaatcattcgaaaaaagaacatgactacctctttccgctcactggaaatgcgtcgacaatgcgtcgagcgtcgaagtttgaattacgattttgccggattcaacctgataatcgaacggcacaggattgcagccgcccttgaatccgatagtggcgaggttgatggcgacatcgcacttcttgcagatgatcttgccatccttctcgtaatagcccgcgtcaccgcagttatcgcatgcgtcaagaccgacaccgtacgctccaccattctttttgatgatgatgaaacgcattaccgtgccatctttcgccttgtattggaagcgatgcaggtgaccgtcgttgatctgactgaatttgatggtggccacgccgtcgctcagcgaataatcctcaggcggagacagcgtaatgaccttcttcgtttgcgccacaccatacgtgagcgcgaacgtgatgccgatcatcgcaacaagactccatgcgccggccgccttcgcacggcgacggaacgcgatatgcgatcgcacaatggcctcgtttgctccttccggcttgattttgaagcccatcacaatgctggcgaccaccggaatgatgaacaccaacaccatggcaatgaccatatgacgctgatgattgatgcaccacaccaacgccaggaacgcttccgtagggaaatgaacgatgcgcttggactgcagaatctgcgcaagatcagtgaaatgcgagacaaacagcagcgcaatcagcagcagcacggccgtggtgaacgaccaacgaatcgcagtggaacgcatcgtacggaaaatcaacgctgcaacaatcgcagtggccgcacccaatacgaaaccaagcgcacgaagcagcatatccgaagtgaagatcggatctcctggctccacaaaaatcgtcaaacgcaaaataacatcaggcaacgcacggaaggtggtggaggcaatcgcaagagcgccaatcgcattcgcaatatcgagcaacgcgcgatgatcatgccaattcgtagtgatgcgacgtgcgaacagcacaacaacgaacactgcgatatcgaaaatcacacaacaccacaacgtggggtaattgacgaacgtacgctgattgatcatcgcggatgcacgcaacgcggcgaacacaatggcacccgcgaatccaataatgaagcccgcaagacgccagtacgcgctcaacggcctgtcacgcccctcaccgaccgtgagcatcacgttcagcgccataatcagcaaagccggtgccagcgttccctgcaacaccgtgacgtactgcgtcagcatctcacacctttcgttgtatatccctgtcaaagcctagtgaattcggcacgcaaaaggaacccccttaccaagattcccccaaaagcgcgttatctcccaaaagcgcatcccctcaaacgcaagagagcggttgcttggatggttgttcgaccgtaggctcggccaaacggccttgagtgcgtcgaacgactatccaggcaaccgcgaacgccgtacccatattcgcgctacttgcatacgtttcgcgatacgtgaacggcgttaaccacgagttgaatctcaacatgaattcaggcttacatccaaaccatttcgcttggcatgtgccggaactcacgtttcagatcaccactcctgcggggtgtagttccactccgggaaagtgacctcgagcggctcggtccagaagcggcccttaacgccggtttccggatcaacatgcagcatccaacccttcttctccggagattcgatcttcagcacgagcttgtaggagccagcctcgtcgagcttgacgttggcgccgtagtgcgggccgtcggaagcgttcatctgcatgaaggtaccggaaccaacggtctcgttgttcgcgttgttgatgatctcgtagttcacggtcagatccggcacgaagtcgcccttgccatagccgagctcggtgcccttctcgttggcatggatgtcggcttccaggtggaaggaagcgtcggcagccttcaggcccataccggacggttccatatcgatcggctggaagtacacggcgttgacggtcagagcgtcaacatcctgatcggagtgcttctcgtcgacctgaatctcttcgaagccggcgccgttgctgtcatcagcgctggaatcgctggatttgtcggtggtgtccgaagtggaggtgtcggacttggcatcggatgcggaatcgttggaattgccgcatgcggacagggagaaggccatggagcctgccaacaggatgccgagcagggcggcgatcttcttattcttcattgtgttctcttccttttctttggttccttgaggaacgttggaaacttatggaaatctctaaatctttacttgtgattattgattggcgcttacttagcctgttccgcctgcgcggccaacttcatcctgtgtttcttgatgaaaccgaccacgaacagcacaaccaccgcgatcgcggcaatcacctgcgccgtaatcgtttcgacgtacggatacaagccgatccaatcgttagttggcacgctgctcaagtaggtgccttcaataagatcaccctcgatgagcgcatggatgccgccacccgcgaaaatgacaaccagcacggccatcacaatcgaagtgacgaggaagaacgggccgatcggaatcttcaccgaagtgaatcgcagaatcaggaagataacgatcagcaccgcggcggcggccagaccgccaacccacatgccgtgcgcatcctggctcatggagtagatggactcgtagaagatcaccgtttcggcgccctcacggaatacggcgaggaagctcagcatggcaagcgaggcgatcatgcccaagcccagtctctgaccggattcgaccttgctttgcgcgccggccacagccgcttcggtcttgttcctgatgtagttgttccacgcttccacggagctcttgttgagcatccagttgctggtccacagcagcatgagggtggcgatcagcgcgcacacgccttcggaaatctcctgaatcgggccggaaccgccgaacaggaacgtgaagagcacggcgaccagaccggagccggccagacctgcgaccacaccaaggtagatccacttggcgaaacgcttgttgccggacttcaccaggtaggcgatcactgcggccaccaccagcagcgcttcgagaccctcacggatcagaatgaggaacgcctggccggcggagctggtgacgagtttggtgaagccgttgacattgccggacgcgccaccgtccagggtggccgcgtctttcacaagccagcttttcaaatcgtcgacatgctgcttgatttccttgtcggaaccgccgtcgcgcatgatcttacgagtcatcttgaactggtattcgacctgcgaaacacgatcgccggaaatcacgttcatcacgttcttttcgaagccgagcttctcgtagtactggtagtaggcgttgttgaccagcgtggcaccttcgtcgcccttgccggcagcggcagcctcgtatgcctggtcgagaatgacggtcatttcgctggcaacctcactccacgtgcggtcgcctttgcctttggatgaattcttcttggccgcgtcgagcttcttgcgctcttccgcggtttgcgcggcacgctgcttcgcatattccttaggattggcgaggtcggcgttcgcgtcaagcgtttgcgcggttgcgttgatttcggcggtcagcgcgtcgattttggctgcgatggcgtcgccttggtcctgctggtaggcaagaccttcaagatcggtgaattgctgcagcagttccttctgcttgtcggcactgatggtgtcgttgacgactttcgagaagttggatgcgtcgtaaccgatccaatgcgcagtctggaaatcggtgccagcctgaccgtaattgccgtcattgtagtctttttcggcagtcgcaagctggtcttcgatgttcttcgcagcggcagtccaggaatcaaaattcgtttgaccgtcatcggcggcaattgccggctgcggaactgcggtagtcgcgaaaagcgtggtcaacgcgatcatcaatgccgcaatgaacgcgacaaggcgaccggacacacttgtagcccgctgcgtatcgcaggatgacataagaccgcttcctctctcagccattcacaatccgattcacgagtgcgccacctttgccatacgcacagtgcgcaccgacttcacaagataaaacgaaaaaaatcgaaagaacagtcttgattttttggcagttttgttgtagaaacctttaaaatggcggaattccgccattcttcttttctgtaatccgcgcgagtcgtctcacatagtgattttttgaggcgctttcgccgttcctctccatgcatattcgtgcgattggaagattcgggaattgggggatttgggatggagctggactttctgacctcacgattccgccctggtgacctcacgattccgaaaaagcaacgaaaaacaaaatcgtgaggccagcgggcgcatggacggaatcaggattcgagcacgtcaagcaccttgcgttcgttgtagaacgcgaacaccacaccgccgatgccgcacaataccgcggcgcaaacagccgcaatgcgatagccggcgcccgacgccatgccaatcgtgctcacgccggtaaacagcagcatcgccaccgactgacccatcttcatcgcaaacgtgcgagccgcatagaacatgccctgacgatcctgaccggtcgttttcgagctcgcgtcggcaatattcgcaacaatcgcctgcggaagaatgccgaacgcagccatcggaatcgcgccgacaatcgagagaatcaagccctgcgccatcggcggaatcgcagcgagcagaccggagccaagcgcgcccgcaaacgcgaacgcacatgtgaaaatcacgaaagcgaccagcagaatccgcttcttgccaacacgattcgccaatacattcaccggcatgtagaacagcaccgacactgcggtcatgagcacgaaatagatggtggtcgtggtctcgggaagtttgagcaggcttgtcacgaagaacggcaaaccagtctggaatgtagtgatcgcaacccaatagaccacgtcggagcagacgaacttgcggaattcgccgtcgccgaacgtctgcttcaacgattcgatggtcgattcggacgtgggctgcgagttgacgtaatcgcgttccttgatggtgagcggcggaaccagcatgcacacgaatgcgatggccgccatgatggtgaacgtcaaacgaatggcgttcacacgccccaagcccggcacgaaaccagcccaaatcaccggtgccacgtatgcaatggcggtgccggccacccacgtgaacgaaatggcggtggagatggtgagctgctgtttggaatcgtgaccaagctcggcgatcagcgcgttgtagggcgtgcagtagaacgtgagcgcaatgtagtagccgatcaccgtgacgaacaggaacgcgccgttgatccagctcgtatcgttgattggactccaaaacaccagcacggtgacgagggcgagcggaagggccgcaaatttgaggaacggcatgcgacgaccggattttgatgtgcaacggtcggaaagacttgccacggccggatccacgaatgcgtcgaagaagcgggcgaacgcggtgatgccgccgactacggtcaccacgccgagtacggcaagaccttgcggtacgaacacggtttgcccttgcgagatggtttcgctgtcaggctggtagaagtagacgagccaattcgaaataatgccggaaagtagcgcccagccgaattggccgacggcgaaagcccagactttgggcatcggcaggctcttcaccgtttttgttgtgcgcgtggctgcacttgcattctcgacgttccccatatcaacctccatgttgacgccctgccggcaactgtaccatgcgccccatcgcgaaagtcccatttcccccagcagctggaggaaatgggcgggtagcatcggaggcatggattctttgacgcaacgcatgccgtttgtcacggcgttttatagggcgctcggcaccggtatggtgatttccgtggattcgccgatcggtgacgagtcacgttccgcaatggaatcgctcattgaagattacgaacgcgtgctgtctcgattccgcaataattcgctgatcgcaacgattggcaagaccgagcatggcggaagtttcgattttccggattggtgcgcgccgctgttcgacctgtatgatgcgctattttccgccacttccggtgcgattgatccatgcgtcggcgaggatttgatccgacttggatacgatgcgtcgatgagtttcacggttacgcaggatgcacccgaacatttgggggcattgcgcggacgcgccacatgggggcaggatgtggagcgtcacggaacaacactggtcacgcgcggcccggtgcagttggatttcggcgcatgcggcaaaggctatcttgtcgatttgcttgggcgcatgttgcggtcgacacagtttgtgattgatgcggggggtgatttgctgattcatgcggaacagcctatttccatcgcacttgaggatccggaagattcatctcgtgcgattggagttgcacacatcgtaaatggtgcattgtgcgcgagcgcacccagccgacgccactggaacgtagccgtcaacgagcgcacccaaatcgccattcatcatctgctcaatgccatcgacggactgccagcacagcagaccgaagccagctgggcatacattccctgcaatccgcagcatttcaacaagttgcaccatactgccgataagtcggcaaacgcaactcccgacattgcgcgcgactaccccgccgccgtcgcggacggcctggccacagccttgttcgtttccgacgcaacgcaattgcagcgcacgttcgatttcgcatacgcaacattgaacgaatcccgtcaaatcgcagccagccgcaacttcccggccgaacttttcctgcgatccgcataacagccgaataacagccgaaataaacaaagaccgcacgcctttggggagcgtgcggctccgtgaaccagtcgaccccgtgaatcagtcggtgagggcgaactggctgttgtagatgtcggcgtagaagccgcccttggcgagcagctcctcatgcgtaccgctttccacgatgtcgccatggttcatgaccaaaatcatgtccgcatcgcggatggtggacagacggtgcgcgatcacgaacgacgtacggtccacggtcagcgcgtccatggccttctgaatcagctcttccgtacgcgtatcgaccgaagaggtggcctcgtcgagaatcagaatcggcgcatcctcaaccatggctcgcgcaatggtgagcaactgcttctgaccctgcgaaagcgtggccttgtcgtcaagcactgtgtcatagccattcggcagcgacatgatgtagtggtgcagccccacggccttgcatgcgtcctcgatctgcttgtcggtgacgcccggcttcgaatacgcgatgttttcacgcactgttccacggaacacccacgtatcctgcaataccatggagaactggtcatgcacgttccagcgtggcacggacttcgtatccacaccatcaatcgcaatcgaaccgcccgaaatctcatagaaacgcatcagcagattcaccatcgtggtcttgccggcaccggtcggaccaacaatcgcaaccttctgaccggacttcaccgaagcggagaaatcgttgataatcgtcttgctcggatcgtaaccgaacttcacatgactgaactcaacgtcaccgcgcaccggtttgccgttcacgccgagcagcgcctgcttgtcggattcgtcggccatctccggctcttcaaggaagctgaacacgcgctcggaagcggccgcgcaacgctgcaggttctggaatgcctgcgcgaactgggaaagcggctgggtgaacagtcgaatgtacatcatgaacgcaacgatcacaccaaactcgatcttgccatccatcgcaagcacagcgccaaccacgcacacaaccacgtagccgaaattgccgacgaaattcatcaacggcatcatcaggccggaaaggaactggctcttccatcccgaatcgtacaaatcgccgttgtacttttcgaacgcgcgaatcgaatcagcctcgccgcaatacgccttgaccacggtgtggccggcgtacatctcttcgacgtgaccgttgacatcgcccaatgcgatctgctgacgggagaagtacttctgcgaaaccttcatgattgcgcccatgatgagcaggccaaccaggctggaagcgatggcgcacaccgtcataatcacattgttgtagaacatcatgatgagcgcgcccacgaacagcgtgaccgacgtgatcagcgagccgaccgactggccgagcgtctggccgatggcgtccacatcgttggtgatgcggctgagcacatcgccgtagctgaccttgtcgaaatacttgagcggcagcttgttgatcttcacgctgatggcttcgcgcagctcctgtgcggtgcgctgcgtgacgttcgccatcatccagctttgcacgtagcacagcaccgcgtaccccacatacagcgccaccagcagccatgcgatgtgcgtgaccgcgtccatgtcgatcgcaccgagcaccggcttgccattgactagcgcaggcaggcctttggcgatctcgttggtcatgtccttgagtttgtccggaccgacgatctggcataccgtgccgatcgcgcccaatacgagcgccacaatgatggcgggaatgtagtggcggcagaaatgcaccagtttcttcatcacaccaccgaaatcctgcggtttttcaacggccccgcggccgcgtcccataggtcctcctggcatatcagcgaccctcgctttcgttcaattcgctttcgacggacggcttgccggtttcaatcggtttgccggtttcgcccggcagcttgctttcgcccgacttgccgtcgttcaattcgtcttcgctcagctgagactgcgcaatctgacggtacacatcgcagttttccagcagttcgctatgcgtgccttggccgaccaccttgccgtcgtcgagcaccacgatgcggtcggcgtccataatggtgccgatgcgctgcgcgacaatcagtttggtagaatctttcgcttccttggcgagcgcgtcgcgtacggcacggtcggttttgaaatcaagtgcggaaaaggaatcgtcgaaaatcaggatttccggatgacgatagacggcacgtgcaatcgacagacgctgtttctgcccgcccgacacgttcgatccaccctgcgaaatcgcggaatcgtactgcttttccttggttgcgatgaattcggtcgcctgtgcaacttcacatgcgttgcgcacgtcggcgcgctgttccgaagtgagtgtgcgatgctcgttttgcgttgcgatcagctctttttcgcgctttctgccggccgcggtcgaggtatcggtcatgtcgacgatgccggcatcggtggtgtcgagcggattgtcgccatagctgacattggatgcgatcgtgcctttgaacaggaaggattgttgcggcacatatccgattttgtctcgtaatgccttgagcgtgtagtcgcgcacgttcacgccgtcgacgagcacctcgccttgcgtcgcgtcatagaaacgcggcacgaggttgatgagcgaggatttgccggagccggtggagccgatgaacgcgaccgtttcgcccttcttggcagtgaagttgatgccttcgagcatggcttcacgcgaatccgggtaggtgaaggaaacattgcggaattcgatttcgccctgcttgcctgcttcgccagcatcgctgcgggtgccgtcggtgatcagcgattcggtgtcgagcacttcgagcacgcgctgtgcggacacgtccgctcgcggccacagcacgaacaccatgctcatcagcaggaagctcatgatcacctgcacggagtagctggagaacaccaccatgttggagaaggtggtgagcttgtcggccgcgtcggccgcgtcgatcaggtaggcgccgatccagtacacggcaagcataagaccgttcatgatggtgttcatcaacggcatcatgaaggccatggcacggttggtgaacagctgggtgtcggtgagttccttgttggccttggtgaacttggcttcctggtaatcctcggcattgtaggcgcgcaccacgcgcaggccggtgaggttctcgcgcgccacaaggttgatgttatcggtcagtcgctgcatggacttgaacttcggcatgacgagaaccatgaggatcgtgatggagaccagcagcaccactaccgcgatgccggtggcgagcgtccattcgagaccgtctcccgcaatcttgcagacggcccaaaccgccataatcggcgatttgacaatcatcatcaatcccatggtgatgaacatctgaatctgcgtaatatcgttcgtggaacgcgtaatcagcgaggctgtggagaatcggctcatttcagccggtccgaacgattctaccttgcggaattccatggaacgcagacgctggctgaacgatgcgccgatgcgtgccgcgaaatagccggtgatgatggcgcatgctgccgatccaagcgaaataagcagcattttgccgccggcgatccaaatatcgtgcatttcactgccgggggtttccacgagggtggtgatgtcggacatgtagtccggcagggtcaggtcaagccagatctgcccgacgatgctgaccagtgcaatgagcatctggcctatctccgctttggagaggtatcgcataatgcggaacatgcttggatcccttctcttgtgttgcgtttgaagtttttgcgattgatggattggttggatcaactacatgagttgatcgaattgcgattaatgatttacataagtcctattgaattgtcttacgatatttaattacttacagtgtaagacaatctcatatttctgtgtatttgctgagagcgattcttctcagctcggtcgcgcgcggccaacatataccattcgcgacacactcgaggccgtttggccaagcttacagtcgcgaacggcacatgtgaggcgcacgcttacgtggtaggcagtccctacgcaggatcttcagattcggcttttgcgaaggcttgctttacttcttcggcggtggggcggggctggccagggatgcagatggtcacgtatgtggcaaattcctcggtaagatccacgaattcgcgcgtgcgacgctcccccatctgcgaaaagacccagcagacggcgtcgcgcatatcctcgcgctgctgcttggccttcgcccgcccctgctcggtaagattcacatgcacaatgcgtcggtcgttgggatcgacctcacgctcgatcagaccctttttttccaacgcagccaacagcgtggaaatcctgcccgacgtgaccttcaacgcggtagccaactgcgaaggcgtttgcgcgcccttgaactcaagctcgcgaataatgaatggctcgcccttggaatcacgcgacatcgcctgctgcatctgagacttcttaccccagaccactttcatcagcttgtcaaacgactcccgctcgaagcccacgcttcacctcgccttattcgatgcccatcagttatgtctcgataatatcttttactgtaaacatttttcgatcgcaacgtgcaagtacaggaaaacgcccaaaaaaggaaacgataatcagcaaggaagcatcgcaagctcttcttgagtgagctgaagttgcgttgcagcgaaggaatcgttgatttcctgcggattgcgagcgctgggaatggtgaacagacgttcgtaacgggtcaattcccacgccagcaccacacgctggtaggagcaaccacgttgcgcggcaaccgtgcggaacggatcgtacgcgctctgatcgaacgtatcgaggaatccgccgagcggcgaccaacagacgaaagcgagccccaattcggcgcaatgctccatcgtatgttccggatcgggatgcgacggcgagaactggttttgcacggcgaccaagccgctgccgataatgccgcgcgcaagatcgatctgctcgttattcacacgggagatgcccgcatatttgatcacgccttcgtcgagcagctgcttcaacgcgccgcattggtcttcgtaaggcaccgcgggatcggggccatgcgaatacaacaggtcgagcgtatcgacgcccaagtgcaacgcggactccttggcgtcacgaatcatggtttcggggcgcgaatccgccatccacccgtattgactgcccgccgcctgcaaatgctggcgttcctcgccaggccgacggctgcatccctcagaatcccgcccctgagtgtccgattctggtgaatcggacatctgtgccccaaatccggcaccctgtttgtccgattctccagaatcggacacaggagcaacaaaagcggggacctccatggtgcgtcgatagccggttttcgtggcgaccagcacttcatctcgggggccattccacgaagtgagcgcatcacgcaccaacttttcgccgtagccaaggtcttccgcagtgccggtgccaggctcgctcggcagataatatgaccaagccgtgtccaaatagcgaacacccgcgtccaaaccggcatgaatcgtacgaatcgcggtatcgcgatccgggcgcccctcaatcgccaaagccatcgttcccataccaagccgaggaatcgcaaatcctgccaactcgccgtccatcatcatcttccccttccttgcaagcactcagccgattcgcacatgttcacatcaagactaacccaacgtgaaccggcgcaagcttgtcgggcgcgtgcgcgaagatgaaggcacaaccgaacgggagccgaaaggctgagagggagctcatagagcttcgaccgaggacttgatgcgggtaatgccgccgtaaggagacgggttgttcacgccgcaagacgtatctcatcttccgttcgcgataaccgaatatcgcgtgattagggtcacggaggggcgcaccacctcatagggtacggttccttcggcgacccttttttcgtaccaacctcgagtgcccgattctgcagaaacggacgcacaagcggctcgaacaagcgcctacgtgtccgattcaccagaaacggacatccgtggactgaaatagatgccgtgcgtgtccgattctgcagaatcggacatttaaagaccaacaatgaacctccggatgtccgattcaccagaaacggacatttggagtgcaggaagcatgtgtcacgacagacacagaagggaaccgcaatgatcatcaacggtaaggaagagaacatcgccacgccgatcaccgtggccgaactgatcgaaagcaagggcctgcgcgccgaccgcgtggctgtcgagctcaatggtgagatcgtgcctcgcacccagcgtgcgcagacgcagctcaagggcaccgatacgttggaaatcgtcacgttcgtgcagggcggctgaaccactttcaaaatttcttgcgattacgaccggcacgatgcacgcgtaacaatcgcaagaacatacaaaacacaaccaacccggcaaaaacaacgcacgaacggaaaacgagaatacgagaatacgagaacaaccatgacttttgaaccatccgcatcgcaggcgcagatcgacgcccgccagcacgctttcgacaaccagcccgacccgaccacgctcgtcagccacgaagaaatccgtgcggccctgctcgaccgtcataccgcagccacgcaagacaagctcgacgcggcgcacgtggccatttgcggctgcggcggcctcggatcggccattgcggtggcgttgacccgcattggcgtcggtcacctgcatttgattgattttgatcgcgtggatatgacgaatctgaatcgtcagcagtattttttgaaggatcttgggcagtacaagacggaagcattgcgcagtaacttgcgtcagatcaatccttttatcgatatcaccattgataccgtgaaagtgaccgacgagaacgtgccgacgctgttcggcaatgaggatattatttgcgaagcgttcgacgtgccggaaaacaagacgatgctggtgaatgccgtgcttgagaatctgccgaacaagaagctggtgagcgcttctggaatggcgggattccgcagttccaatttggtgaatactcgtcgcgtttcgaagaatttctacttctgcggcgacggcgaaaccgctccggtgccgggcgctggtctgatggcaccgcgcgtgggtgtggtcgcctgccatgaagccaatatgatcactcgcttgattctcggcgaagaagacgcctgacagcgaaacgcaaacacaaacgcaattgcaattgcaattgcaatcgcaaatcgcaacgaatgacacaacactaatcgcatagtaaggattaaccatgagcaccgaaaacacgatcaccaccgcggaaaaagacttcgcggcggcaccgaacgccacgctcgacgagctggtcggcaccaccacgaacaccgcactgctgccggaaccggatgcgcacgcgtatgacgaaatcgccaccggcgacgccgatccgttgatcctcggcggacacaagttcacgagccgcttcatcctcggttccggccgctacgatctgaacctcatcaaggcgaccattgagaacgcgggcacgcagatcgtcaccatggcgttgcgtcgctgccgtaccaccgaaaacaatctgctcgattacattccgaaaggcatcaccatgctgccgaacacgtccggcgcacgcaatgccgaggaagcggtgcgtattgcacgtctcgcccgcgaagtgtgccagacggacttcgtgaaggtggagatcgaacatgaggcgaagtatctgctgcccgacaatgaggaaaccatcaaagccacgaaacagctggcaaaagaaggcttcgtggtcatgccgtacatgttccccgatccgattgcggcgaagcgtcttgaagacgcgggtgcggcttgcgtaatgccgctgggcgcgatgatcggctcgaataagggtctgcgtgcacgcgatttcattgaagtgatcatcaagaactccaatgttccggtgatcatcgacgctggtattggccgtccgagccaggctgcggaagccatggaaatgggcgcggacgcggtgatggcatacacggccatcgcttccgccggcaatattccgctgatggcacgcgcgttcaagaaggcgatcgaagcgggtcgtgaagcgtatttgtctggcttgggcaaggttacggaagatcatgccgtgccgtccagcccgacgaacgaggccgactacatcggctgatttgcgctggatcccgtaatggggattcgcgcaaagaccatgctgaaaggggcgtttgccgaacgtacgtgatgcactcacgttcggcaaacgccccttacttgtatcctgcgttacctgcaaacgttactgctgcaaggcttccttaagatcgcgattctggaatcgttcgtgtagcaggcaatatccgccgaacgcaaccagccaaatcagaccggcaatcgctgaaccaatcgtgtccgtcgacaggaacaacgtgacatacacgagcacaaagaacgtgatcgcaatccaatcaaacacctgccaagcgggcatgacgaaaccgtccggtagaaaatcgctgctctgacgatacctgtggtgggcgagcatcgtcagcacgtaaatgaaaatcaccacagcgctggcggccgaagcgaatagcacgaacgcgccggaaatacccggaatcgcgttgatgatcggggagaacagaatcatgcaacccgaagcgacgatcgccttcgcaggcaccttgtggtcggaaacctcagccaaacgcgccatcgcaggcgactcggaatccgaagcaagctgatacaagtgacgaccggccgaataaatcagcgaattcaacgccgacgcggcagccgtaatcaccacgaagaacaccagggcggcggcccaatcaagacccgcatatttgaacaccatgatgaacggcgaaccgaacgagccatcggaattctcgtgaaagttacgccagggcacaatagccatgatcgcgatcagcgcgcccacgtagaagatcagaatacgcatgatcagctcgttcaccgccttcggcagcacctcgcgcggattctgcgtttccgacaccgtgacacccacgaattcgatgagctggtaggcgaaaaacaccatttggaagctcatgaagaagttcatccaaccgttcggcgcgagctggaagccgtcggtgatattcgtaaggctcaccgtggcacccgacaccgtgccgtccacgccttcgatgtgcgtggcggggtagctgaagccgatgatcagcatcacgatggcggtgacgatcagaccgacgatcagcgtgatcttgatcatggagaaccagaattccgcctcgccgaacactttcaccgcaatcagattgatgccggtgagcgctacgaggaagcacagttcgatcaaccacttccacgagttcaggtctatgccgaatgtgccgaagaacgttacgaaatatgtgcttacggcggtgatttcggtcatgccggtcagaatgagcacgatccaatacgtccagccggcgaacttgccccacccgcggccgagatagcgcgtgatgaagttgatgaacgtgtgctggctaggatcgctgtacatcatttcgccgatggcacgcatcagcaggaacataatcaggccaacgccgatgtacacgaaaatgatgctcgggccggtcagtgcgatcgacttgccggagcctaggaacaggccggtgcctatggtgcctccgatggcgatgaactggacgtggcggtttttcaggcctcgctccatttcgttgctttggtcgaggctttcgacggatttgatgtgcgcggcgcttgagcccgcggaattggtgttctcggaagtcataatgttcactaccctaccccgcgaaccgcacattgcgcccgccgaagctttgtttttgggcacgtacgcagattttgcggcactggcgcatcccgtttgtggtcaaccgtgcccagccgaccaccttattcccgtattttcgcctcgccatacccccctgccgccctatctcgcctatatatggcagattcacgaggttgaccgctactttctcgcttatatatggcacttgctcacggcaaaacaccacttagggggtacgttttgggcgtatttccgcaggctgactgccatatataagcgaaatggctcatgacgcatgagcaaatctgccatataagtgagatacgcccaactgtccgacacaaatcgcgcctcgcttgtctgattctgcaaaaacggacatccacagcacactttcagtactccagttgtccgattctggagaaacggacatccgcaacgcactttcgccgcattacttgtccgattcaccagaaacggacaactgagacccgtttttgcctgtgtaagtgtccgattctgcagaatcagacacttacgcggcataacgatggtctgggtcaggcggtggcggcgatttgcccgcgcagttcggcgttcgcgcgctccagttcgtcgatacggcgcgcctgctgtttgatgatgatgctcgcggttcccacgtcgatgccgtcgtcgccttgcgctttgacgggaatatgttccatcgtcctgttggtgatgctatcgaggttgcgcctcatcacgaacgcatgctcataccggttgacgagttgcgcgatgatctcgctgtcgctcatgttgccgctgccagtcacggatttgatggccgacgttttccaacgatccacacaccgttcgatgcgcttgtatccgatgagatccggcggaagtcccgcttcccggaagattttggttggcgattcgcctgtcaagtagcggatggtgcacacttgcttgaacgaatcggcgtaggtgatgcgattgcgcgttacgttggcgaccgctggcagtccgcgcaatagttggatttcctcgtcgctgaatgctcccccacctcgtgccatggcacccgcctttccactgttttcatggatgtgcttgcgattgtagggtgccattgtcgtgagatgcccccacctgcaacccctgcatgattgctttttaacgactgttttgccacctaactgccacttgcggatacctttttcatgccggatttcgccgtttggtaccggatttcacccgtttcgatcccgtattgccccgtgcaaaaccttcacccctaaaaagtatggaaaggcacgaaaagacatgaaaagcgggcatccacggatggtttccgcgaatgcccgcttatggctgcttatgcgcttattgtttcagcgattgagcgcgtatcagcgcatgcgctggcgcgacttgagcgcgacggcaacgccggcacctgccacgagtagcgccaccacggtgaagagggtcgtgcccgcagcaccggtgagcggcagctgggtgacgttcttcacgttcttgaccttgtacgtgtagttaccggagacctcagcgctcggagccaagccccagatatcggcacctgcatacttgacggccttaccgttcgcaatggtaacggtaaatgcagctttgagattctgctggaagcctgcaggaacattggtctcagtgaccttgtaagtaccgtccgcaagacccttgaaagtcaccgttccatttgaatcggaagtcgcagtagcagtggacggagtcgaggcaccgttctgtccttcgatctcaaaatcagcaccagccagagcattgccctgggcatcggtcttggtgaaggagaactgaccgttggtgatggaggtgctgtcggtggctttagcaccgttgtcggagagcacaaccgtattggtcacggccttgcggccagtagcttccgcttcggtaacctcggcatcgtaggtcacaacgatctcatcgcctgcgttctgctgcttgatggaggtgatgttaacagtgaactttccattctcgccctcggccacggtgtaatccttacccttgttcaggtcgctaccgccaaccgtcactttaagggaatcgagatgcacagtctggccagcagacggggtatccgtgtaggtgtaggcgtaatcgctgtagtactgcgtgttctgcggaactttgctcgtaatggtgtaagtcaccgtctggccgacggaagcggttgcagcgctcaccgtcttgctcacagtggtggtctggttcttaatgtccacagttgccgcagtgagcggattcagcacgccattctcaacgttgccggagccaacgaggattgcgatagacggagtggcagccccattggtgccaaccaagtaatccgcgtccacaaacaggtacaggcctgcagggagctgcacagtagcggaagtgccattagcgacagcacccaaatcaaccttttgtacggtaccaagcttgtcagtcgtggtcttcagcgattccacgaacttacgggaagcgctattattccatgcaccatctgcagaattgtccacagacagcacgccttcggcgagcgcccaagccatcagatcgccggtttcagagacagtcttgccagtagcagactcaagtgccgccttaagagtaccgcggttaacaccgtcggcagtctgcacaccgtacgttgcattatcaccagtgccgtactgcacataatcggcgatcttgtaggcgttcagactacgattggtcagctgcttggcgtcctgagcagtgaacgtgaaattcgctgtatcggtaacgatagtgccggcgccatcggcctgtgcgctggttgcgcccagggccatgccaccgagcaacgtcgcagcggcggcgatgcctgcgaaaagtttcctcatcttcatgagaatcccctctcattgtgttgttgatgttgtgtttgtttttgctaacgggatctgaagcccaacatgctccggatccacaaatttgtgatgtgcggctggactgccctgtgaaggttggtagggcagtccagcccgaggaaccatctcagacgagacgtttcttgctgttccagatgccagccgcgccaaccagcagtactgcgagtccgccgatcgagccgccaaccagcagccattgacgatccgtggttccgcccgtcaacggcaacgccgataccgccacatacgtattggtgaatgcgatcggatcgccgattttctgcgattcggaaacgttcttgccgttgtcgtcgagcagtttcgtcacggatttcaccgaagccgtccatgcgccgttcgtttcggtaacggcgaccacaatctggtatttcgcgcccgaatagtacaaggctgcgatattgccgttgccttccgtaatggtgtacgtgtagtcggcttttccagcgttgtaggtgatgtcaccgaacgttgcggaatgctggctatccggggaatcagcatcataggcgaccgtcaccttgcacgactgttgcgcctgttgcgcgcaatcggccggcagcggcgcgttgccgtctgcggtcagttcgaaatcgaacgaatcgcctgccttccagtcgcgcccctctaggattttctgcacggtgatcacattggatagcgtcgcgctcttcaacgtgttggtcaatgtggccgtcatgttgccgccgttgccgtcactctgccagaccatggctttggtgaggtccacgccggtcgcgttgctcgcagcattgccatactggtaggagaccgcgtagcggctgtcttccgacgtttcagccacgctgtaggtgtatccgggctgcaatctgccgatcgtggccgtccaattattcgacgcgttcaacgtgattggatcgcctactttttcagcctgtgcgaccgcttccccggtcttcgtgcgctgcaattggaccgtcaccgcgtcactcgcatgcttgctcgcaccgtcggaccacaccttgttgatggtgatttggccaagtctgacttgcacgaccggtttggcatagtcgagcgtctgttgggtgcattccgattcctggtcgttaacggacgtgaccacgcagtagttcagatgcgctccagcattggagaagtatccttgctttcctgcggattcattgccggtattggcttctcccgtgtccgggtattgctgcttgcttgcgtaatccgcatatgcggcgtcgcttggttttaccttgaaggaaacgtcgatagtttcgtttttgtcgacgatcatgccgttcccattgttgaatgtcacggtaatcgtgcgattgccgttgtcgtcgacgttgtagacggctgtatatccgcttacggttgcgccattgttggttgccgtcacatattgcgtgatattggtgccgtttgccacatcggcgaaatcgaccggatcaacccattgagacagggtgtcggtgatggaatacgctctgattttcgcggttgtggtgatggtgttgtagatctgttcgaatgccttcgtcagattgtccgcggacgttccgtcgtattccttgccggtgacggcgttcgcttctttggctaggtcgctcatcttattggcgtcggccgaaaccttcaccacatacagggctgcgttcccgcgtttgttggcttccgacagagcggccgcatagttgtagccgtagctatcgtcattgccctcgccgtggatgtttccgtccgagccgtccgggtcggttttccactggtaggactggtccaaccacttattgttagcctcgcactccgcctgtgtcccgtattcaggatggctttcccatccctgaccgagccaactccacttgaagcatccggaataggatgtgattctgaaggtcggattgccgtcagacaggaagacgatatgcttctgcacaccggaacgtcctgacgacagatcgttcgctgttttcagagcgtcttcccagttggttccgccatttggccacgcactgacggccgtgctgatgttgccggcagaagccgtgaaattcgaagtggttcgcgccctgtcgctgaacgtcaccaccgccatctgtacttgctgctcagccggaagagcggcattcgcggccgtcagaagcttactcgccaaggccgtggcagcgtttttcgcattcgtgtcacggttgctgttttccatactgccggacttgtcaagcaccagcacaatgtcggcaggcaccgcggccgtaaccgtggatgacgaactatcgccggacgcagtcaaatgcaacgcatactgatcaccgtctccaccttcgattttggcaatgcttttactattcgcaggctgcaaggtggaagtgtcaccggaaggattctggtcgtcttccgcaatggcggaagacgtggtgacgtaacccaagccgccaagcatggcaatcgcagcgagcgccgcaaccatgcgttgaacaaagccttccctcggctttgcctcgttgtgcacatgtctcatatgcatccccttaattcacgtctctcatcgaatcgcgccactgactcgcctggagcaatccgacactgcttcaaccctgaaaactaaaggaaatcaaacaatcgcgcgcacaccctacgtgcgggaaagtcggggtttggcaacagcgcaacaacaaaatccctgcaacacatttcctacggcgcaatcacccgacatcacaaaaggaaaaacgtgcgaaaagcgcgattattcacgcaaatgtaaccgaatcagccgcgcttcggccaccaagcagcatgcctgcgaatatgccacggcttgcgtcgcaaccaaaccaacaacacgcccactacgagagtcgcaatacctgtgatcgcaccaatcgcgcgggcatccttcaccgcgtcgttttcggcgggaatctcatctggaatggcggaacgtgtggccgaaaccagcagacggtgcgtgttgacgccatacggcgtgcaggtcatcagggtcacgcgatcctcaccaggcacgattttcagctgcgacgtgtcgttcggctcgatcaccgtgatacggtccacctgatagccgagcgttcgacccatcacttcgatgtagaagtagtcgccgacacgcatttcatcgagccgcgtgaacatggccgcctcgaccagtccgcgatgcccggtgagcaccgcatgcgtgctcttgccgccgactggcaggctgctgccgtacaggtggcccgcgcccgaagcgagcgccgattcggaggtgccatggtagatcggcagtctcacggaaattttcggaatgcgaatcgtacccatcacgccaccgccggaatccaacagactccggtactccgcgtccgccgaactggcgcttgcggaaccagcgtccgcggaaccggcgtccgcgcctgtacccgcaccactctgattgtccgattcaccagaatcggacacactggcacgcgatcctccacgcacatcagcgaacggatccttcgcctcacctaaaatcggctgtccggactgcgcaagccgcttgttatagtcctgggccgcggcgaacgcgtcatccgcctgcggatacggccagcccgcaaccgtctgcgcggatcttaccgacgttcccgacagatcacgcgccgaccgatactgcaacatcgccggaaaaccgccaatacagatcgcagcgacaatcaacagcgccgcaatcgcacgcatcgccagcgttttgccgcgagcgtgacgtcgttgacgcatttcgtcggcaacgtcaatcgcctcttcgaacgacggaaagcgactttccaacgaaagtcgaccacccatcggagcctcttcggatgacggccaacgaccgtcatgccattccgccgtttcctccatctcacgcaaccgtgccgtcacccgacaagctttcgcagcacacgttccagttcgtcgatgcgcaacgcctgtttcgcgatcaattcgtcgcattggttgatgatgagttgcgcttgggcgagctgcgaaagcgcatcctgcgattccgttgccgacgattgcgcatcatcgcgcataagatcatgatgccgaatgacgcgcaggtcgtcgcggtccacccgcttgctgttgcggcggtctcgttcctcctgctttttccagcgtgcaatgcaccgctcaatgcgtttgtatccgatgagtttcgggtcgagacccgcctcgcggaagatggcggccggcgattcgcccgcattgtatctgcacatgacttcgatgcggaaactgtcggcataccggatatgcgacgcgctcacgctttccactgcgggaaggctggccaaatacgcgcgctcctttgcggtgaattttccatcaaccattcttccctccccctatattgcctaaacagcttggttcagaatcgtatcggagctttcccattggcaccctcgttaaaaccctcgaataaagcccacccttcccccaatgaaaagaaggagttccatcttcaaaacaaaacagttccgccattttgcacagatagtaacgctcatagaattaccccccccccataaaatttacaaaaacttaaccttgccccagagtgccctttggctcatcatggggcatcacgtcctcgaacaccgtcatgcagactcactaggctagaaacatgacgcaagagctcgtttcattgactatcatcatggcggtggcggccgtcagcccgattgtgacgcagctgattccaggaaggttcattccacaaactgtgctgctgctcgtcaccggagccgcactcggtccgtacggactgggcgtaatcgaggtgaacgacgccgtgaaactcttgagcgagctcggcatggcgttcctattcctgctcgccggctatgaaatcgacccgaaacgactcgccggacatcaaggcaaagtcggccttgtcacatggatcatcaccttggggctcgccggactcgtcgtgaccctgcttccattcttcgcaaagcaaggcatcaacggcatcgccacggtaatagcacttaccaccaccgctctcggcacactcatgccgattctcaaggaacgcaacctcgaaggcacccccatcggcgacgccatcatctcgtacggaacgtggggcgaactcggcccaatccttgccatggccatcctgctatccacccgaaccggctggcagaccatgctcgtgctcggcgcgttccttaccatctgtctactgtgcgcaatgctacccacgaaagcactgaaaaccggccatcgcctgtaccgtttccttacggaaaacgcgaacacgtcatcgcaaacgctcatgcgactgaccacattcctgctcatcttccttgtcaccatttctgcactgttcgaacttgacgcggtgctcggcgcgttcgccgcaggcttcatcctgcgttacatcatccccgacggcagcaagtcgctggaaatgaagctggaaggcgtcggctacggattccttattcctgtgtttttcgtggtgtcaggagccgcgatcaacgtgcgcgccgtggcaggccgacccgcgctgctcgtcgcgttcatcgtaatgctcatgctgattcgcgcggtgcccgtatatgttgcgctatcgctcgacaaacgcgagaatccgctgtcatcgcatcatcgcgtcaccgtagcgctgtattgcacgaccgcgctgccgatcatcgtcgccgtcacgtcactggcggtgaaggtcggcaccatgcaaggcgacaccgcgtcaacactggtcgcagccggcgcgattacggtgttcctaatgccgctgcttggctcgatcacatatcaggtggccgacgtacatccggtcaccgcggttcgggagattgcacacacaccatccgattggcggacgatcgtgcacgaacatgcgcaggtgcgtgcgctgctgcaccatcaggaccggctcaagcgtatggcggaaacattggacgcactggagaagatgggaacgatgggacatggcgatgcggcacatagcaatgccggacatggcgatgaatatcgagccgaacttgtgaaacgtgcgcgccgcgaaatcgaccggcagttgaaggaactcggcctggacccgcagctcaccacgcaactgccacacaactaccgttatccgaagaactgaaacgcgaatccgagcctttccggcactctaagtgtccgattctggagaaacggacaaccgtaacacacttttacccgtctagttgtccgattctggagaatcggacattcagacatgcgcctattcgacggatttgagcgaactaatcgggtcgatacgatccaacaccggattcacgaacaactgcacgagcagcgcgaaagccatggtcgcgccggccgcaatcacataactcaacggcgtgcattccacttcgaaatacagtgcgggcatattcaacgcagccgtcagcaatccgccgacgaaacggccgagaggcaagcccagcaccacgcccatcatggtgagcaccatcatttcacggttcacatagtggtgaacctctttgtcgaagaatccgagcaccttgagcgtggccatctcgcgttcacgttctgacacgttggtgttggcgagcgtgaacaacaccacgagcgcgagcccgcccgcgagcgccacgatcagcgcgaccaccgcacccatcagatcgaatttgaagctttccgccatgtgcgcgcagctcacggctttcatgaccgcatcgtcgtcttccagcttttccgcataggcggcctgggattcgcctgaacctttgagcttcgcatacatggcgttccacaccaattgttggccgtttgacgatgcgccattcgaggtaccggattcgccgttttgattgtccgattctccagaatcggacgcggaagatgcggaagacgtgccggatgcagcagtatcgaacagctggcgataataggtttcgctcacatacacgtccgatccgatcacactgcggatcaccgcgctgacatgcgcttcggcctgcatatcgtcaccgttggtcagcgttaccataccgcccgctttgacgcccatcgcgcttgccgcggactgcgatacgatcacgccgtcatcgcccagacttaccgtatcggccgcaccatccacccaactggagcgcaccggctgcaacgtgaccatcttgccgaactcgctgcgttcactgtcgggcacggcaaccagctgaatgctttcgctccccgaatcgccggtcaaatcacccgattcaacgcgcacgtccatgctcgacgtgacgagaccatccgaagcgactttctgccgcatcgcatcagcgtcatcatcgttcgcgaccaccatcaaatcgtactgatacacgtcctgatactgtttcgcgcccaatgcggcaacggtgtcgttgatcgcaagtccgcacacaatcagcgcggtgcagccggccacgccgccgaccgtcatgatcagacgcgatttgaaacggaaaatgttgcgcgccgtgactttgccgaggaagctcatgcgattccacaacggcttgatacgctccagtagaatgcgcgatcctgcacgcggcgctttcggacgcatgagactggccggcttctgtcgcatttcctgcgcgcacgcatacacggttgcggcaagcacgccgaccacgaacagcgcgactccggccgttccgtacagccagtcgtatgccaagcgtacgtccggcatcacatacaagcctcgcaatacgacgagcaggaacgccggaatgccaaggaagcctgcgatcaggccgagtccaccgccgatcaggcaggcgaacagcgcgaacaacaggtatcgtgaggcgaccgcaagacgcccgtagccgagccctgtgtatgtgccgatcagcccgcgatcctcttcgaccatgcgcgccatggcggtcagactcatcatcaccgccacgagcaagaacacgatcgggaatgcgttgcccagcgattggatggattccagatcagatttcagcgagctgaatccgccgatttgcgaccggtcctgcacataccaacgcacttgcggaatgctgtcttccagctcgttttgcttggattgcagtgtccgttcggtgtcttttttctgctggtccaatttcgattgcgcctggtcgagttgcgctttggcttccgctaattgcgggcttgcggcaattaccgtttcacgtagtgtttcacgggttgtttcgtcgagggatcctgcagccgcgcccgcctgcatattgacgatttggtcgatttgctgattgagctggctgcgattgctgtcgatctgctgttgcgctgcggcgaactgtttgtcggtttgcgctttcgcctcgtcgatttgtttggttccagcgtcgagtagttcctgatgacgcgctttctggcgattggttcgcaccgtgccgtcgatgcggtcagctacttcgctgacggtgtcgtcgtacacgtcactgaacgagtccttgtcggcggcgcctttcacgagaatggtgacggccgtgtacatgctgccggtcacaccgtcggacggcgcaaagaacgtgtagtcgctggtggcggaggaacggaatgcgttcgtacccgaatagccgtctggattggtgagatcctgcgggtcaagcaccacgcccacaatagtcagttcggtggggaagctcggtgcctgattgtccgattcaccagaatcggtcacccgtgcggcacgtttgccatcctgcgtgtccgattctgcagaatcggacatctgggacccgttttcgcccgtttgattgtccgattctgcagaatcggacacagaagaagacgccgaatcctgcggtgtcaccgtaatatggtcgccctttttacatccggaatccttgatgaatttgcgcgtcaccgcgatctcaccggacttttcaggcatacggccactttgcaaatacggctggtcaatgccgttcgtgccgatctcctgcatggtcacggtttttttgccgttcagatcgacggtcacggtttgcgaacgttcgccctgcactttcgcaacaccggaaatcttacggagcgcggcaatatcgtcatcggtcaatccggccgtcgacaacacctgaatgtcgtgcaatccttgggtgtcgaaaaaacgatccgtcgcaagaaaagcgtctcggcaacccgcgtaaatgcccgtaagcacggcgacgcccagcaacgagatcagtgcgatggagatgaatcgcttccacgcatgcaaccacatacgcaccatgtctttgatgaatgccatgacgacctccagcccgtagcgctcaagcagcaccaaccattgctcccaaaaccttcattttattgaactatcgaactattgaacactatgaaaccgaatccacgcgctacagctacaatcggggaagacgcgccataccaaaaaccataggcgcgtcacctaccactactgccgaacgcaacatcgccaagatcgcaaacttttgccgaatttgccgaatttgccgaggcacccaagaagaggaagcattcatgagcgacgcaaccgttgcgaagaaaccgcgcgaaaccgacgatgtgccggttccgccgacgctgcgcaagtctttgaagaatcgtcatattcaattgatcgcattgggcggcgcgatcggcaccggcctgttctatggttccagcgagtcgattcagctggcgggcccggccattctgctcgcctatctgatcggcggcctggcgattttcctgatcgtgcgcgccctgtccgaaatggcggtcgaggatccgaaggcgggcgcgttcagctattacgccacgcagtactggtcgaagcgagccggctttatttccggctggaattactggttcaactacgtgctcgtggccatggtggagttggccgtggttggctcgttcgtgaattactggttcccgaacattccgaagtgggtgtcggcggcggtgttcctggtggccatcgcggcgctgaatcttatgggcgtgaacaagttcggcgaatttgaattctggttcgccatcatcaagatcgtggccgtgcttgccatgattttcggcggtttgtatgtgatcatcgcgaatgtgccgaccgcttcgggcattcgcgcgtcgttcgccaactggtttaccgttgacggtggattcctgccgcatggcctgatgtctcgcaatgcggacggcacgtggaccggcctgctgatggcgctggtcgtggtgatgttcagcttcggcggcaccgagctcatcggcatcaccgcgggcgaaaccgaaaatccgcgcaccaccattccgaaggccacgaacggcattatctggcgtattctcgtgttctacatctgcgcgctcggcgtgatcatggccgtaatcccgtggagcacgatcgacggcaattccagcccgttcgtgcagattttcgactcggtgggcgtgcatgcggccgccggcattctgaatttcgtgtgcctgaccgccgtgatgagcgtgtacaactccggcctgtacgcgaactcgcgcatgctgtattcgttggcgaagcagggcaatgcgcccgcgtatctgggccgtctgaacaagcgcggcgttccggtcgggggtgtgatcacgtcggccatcatcattgcgatcgccgtggtggtggtgttcgtgtggcctgatttcgcgttcaattatttgatgtcgatcgccacgattgccgctgcgattaattggatcatgatcatgattacggaaattaagttccgtcgcgttgtcgccgccggcgacggtccgaatgatttgaagggattgaagggccaggaagcacttgacaaacttgcgttcaagctgccgttcgccaaggtgacgccgtatgtggtgatcgcgttcatgctgctggtcgtggtgctgatgtgcttctccgcaagctatcgcatcgcagtggtcgccggcgtgatttggctggtcgtgctgttcgccgcctatcagatcacacagaaacgcgcctgaagtcgtagggcaacaatgcgcccgtgcctcaagcgaggggcacgggcgctttttgatttcagattacgatttcagattttgatttccaatccgcgattcccgggctgttctggggactcgcgccgttcgacctgtggtacctgtcgaagcagtccggcaacaccgtcgcaatcctgtatggcgtaacccttgcggcgatcgccgcgatcggctcgctgctcgctttcatcctgcccttgtcggggcgcagcaaatgcgcaatcgcaattttttaattcatcatcgcattaactcatcatcgcatcttattccgctgccggagcgggaccggtcgaagcgcgggcacgcaattcgtacggcccttccatcagatgccccacacgctcgccgccgatcagcttgagcagcaatccggcggcctgcctaccggtatcgaccacgtcacggcccatggcggtcaggttcggatacgccgcggtgcacatgagggaatcatcccacgacatgatggagatttcctccggtactttgatgccttgcgaagctgccacgccaaggccagccaacgccatcacatcattgtcgtagatgatcgccgtcggatgctcagagaacgccagcaggcgcttcgtggcctcgcgaccggtttccggcgtgtagtcggtgtgcaggcaacgataacgcatgcccagctcggaagcgacgtccgcaaaggcggaatcgcgaatatacgagtgcgcaagcgattcgggaccgccgacgcgggcgatctgacgatgcccgagatcatacaggtatcgcaccgctcggcgcacggcatcggcgtcggcgcttgacagactcgacagattgccgaccacggaggcatcggcaatggcaagcaccggcatctcctcatgctcctcaagcaaggcaacgcaagggtctccaagctcgacattgacgagcagcatggcgtcgacgttgccagtagcaatccaatcatcgatgatcgaaagcttcgcgtcctcacccacggccatgcgtaccagcagagaataatcgtatttttccagctcggcgccaagaccggaaataagttccatcatgtaggattcgacggaaagcagcttcgggtcgtaacccaacactagacccacgcgccgcgtcttcgccttggccagcgcctgtgccgcgccattcggcttccatcccagttcgtgtgcgaccttcaacactttgtctcgagtcacatcggaaacaccagacttgccgttgagcgcatacgaaacggcgctactagagactcccgaagccttggcaacgtcaaaaatcgtcaccttgcttttttgaataggcatgtccgtgtccttcttcttaacttaaatcgcaacttaaacggttcatctacatcgtacagtaaaagcgccgaccaacctcttgaaaagtcagcgttcacaacactttcgtttcttaaggttggcggcgcttcaacttatgtttttactcaaccgaacacgtcaactgaaatttcagtagtcctctatccactcttctaccgcttcagtaaacggcgtactcgcggaagctcaccattcgcgcttcggatcgttggcggaacgcggcacgttggcggctgcgaacgcacccagagcggcaagcgctgcggcatcggcagtggcgatatgcagcacgacgctttcgcccggaagcagcgagaccatgccctcggccaccgaagccttcgcgtcgaccttgtctgccatgcagaacaggtcgcgcacgtagctcttggctgtgacggtaagttccacgccatcttccacggcaacggccgcggcactgagggcgagtttcacgtaaaacatttcttgtattcacgcaatggttgcggcacggatggccatccgcgcgttccggaagacgaacagatggccgccgaactgaccgcatacctggaatcattcggcccggacctctggcaatagcctatgcgctcgcagtgcagcgcattttatttgattcgtttctgcgattttggtggcataaatcgcaaaaacgttgatttttcaacgattttttatttgactggtatttgattcgtatttggctgacgtgcgatcagcaggacttcaatcgcaatataaagcgtgcgattgcagcacactataagcacagcaatcgcacgctattcatcgtcaactatcgacaatcatgtgacgcagccgttcaacgcaactatctaacgtgattattcagcgtgatcagagtcggtgtgatcggtcaggtccagcttgaatgggtgagcaggcagattattgtcattaaacaacggtgccggaccccagctacgccatgcgtagcgcatcatcaccggcgctggcacttccggcgtggccaacgtaatcgtgccgatactgcggctgttgatcggaataccgaattccgtggcgttgtaatcgaccacgttgacctttgcgttgaccagatcgtcaatatcgcaatccacgaaaatcgcggcgtaggccggatggaacacaccatcggcaccggcaagctcgaaaccggaacgttccggcagacgaaccagcgaaggcaggctcttggcgaactcgtcaccaaaactgtcgggcgtagtaccgctgaaatgcaggccgtgcgcgtaccggaagaacaggcgtacgcggccgccttcgtcgcagcggaaacccagcacagtcggcccatacaccggaatacggctcataccatacacttggcgaagcgcacaattgcctagacgctcgcccagtgtacgtttatcaaccggatgaatgttgttgtattcgccgcaatccatagtgcagatggcgaacacattgtcgatggactgcgcggcatcccactgggcctcgcgcaacaccggccacagcatcggatcgccgtcgccctcgtcgaccttcttgtcaatccactgcggcaattgcacgatcaggaacggcaggctttcgctccacagcgcacgccattcaccaatcatcatgcccagcaactcacggtaggatccgcaatacggctcgtcttcctcgccctgataccataggaatcccgccaaggagtaaggcacaatgcgctccagcatggcatggaacgcgcctgacggacgccactgcgaggtcggcgtcatcggcggcggccacgggcattcgccatactgttgggtcagcgtatcccacgtcacatcaggatcgtcttcgcgggcggctgcgatcgacgcattccacgtatcagaacgcgactgccattcgccgtactccaaatcgaactgttcctgcgttttacctgcgatcgcctgctcatagcgcgcaagatagccgcgcccggattcgctggaattcagtgcatcttcgctcgtccagcaactgatcgacgtacccccgatataacagtcgataatgccgatcggaaggtcggaatcaagttcatcacgcagttttcgcgcaaaatagtacgctaccgcactcattacgccactattttcaggcgatgattcctgccagcttgccgcatgttcggcgttgcgattgatcacaccggttttcggcacattgtagaagcgcagtaacggatcggcacagttatcgagggcttcctcggcgtcttcactgttgcgcaattcaagttccatattgctttgaccgccggccagccatacttcgccgataagcacgtcataatattcgatgaaatcgttgcctgcggtgacgcgcaacgtgtaagggccaccttcgggctgtgccggcagcatgacgcgccacggtgaaaaaccgttcttgatctctttggaggcgtacgcatgcgcctgcacgatcacggaaccatcgaaatcgcggatttccgcggaaacctcaagtccggcgcaatcggcatcaagcgcgccgaacacggcgatgggcttgttacgctgcaacaccatatgcgaggcgaaaatcgcggcgacgtgcagaactcctgacgtgctacggtcttcggtaggttcagccgacgttgtcatttcagaaccaggtgcgggaccagtcgcagtgaccatgacatctcttcctatagaaaaaccgtaagaaaccgtacatatctatcctagaacaatatgcgacagaacatacaaaaaagaccgccacccgtaagggcagcggtcttgtaaaagactcagcgattagccgaatgagccgcatcagccacgggcgatcttgccggtgaaggtggccatatcagcgtcgtcatccttgccgttgttccaggagaacatggcgcgcagcttcggaccgacggtctcgatgcggacgttgccgtactcttcctgcagagccttgaacttcggagcgccagcgtcctggtcctcgatgaactccttggcgaaggagccgtcctggatgcgctgcaggtggtactgcatgcgctcacgcacgtgctcgtcgatgcaggtgttggtgtagtcgccgtactgggcggtgtcggagcaggaccagcgagccttgttcagaccgccctcgttcatgaggtcgacgagcatcttcaactcgtggcagacctcgaagtaggcgatttcaggctggtagccggcgtcggtgaggacctcgaagcccatttcaacaagcttgttcacgccgcccatgagcacattctgctcgccgaacagatcggtttcggtctcctcggtgaaggtggtcttgatggcgcctgcacgcagagcgcccagagccttggcgtaagccagggacagcggccaagtcttgccatccggatcctgctccacggccacgacgaccggaacgccacggccgttggcgtactcacgacgcacgatgtggcccgggcccttcggggcgaccatgaacaccggatgatcctcggacggcttgatgtagccgtagtggatgttgaagccgtgagcgaaagcaacagctgcgcccggcttgatgttcggctcgatgtcattggcccagatggtgcgctggtactgatccggagccagaatcatgatgatatcggcctcagcagcagcttccggaacggacttgacttccagaccctgctccttggcgtgctcgacggacttggaggtcggacgcaggccaacgacgacgtccacaccggaatcgcgcaggttcaacgcatgagcgtgaccctgggaaccgtaaccgatgatggcaaccttcttaccttcgaagaccgagagatcgccgtcgttctcgtaccagatttgtgcagccattgtacttggcactcctttttatgtagtggggtgaacgcctcccggcgctcgggtttctaccattcgcagatgaattcgcgtgtttttgtgcatggattttgtcctgcaaactggggtctatcctactcccgtcccttcctaaataagcattgagtccacaaagtgggccaacgcctagccgtgcggttcccccgacaatcagtactgcgatcccgcatacgaaatatcccagtcataaaacaacacagcaacaaaaagaagccaccgcggtgagacggtggcttccaacacgtttcgcgcatattgcgctactacgttattcagcggcccttaacatgcagccgctacagcgaaatcactgaacctgggtacgagcgatcttgccgttgaaggactcggccatatcggcatcggcgtccgtctggttgttccaagagaacatggcgcgcagcttcggaccaacggtctccaggtgcgggtggctgtactcttcctgcagctccttgaacttcggagcgccagcggcctgatcatccatgaactccttggcgaaggagccgtcctgaatgcgcttgagctggtactgcatgcgcttcttggtctcttcagtgatgacggtggaggtgtaatcgccgtactgagcggtgtcggagcagctccagcgagccttgttcagaccaccctcgttggccagatccaccagcatcttcagctcgtggaacacctcgaagtaggcgatctccggctggtagccagcctcggtcagcacatcgaagcccatatcgcacaggtggttgatgccacccatgagcacgtcctgctcaccgaacagatcggtttcggtctcctcggtgaaggtggtcttgatggcgcctgcgcgcagagcgcccagagccttggcgtaagccaggcacagcggccaagtcttgccatccggatcctgctccacagccacaacgaccggaacgccacggccggcggcgtactcacgacgaacgatgtggcccgggcccttcggggcgaccatgaacaccggatgatcctcggacggcttgatgtagccgtagtggatgttgaagccgtgagcgaaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcctcggacggcttgatgtagccgtagtggatgttgaagccgtgagcgaaagccagagcagcgcccggcttcaggttcggctcaacgtccttcttgtacacggcggcctggtactggtcaggcagcaggatcatcacaacgtcggcttcggcaacggcctcggcaacaggcttgacctcgaggccctgctccttggcgtattccacggacttagaggtaggacgcaggccgacgacgacatccacaccggaatcgcgcaggttcagcgcgtgggcgtgaccctgggaaccgtaaccgaggatggccaccttcttgccatcgaacacggacagatcggcatccttctcgtaccagatagttgctgccataataggcgctcctttatttttctttttatagcgattcgggacttgcattcccgaacaaactcgcgatatttaattcttgtttcggttgttcacagcgggcgatggttcctaggagattactcccccggattgtgtccgaggaaccaccccgcctctcctgcggaactgttttagtcccgctttctttatattggttgctgacgttcacatagtggttatattcgcgtcaaacgtttttagtaaggcttccgtcgatgtcatcttgacacgtcgctgaatagccggtcaaacggcacttggcgattgatcacttggtgaaatcaacatccttagtctccttgcagctcagcaccgcaacaaggcagcacacggccatcacgccgaggtacagaccgacggagtgcacaccccagtggtgggacagccaagtggcgatggtcggcacgaatgccgcgccgacgatggcggccaggttgtagccgatgccggagccggaataacgcacgttggcgtcgaacagctccggcaggaacgcgccgatcggaccgaatgcggtgcccatcaacgcgaagccgatgcataggaacagcaggttggcggcgaagttacgctggccgacgaccgacggatcaagcaggaacgggaagagcagcgcgaatgccacgaggcagcaggacgagatgacgatcacgcgcttgcggccgaatttatcggcgttcacgcaggaaatgacgatgaacgcggcgaacacgcagatggcaagcatcagcatgagcaggtattcacgattggtgaaaccaaggtctccgccgccctgctcgacggttttggtgccccaagcgagggaccaggttgccagcgtgtagaacagcgtgtaggtgacggccaccaggaacgtggcttggatgacttccttccagctcttcttgaacacttcggtcaacggggacttgacgaccttcttctgctcctgggccatgcggaagatcggagtctcctccatctgcactcgcacgacgaggccgacgatcaccagaatcgaggacagcaggaacggcacacgccagccccatgccagcatcgcatcgtcatcgttgaacgtttccaacaggaagtaggtaccgttcgacaggaagaaaccgatcggagcgcccaattccgggaaggagccatacagcgcgcgcttgtcttccggagcgttctcggtggccaccaaagcggcacccgaccattcgccgcccagaccgatgccctgcacgaaacggcacaggcacagcgcggcgacagccacaatgccccactggctgtaagtcggcaggcagccgatcaggaacgtggcgatgcccatggtcaacagcgaaaccaccagcgtggtcttgcggcccatgcggtcgccgaaatggccgaacaccaaggatccgagcgggcgtgcgatgaacgcgatggcgaaggtcagcaggctggccagcagtgcgacagtcggattggtggtgtctccgaagaacaccttcgggaaatagttcgcagcggcggtgccgtatgcgtagaagtcgtagaactcaatggcggtgccgaccatggaagcggcgataacggttttcaccgaatcgcgcaccattgcctgcgctttgccagcggctgcttcgactgcactcattggattactcctgttacgtctgtcatgcgttgccggctcccaacatgcgccgataacgtctttcttctattctcttgtgtgcagtcttcatttcgttgccttacgccttgtgggcggcaacaaaaagaccccgcagcatgcagggccatcaacgtgtgtgttttgcgcgcctcaaaccctgcctccgttggcgagggattgaagctgcattgctcgaatcagtccgccaacgaaagcggaataataattcgtgcggacagcagtacgcgtgcaaccattccgttcatcgtggcgaacctcctttcgcaaagtcttgtattcggcggattatccgctcgaactaagccgtaaagataagcgcgtccacagaccctttctactaaaggttcactatgtggacgcgcaattttgaatttgatattcgtttttcggattatctcaggtcatccaaatcatttcagcagcaacgtcagcacgcccgcaacagccatgcaaccggcggcaacagcgaaaatcagcagatactcgccagtcgccgcaatcgcaatcgcgcaaacgacagcgccaatcaacgaaccgaacgtattcgccaaactgaacgcagccaacgaacgaccaacggaacgtatatccggcaacgtcgcaagattcaacccttggctcacgccgtcatacaccacatacgcgaaacctgcaaacagcgcatacagcgcgaccgccatagcactatcgatcggcgtcaacggaagcaccacagcaaccacaaacaacaagcaggcggcaatcgcgggaatacgggaatctttgaaagcgcgggcgatgcggccaagcagcagcgcagccaacagcgagccgacgaacgcggcaacggccatcatcgacataaccgcagccgctccggacaaaccaaacatggtgacctgcgaaacatcgcccaaaccatcctgcgcaagataccactggtaaatcgcaatgccggaagtggctgcgatggcaaacatgcgcgcggcaaacgcaatgaagaacttcggagcgcccttcggcggacgatactgcgaaaaataatcgcccttcttcacaccctcacgaggcaaatagctgctggaaccctcaaacggcaacaccagcaacgtagccacaccagccaccaccaggcacaacgcaaacaccatcatggcgaaacgcgtggtgccatcccaaccggaatcgtcggcagcccacgtaatcgaaacggccgcgataatgcccaacacctggccgaacgcctggccaacgccacgccacgcgtccgcacgatcacggaacttgtcaggcacgcgctcaccgaaagcggccgccagcggcatcgataccatcgcatgtccgatcagcgtaaacagccagaacacgatgaccaacggcatgaaatcgcatgcggaaagaatcgccaccgacgtggcggtcagcaccgtgccggcgatgatccacggggtgcggcggcccagcgggcagtacgaatggtcggatccgacggaaatccacgcgttcatcaggaacgtcaacagcgtgccgacgacgctgagcagcgccagatcggtgacgcggtcggtgccggaaagacggctgatggtctgtggaatgagcacggagttgagcgcggccatcggcgcggtgaacagcagcgcaccaagcgcgaagccggcggtgaggcgatgcacctgcggtttggtgggcgtggtgccgtcgggcgcggtcatcggatcgcgcaggtcaaggaacgacgattcgaggttcggcacggcggcgtcgagatgggcgaacgcggtcagcggggagccgccttccgtgttgatgagggtctgctgcacttccggacgctcgttggaagcctcgggcacgcgcggattctgctgtacggccaagcgcttcagggccgctttggtctcttcggtcagcgttttttcgtaatcgggacggtcatcgatgccggggcgtacgaacacctggcccggcagcggctgcggctgcattggagtctgctgctcacctgcattatgttgattgtcttcagtcatctcttgtttctattcctgtttttcctgttttgtattgtcgcttctcgttcttgcttctatttcgtcgctcgtttcgaaatgtcacacgatattcagcacatatgaaaatcgcccggacgcactgcaccagtgcattcgagcgattctttcggcgaaatcaaccatatcaatacgtcctgtcagacagcagaaacatgcgatggcaatctcaatatcgatatcgcataagaatcgatatcgcataagaaaagcccggatgcgattatcgcttcgcatccggaccggttgtgtgagtctgttcagttatgattgcggattccgtaccgttcgatcagcccttgactgcgccggaggtgacgccttcgacgatgtagcgctgcaggaacaggtacaggataaggatcggcagcatggccagcagcagggccgccatgatcaggccgatgtcgttggagtatgtgccgtagaagatctgggttgcgatcgggatggtgtacagatcgcggcgacccaagaccagggacggcagcagatagtcgttccagaacgccatggcgtcgatgatggccacggtggccacggtcggcttgagcagtgggaacacgatcgtccagaaggtgcgccacttggagcagccgtcaatgctggcggcttcctcaagctcgttcggaatgttcgtcttgatcgcgccgtggaacatgaacaccgccagggaaaccgagaagccggtgtgcatgaggatcagcgtgatacggctgttcaacacgtcaagcaggccgccgtagacggagacgagcggaaccataagcacctggaacggaatgaccatggaggccaccatgagcgcgaacaccatgccgccgaacttccacgaggggttgcgtacgatcacgtatgcacacatcgcggagaacaggatggtcagtatggttgcgctgatggtgatgaccgcggagttgccgaacacggtgacgaagttcatcttgtccattgccctggggaagttctccagggtgaacccgtgcttgccgatcagtgccagcggagcggtgttgatgtccgccttggtcttgaagacgttgatcacgaccagaatgaacggtgcgatgaacagcagcagcagaatcgtcagaacgacgatcatcagtgcatgcagaaccttggtgcgagtgctggtttgacccttcattatgctgccacctcacccttcttgccgaagtacacctgcagcatgccgatcactgcgcagacgatgaagaggaccaacgcctccgcctgaccggtgccatagttcttgtaaacgaatgcctggttgtagacgtgcattgctgcgagcaccgactggttgaacggttcgcccttggtaagcgaaaggttcaggtcgtacaccatgaagcaacgggtggtgctcaggaagatgcactgcacgaaggaggagcgcatcagcgggatgaccacgtgccacatggccttgcccttgttgcagccatcgatcatggccgcttccttcaggctctggtcaacgctcatgaagcctgccacgtaaatcagcatcatgtagcctgcgtactgccagaccgaaacgagaatcaagcagaacattgcgccgtttggcgtggagagcagcgatgcgtggtctgtttgcgtcgccacttcggcgacggccacgaatgcgcggttgaagacgaacttccacacgtagcccagaacgatgccgccgatgaggttcggaatgaagaagcccgcacggaagaagttctggcccttgatgccgctggtcacgaggtaggccagcagaaaggcgacaatgttggtgaggatgacggcgatgacggagtagatgaaggtgcgtccaagcgactgccaatatgcggtgtcggcaagagccgccttgtagttttcgagaccgacgaacggcttcgttgtcgaaacgccgtcccagctggtaagtgtcagatagaggccatagaagaacggtaggatcaccacggcgaagaaaagaatcgtcgccggaccaccgaacatcagaaactggccgattttataggaaagcttattctgtttcatgatggatcccatacgtgccggggatgtaaggtccgccgcaggaaggaagcggcggaccctgcatcatggtgcattatttggaagttcaggcggttgcgccggtgaacttagcggtcttccagtagtcctggatgtcctgggcgaggcctgcacggtcctcttcacctgcgagccacttctggaaggctgcgccgagcacggagtagtgatcgtccggcaggtagttgtagttgccgatcagcttgccggcgtcagcgtaggacttcacggacttgcccagcggatcggaagcttcgatgtcgttgttcttgaacggggagatcagagcggcatcggtggagatgaactcctgaccttccttgtcttcggcaagccagttcaggaagtccttggcggccttacgctgctcgtcggaggtgttgtcggaagagtcgatgaagaagtacttggagccgccgccgacgagcttctcattggagccgtcatcggtgttctgcggaaccggcatgagacccatgttctcggtgtaatcgtactggttcagcacggaccaatcccagttgccgccgaacatgaaagcaatctcaccctcggccagcttctgctcagtcacctcacgctcggcggagatggcggaggacttggcgtagttgttatctttcatcacgtcgaagaagtccatcagggagttccacttggcgttggagctgaggtcgaccttgccgtccttgagctcatggcagaaggcgtccggatcttcctgctcctcgtagacttccggcaggaggtgcccggcgagggaccagtcttccttcatgacaccggtcggggattccatgccgccggccttgagctcgtcgatgagatccttgaactcgtcaagggtcttgtagttctcaggcttgaattccttaccggtgaccttcttgatggcgtcagcattgtagatcaggccacgggcttcgacggaaaccgggaagccgtaggtcttgccgtcaatgctgatggcgtagtcggtgtctttgacccaatcctggtcggacagatcgacggcgtgctcttcagccaaggagtagatgtccttggcgtcgaccatggagatggtgtacggatccttggatgcgtacttggtggcgagatgcgctgcgacggtgtcgttggagtagtagacctcaacgtctacgcccttttccttggagtacttcgcagccatgtcttccatttggctttcgatttcaaccttggagttgaagatggtgatcttggtgccgctggagctggatgacgatccgcatgctcccagcatgccaacggtcatcagcgttgcaacaatagcggtgccagccttcttccaagaagagaacttgctcattttccaatccctttctatccactattcaccgagcagccctgcccaatgaggtgataaaggaaggtgaatccccgactcgcgttgtcggaatctctccgtccttggtatacaggataccaaaccggttcgagagttgtcaaaccggttcgagaaaccttgtgtacagtgccatccgtcggcgtgtcgcgtcaatcgattgacgtattgcaaacattggcattccatacacccctaaaaagtgtcttcacgggctataatgacggaaaagcagtgaccgacgtttccaacgttgcgatacatcggtagaccaacagcaaagacgcgaaaacaggaggatttatggcaagctggctcaacaacgcaatcttttatgaaatctatccgcaatcattcaacgactcgaacggcgacggtatcggtgacttccaaggcatcatcgacaaactgcaatacgtgcgcgatctggggtgcaatgcgatctggatcaacccatgcttcgactcgtcgttctacgatgccggctacgacgtacgcgactactacacagccgcggaacgctacggcagcaacgcggacctgcagcggctcttcgagcgcgcgcacgaactaggcatgcacgtactgctcgacctcgtacccgggcattccgcggtcgacaatccatggtttcttgaatccggcaaggacgaacgcaacgcatggaccgaccgctacatctggcgaccgatgacgcaatcgccgaatctgaactcgccatacgaatcaatccgcggattcctcggaggcattgcggaacgtcccgacgcggcggccgtgaactgcttctccacgcaggcatgcctcaactacggattcggcaccgtcaccgaagactggcagttcgccgccgactcccccgaagcggtgcagggccggctgctcatccaagacatcatggacttctggctcgggttgggggcggacggcttccgcgtggacatggcaggcagcctcgtcaaggaagaccccgaccactattggacgaaactcttgtggcagcaagtgcgagcgcatctggacgaaacctacccggaagcggtgctcgtatcggaatggggtgaccccgaagaggcgctgcacgccggattcgacatggacttcctgctgcatttcgggccgtcgcattatcttgacctgttccgcgagaatccgtatttttcggccggatcttccgaagctacgggcagcgccgaaactgccgaaacggaacacgacggcgaacgcagcgaatgcgacggcgcgggcagcagcgggtgcgacagcaacggcaattcagtcgtcgacggagacaatccaaattgcaataacgacaatgtcggcaatgcgagcggcgacatcaaggcgtttgtggacacatatacggccatgcttgccagcaccgccggaacgcctggatacatctgcattccgtcgggcaatcacgacatgatccgcatgcgcgacaccttgaccaccgatgaaatgaagctcgcgttcacattcctgctgaccatgcccggctgcccgttcatctactacggcgacgaaatcggcatgcgctacatgcacgggctcaaatccaaggaaggcggatacgagcgcaccggatcgcgcacaccaatgcaatggagctgcgcaaccaacgcaggattctccgcagcccggcccgatgatctgtatctgccgatcgatgccgacagcgagcgcccgaacgtggcttcgcagaccggacgcagcgactcgctgctggaaaccgtacgcgcactgaacacgctacgcctggcacatcccgcactgcaggccgacggaggcatcgagttcctctacgcggaagatcacgcgtatccgctggtgtatgcgagaagctccgaggccggcgaagccgaacgcgacgcaactgacggcgaacgcagcgaaacagcacacgaaaccagctgtgaaacaccttgtgaaacatgcagcaagattaatcgcgaagcaggtggcgagcgcatcgtcgtcgccatcaatccgtcaaacaccgacgcaagctgcacactgccgagcgactatgtgaaactgctgtctggcggcttagcgcaggaaatatcgcaagaaccaacagcgaaaccaacgcaagaaccagcggagaaaacagtactgctgagcatcggcaaccccgcacgcttcgacggcacccaactgcacgtcccagcccgcagcgccaccatcctcccctgctaatcctgcccccagcgtgtccgattctgaagaatcggacatccaagcgcctcaaaacatgttccagttgtccgattcaccagaaacggataaccggaacaccaaaacagacccacggttgtccgattctccagaatcggtcattcaagcaccccactttgacctgtagttgtccgattcgggagaaacggacattctggtactcaaaaacacatcctggttgtccaattcgggagaaacggacattcacgcgcccaaaagtacgttccagttgtccgattctccagaatcggacactcaaggcgacgaaaacgcgtaaaggccgttccgcgaaacttgcaatctgcggaacggcctttacgagcaaacaatttcaggactgcgctaccttgcgccccttggcgtcgatctcaccgtcgatacggcggaaaatccagttgtagatccacgcgcaacagtattgcggcaacgtgacgcccatcaaaatcagcagcggaatcatatatatgaaaaactgcgcatacagcacggcgaacgcggccaaaatcaccagcatgcacaaggtgcgcgggaaaaagccgagcgcaagtttcgtcgcattcttcaacgtttcggaagtcggattctcatagcgagaaagcagcgggaagaagtactgcgcaatcgcaataatcaccaatcccatgaacgcgacgcacgccatcagcggcccgcgcatcgaccccatggaccgggcgagcatgccgtcgaccaccagcacaatcgccgccagcaggaacgcaagccacggcagcagcgactgcttgagattgcgcttgaacgagtcgaaaaactggcgcgccacatacgtttcctcatggcggaccatgcgccagagcacactgtgcatcgcagtgaacgatgcgccggccgtgacgaccggcaggcagcacaacagcgtgagcacgttgagaataatcagatcgaacagcacgcccataatggcgaaaaacatgttgtcttgatcgaaaagctttgacatctttgacataagctcaccttacccgtttttgctgggatttcagctgattcccgggaaaattgttttcccgataagacgattgctcgaaaaaacgaaaatgcgaatcgtccttcctgaaggagaggtgacaggaaggacgattacagatttatggatttatgcgcggtcaggcagcgaccggatcaggcgaggctgaatcaggccacgaccggcggattggcgatcagatcgtccgtgcggtgctcaccggcggcatcacgccattcgagcgtggcgacggacgcggtgttctccacaccaagaccacggcccggctcaaacgtgagcgtggcctgagtggtcgtgccctcccacgtgaagctgatggacgtatcgccgtcggcgctgtacgagaaggtgccatcgaacgcatcaagctcgttgcggaacttggcaagcgcgttcagtgccttcaccaccggacgctgcagattctcgtcgatctcagccgtggaatagtaatggcgattgatatcgcggccattgttggtcttgcgcagcagctccatgtcgttcttgccggcaagcgcgccgacatagtagacctgcggaacgcccggcaggaagaactgcaccgcgcgagccgcaatatagtgctgatcgttgcatcccagcgccgaatagtaggtgctgttgacctgatacaggtcaagattggatgcggcggcaccggtagcggcctgcgattcgccgtgagtgttcgcatgaatggcgttgacgagattgtcgacatcctcatccggcacgagccccttgagcgaacggtccagctgatcggaaccgatgtcgatcacgccgatgccatcatgcgtgtcaagtacggtgacggcattgttcggacggatgtcggtccaatgcgcgaccggctcgacatgaccggtattcagcgaatgcagcagcagcggcggaagggcgaaatcgtagacgcgatcgaccttcgacgcgatctcgacctgcttcttgtagtaggaatgcacttcgatgaggatttccaagccgcgcttgacgccctcctcacgcaggcgggagatgagcttgaacgttttcggcgtcatgaagcagctggtaccggcttccttggcaccgtagccgacggcgtcaagacgaatgtagctgacgtgggatgcggccatctggtcgaaaatcgacatcaggtattcccagcctttgtcggaatccgtgtcgatatcgacctgctgcggggtgaagctgacccagaccaggcgagtcttgcccgcgaacttgtagtgggtgaacggcagacccgggcgcggacggtagatgccggccagatcctcttcggtcgcgccgttcggaaagacggaactcatggtcaggaacatcgggtaatactcggattcctcgcccttttcaagcacgtcttggaactgcttggattcccagctcatgtggttgacgatggcgtcgaccatgatgccgtgggtcttggaaagttcggcgacatcgtcccagccgccgaggcgcgggtcgaccttggtgtggtcgatggggtcgaagcctgcatccgcgccgtcgaatggagtgaagaacggcaggatatgcacgccgtcatacacgccgtcgaaacgggtgcgcaggatgtcggtcatcgagctgagggtgccgtcgccgaggcgatcggcgtaggtgatgagctgcactttgtttttcatgggacctcccttggttcatgggtgcgggtgcaatgtgtgcgcgtctgcctgtttgttgtttacgtatttgcatactcacgtatgtatcgaacaggttcgatattacctcgagaggggcgtcaatgtccagtcacacagcggaatgcgcgtgtcgaaccggtttgatgcggtgttctatgcagcccagcctgtccgaccccaacccagcgttccaacgcgcagcatcaacgcgtggtatcgcctggcaccagcgtcatgggaataagcacattcggctcgaacggcttggggatgttcttgcgcgaggcgttggccgcagccgcctcttcattggcgatcgcctgcaccatatggtcggccgccgactgcgcgatcgccgagaaatcctgtgcgaccgcggtcagcttcataccggccaaatcggtcaaatacgtgccatcataggcgacgacctgcagctcgtcaggaatggaaattccgcggctcaacgcttcgcgcacgcagaacgccgcgccaatatcggagctgaccacggcatcgacgccgtcggtcgccaccccatcaagcgcacggctgaccgcacgatgatagccggcgaaatccatcacctcaccggcctcgatatactcatacttcacgcccgcggaggtcaattcctgttccaacgtgaggtagtagcgcaccgtcgggaacgtggtctttcccaaatcgaacgacccctcctcgacttcgccgcggaccgccagatcgaagaactgatcgcgcggaccgccaatcatcaccacatggcgcgcgccattgcgaatcagcatctgcgcaatcagtcgcccaccctgctcgtggtcagatccgatcgacgaaataccatttccaagcacgcgatcgaatgcgacgatcgggcggtggatggacgtccaataatcgccgggatgcgaggtgtgagcgcacatgacgatgccgtccatcatgtgcctgcgcagcatatcgacgtattggatttcgccgtccgtctcgtcggtggtggagcacagcatggtgcgcagcccctgcgcggcgagcgcatgctgcaggtgcgcggtaaacgttgcaaagaacgggtgacggatggtgggcacgatgacgccgaccagattcgtgcgatcgtggtacaggttgcgggcaagctcgttcggcacgtaattgagggcctgcatggccttacgcacgcggtcgcgcatgtcgttggatacatacccgttgccgttcaccaccagcgagacggtgctcagagacaccccggccttcttcgccacatcgcgcatgccgaccatgatcgcaccttccccgttatcactgttccatcgttgtattctcacgtgcttgccgcgcgctttccgtgcgcttctcgcgagatattacattcatttacattctctcgaacctgttcgacagtccggcgtgtatatcgcttaacggggttacccctttacttgattttcaatattgattttcgtatgctgcccacgacacggaaaacggcagcacagcacaacaaaagaaacggcgcaaagcttgcgatatccacactcactttgcgccgtcttcttgtattgatgatgacctacattgcgatcagtcggtcggcacgtcgccggactgggtgtggtcgaagaccggcttgttgtctttgtcgaaggtgtagacgccgatgttcgcggagctcggatcattgttcttattgaacggtccgataccggtctggccctggtactggatatccttgccatccttcagcagcggcttggcctggtcgaatgcaatcaccagcgtcgcatccgggctggcggccttgatggcggttgcgctcagattcctttcatgttactcagcgaccgtccgcgtaacgtgaaaattacgccggattggcgagcagcgcaatgccgaaaccggtggccacgcaaatgagaggcaccgcgacggttgctattccatagcccagagccagcgtaaaacgacgctggcgaatcaatgaaaccacttcgttgagcgccgtggagaatgttgagaaaccaccgagaaatccgacaacgaacatcatgaccgtgtccatatccaccgattgcgaatagtaggacatcatggcgatgcccgcgcatagcgaggcgacgccgttgatgacgagcgtggatagcgggaagttgcggttcgttctccgattctcgcgattccagcctcgttgaattgacacgtcgagcacgtaacgggccatggcgcccagaccgccgaacagacagatcatccacatcatcagcgcacctccccggtagccgggtcggcgataagcgaaatctccgcagtgatcggtttgggctcgaagctgggcggaagcgggttagccggctgctggatcggctgcgactgctgctggggctgctggattggttgcgactgctgaatcggctcgggcagctgccccaagtctgaagtatcctgctcgcgcagcaacggctgcgatggctgtgccagctgaggaacggccagcggaggaatctgcggaacgcggcccgtctgcatagtctggctggcggtcggcggcacggttggtgtttcgactcgcggaacctgtcccgtctgtgcaatctgctgggccgcctgcgcggcctgctgcgccgcctgcgcggcttccattgcggcctgcgcggcagaacgcgccacgtcggccactttcacatggcgtacgccctgcgtgtccgattcggcagaatcggacacggaaacagctgaaaacgcaccccgaacccgctttcgagtacttcgtgacagcagtgcctgcatcagaaccacgccggcggcggcagtgagcaaaccgcctgcaaaatttcccgcaagatagccaagcgcactggcgatatgccgctcgtgcagaccttccatcgtttccagcatcacgccggacatcgtcgaaagcccaccgagcaagccaagcccaacaccacggctgacaacctgccgcacccggcgacgcagccacgaagcggtcgccatgaattcggtcagcatcgcgaacaggaagcaggcgaccatattcgacacaaacgtgcccacaacgaacggcgtcccgctgaccgacggcagaagcatatccaacgcatgccgacagccgactccaacaaatccaccgacgaacaccacaacatacatcagtccgtcggcgagcggattgaaccgcgcctgcatacgtttcatcgatgccaggggaatcgtaggcggatccatggtgttagcggagggcgtggttgcaccagcatgcgtcacctcaacagtgtcgattgcctgcgtgatgggatgcgagtcctcacccgcagtcaccacgtctcccggcgattgttcttgcgattccattgcgctccccctgtactggccttccgcggacagcgttgttccgcccataggccgtgcaacaacgagctgggccgcggttgccgccttcctaacgcatatgagtttacacggagcgccaacgtatgcaccctggatgtccgattccgcagattcggacatccagagtccagccgaattcagccaggctcagtcaagccgggcatcacacagccgccgcatcgcaggtcgtacctcgcgctcctcctcgccactgaacagcaccaccagatagtcaccggcacgcagccgtgtatcaccgcgcggcacgatctcgctttcgccgcgacgcaggccgatgatcagacacccagacggccaacgcacgtcacgcacccgcttgccgtccgcaatcgcccccatttccaatggcagttccataatgccgctgcccacatggcttgcgattgccatctgcatgccttgcgcacgcacgtaccgctccagcaactccccatagatcggtttggtgcgcagcagatcggacaccaacagcgcgatgaaagcgacggcagcgaccggcagcatgtgcgtcaacgttccggacatctccacagccaacagaatcgacgtgatcggcgttttcacggacgcggcgagcgtgcccgtcatcacgcacaccgcaaacaccgccactgcgtcggatggcagatcaccgattcgatgcaacacttcaccgcagatgccgccggccaacgaaccgaccgcaagaatcggcatgaaaataccgccaggcgcacctgagccgaaactcgtggatgtgaacagcatcttcgccacgaacagcagacacagcattcccaagccgacgcgcgcatgttcggcggtatcaatcagattcgagccgccgccgagcacgtcgggcaaccagatgccgacaggcaacgcgatcgcaatcgcaatcatcgggcggctccatgccggcagtttgccgtacagcgtctggaagccaagcaacgagcggttcatcagcgaaccaaccaaaccggccaccaatcccaacggaatcagccacacatactcttccaacgacagctgaccgatatcaccgaaatccaaaaccggacgcagaccgaaacagtatttcgagacgaaatcggcggtcagcgatgcggcagtggcgcccatcagaatcgcaggggaaaaactccgatgcaccccttccaaagcgaacatcatgccggacagcggcgcgctgaacgcggcggacaagcctgccgcggcaccggcggtgaccagataatgctcctgcatgtcctcacggcggtggccgcgcaaacggtgggacacacactgcgctcccgacgcaccaatctgaatggacggcccctcacggccgagcgacagaccaaacaacgcgcccaacagtccaccgacgaaacggactggcagaatcgtctgccaacgcatcttcaagccgcatatcaccacgccgttggtctgcgggatgccgctgccaccggccatcggctccttgccgaccatccacgcgatcgccagcgcggccgccaccgcggcaaccgcccacggcgcaatcagccacggggtctcgcgaatccgcgcatatatccagcgggacgcatccgtgccgtattcgatgccgagacggtatacgacgaccagcaatcctgaaaccagaccaatgactatgccggccgccgccatcttccacttcaagtggtcgaatcgcggaatcagccggcggatatcatgtgccgcgtcgttgccagtcaagccgggaaactcgttgccgacggtcagtcgaccagcgaattgatctggatgatatggtcgcgctgcgggccggtgccgatcacggagatacggcagccggacagttcctcaagacgcttgacgtaatcctgacaggtcttcggcagatcattgaagtcgtggatttgggaaatatcctcgtcccaacccggcatggattcgtagatcggcttcgctgccgcgaattcggactgatcagtaggcatatcgtcgcggcgttcgccgttgacatcataggccacgcacaatgggatttccttcaggccggtaagcacgtcgagcttggtgagcacgatgtcggtcaggccgttgacctgagccgcataacgattgacgaccgcatcgaaccagccacaacgacgcggacggccggtggtcacgccgtactcgtggccctgggctcgcagccattcgccttcctcgccgaacagctcggtcgggaacggtccttcgcccacgcgggtcacgtacgctttggaaacgccgatcacgcgggtgatcttggtcgggccgacaccggtaccggtgcatgcgccgccggcagtcgggttggaggacgtgacaaacggatatgtgccgtgatccacgtcgagcatagtggcctggccgccttcgaacagcacggtcttgccttcgtcaagtgccttattgagcaccagcgaggtgttggccacgtacggcttcaaacgttcgccgagcttgagcagctcatccgtggtttcgttcacatcaatcggacgacgattgtacagcttcaccagcatctggttcttctgatgcaggcttgcctcaaccttgtcgtgcaaatgctcagcattgaacaggtcgtgcacgcggatgcccacgcgattaatcttgtcggcatacgcaggtccgatgccgcgaccggtggtaccgatcttgtgcttacccaggaaacgttccgtcaccttatcaagcacacgatgatacggcgcaataatgtgcgcaccctcactcaccagcagtcgggagcagtccacaccgcggctttccaagccgtcgatctcttcgaaaagcacttcaggatcaacaacaacaccgttgccgataaccggagtcgcggtcgggctgatgatgccggagggcagcaggtgcagcgcatacgattcgtcgccgaccaccacggtatggcccgcattgttgccgccgttgaagcgggcaacatagtcgaccttcgtgccgatcaggtcggtcgccttacccttgccttcgtctccccactgggcaccgatcaaaacaattccaggcatgttgttgcacctccgcgcgtatgcgatttcgcctcaaagccttaccaaggccttacaaagactatcctgcgccctctaccggatatctgccggatatgcaccgatcggccgttgaaactagtcagttccatcgttttcgtctcatacaacgcgacacacccaccgtgccgccacacgccgcatgcattacgcggcgcgtgcggcatcacactacttcaacgccttgcccgcgctgccaagctgcctgcaagcctccaccacgcgtgcggccatggcgctttccgcttcgcgcccccacgaacgcgggtcgtacatcttcttgttgcccacctcgccatcgattttgagcaccgaatcatagttggagaacatgtgaccggccaccgcacggctgaatgcgtactgcgtatcggtgtcgatgttcatcttcaccacgccgtagctcacggcctgcgcgatctcctccggcgcggagccggaaccaccgtggaacaccagggcgaacggcttaccgggagcgacatccagcgagtgcgcggggtcgggcatttcgccggccttaatcgcgagcgcgaccgtggtctggatttcgtcgagcagttcggggcgcagtttcaccacgcccggtttgtatgcgccgtgcacgttgccgaaggtgaaggcggccatgtagcgtccgcgctcgccaaggccgagtcgttgcgcgacggcgatgccttgcgcgggcgtggaatacagtttgtcgttgatttcggcgctgtgcccgtcttcttcgccgccgaccgcgccgatttcgatttccagcacggtgtgcgcggcttgggatttgtcgagcagttcttctgcgatgtcgaggttttcacccagcggcactgtggaaccgtcccacatgtgtgactggaaggtcggttcctgaccgtgcttcacctgttcggcttcatggtcgagcagggggcgcacccattcgtccagatactgtttggcgcagtggtcggtgtgcagggcgatggtgatgttggggtatttcgccgcgacttcgtgcgcgaaggctgcgaaggcaagcgagccggtgacgcggtcgttgacgcgttgcccggagaagtaggcggcgccgcctacggagacctggatgatgccatcggattccgcctcggcgaaaccttggagtgcggcgttcagggtctgtgtgctggtcacattgatcgcgggataggcgtaaccgccgcggcgtgcggcgtccagcatttgcgcataacgttccggcgttgcaatagtcatgcctccattatcgcccgaccctatcccacttatcatgtgacaacattcgccatctttcctttccgttttcccgaccgtccgctccatatccaggtcgcccgccccactagggccatatgccgagcgttttcgtctcatatcccgacatttgcgggaccgaccattaaacagggcgaaaccattgcgatcgttccatcggaagtcatagaatatccaccggatcgcgcgacgaagagcccaaccgggtattcccgcacgggcatgccgccgcacgtagatgttgcgaccaatacccgcgaggagacttgatgcaccaggttttcgccatcttccttcgagacgtgaaacgcattctgaagaacccagtggcgctcgtcgtcacgctgggtgtggccatcatcccatcactgtacgcatggtgcaacatcctcgccaactgggacccgtacgcgaacacgggcaacatccaggtcgctgtggcgaacgaggacaagggcacaacctccacgctggtcggtcatctcgacgctggccagcaaaccgtcaaccagcttaagaagaaccatcagctcggctggcgtttcgttcccgagcagcaagccatcgaaggcgtggaatccggcaaatactatgcggcgatcgtactgccggaagacttcagctccagactaatcggcaccgtcactggtaaaggcgaccgaccgtcgatcacgtactacatcaacgaaaagctgaacgcgatcgcgccgaaaatcaccgatacgggtgcgaccacgatcgacgagcagatcaacaccactttcgtttccagcgtggccgacgccgtggcgaaggaagtgaaggaggcagcgggagaaaccaccggcagcatgaaaagcgcgcaaagcgacgtcatcaacgatctgaccgacaccatcaaccagctcgaaaccgtccaacagcagctgcgcggcacgcgttccacgctcgacaaggccctcaccaccatcgattcggccaaacagtccaacatcgcgctcgcctcgggaatcaccaactcgcttgacaccgtcggcaaggcgtccgacttgctgagcgagacgcgcacacaaaccgaacgattctcgaacacgctggtcggagcgctcgacaacggcagcacgcaactgtccggtctgcaggtcaacgtgagcaatgccaccggcaccgtgctcagcggactgaacaccacgcaggacgcgctcgaccaagtgtccagcaccatgcatcacgtcaacaccaccaccggcaatgtgctcgacggcgtggagaaggcgttgcaggccagccagctggatccgaacagccaaacgtataaggatctttccgcgcaactcgccgaagcccgcaaacagctgacgttccagcagcagcgcatcgacgccttcgatcaggacaccacggctgcgatcaacgcggggaagaacaccgcgaacgggttcaacgacgatgtcaccacgctggcgaaaaacggcacggcgtcgatggcgagcgcacgcacgaccatcaccggcacggtcatgccgaatctcaacaccgggctcgatacactcagcctggccaatgggtcgctgtccggcacgcttaccacgctgcaaagcacactggaacagggcaacgggctgctcgaccagttgtcgcgcaccgtgacccaaacgaacaccaccattgctggcacgcagacgcagctcgccaatctcgccaaacagctcaacaccacgcgcaccgatgtggccgcgttgagcagttcggcgatgttccagcagctttcccaagcgctcggacttgacgcgagcgaggtcggctcgttcgtgggcgagccggtgcatttggacgaacaggtcctctacccggtcaaaaactatggttccgcggtcacgccgttctacacgaatcttgcgctatgggtcggcggattcgtgctcgtcgcgatctacaagcttgaagtggaccgcgatgagaagatccgcatgtacacgccacgccaaggctatatgggccgttggctgctgttcgtcacggtcggattcctgcaggcgatcatcgccacgatcggcgatctcgcgctgggcatccaatgcgagcatccgttcctgttcatcctcgccggcattttcgcctcgttcgtctacgtgaacatcatttacgcgctcgccgtggcgttccggcatatcggcaaggccgtcgccgtgattctggtgatcatccagattccgggcgcggcaggcctctaccccatcgagatgatgccggaattcttccgccgtctgaaaccgttcctaccgttcacctacggcatcaacgcgatgcgcgggccgatcggcggcatgtatgccaaccattattggatcgacatgctctcgctgttctggtatctgcctgtggcgctgttcatcggcttggtcgtccgcaagctggcgttgaacctcaaccgcctgttcgacaaccgtctggcggacactgatctgatgatcaccgaacataacgaaggcacggtggaaccgttgcggctcaccgagaccgcgcagcagatcgccgaggagttccccgaactcgcccgcagacgggcgattcatttcttccgcctgtacccgcgcctggtgcgctggggattcctcgcgctggcggtactgccgttcgtgtttctgctgttgctattcatcacgcgcatgaagctcgccatgctgctcggttggatcatttcgatcatcgccatcgacacgtatctcatcgtggtggagtatctgcgcgaacggtatgcgaattatctgggcgaggaagcgatgagtgcggaagagttccgcagcgcgatcctgcacgagaacctgctattccggccgggcatgcattacaagccgatgcatgccgtacgcacgaggctgtatgaggctgcgcatggtggttcggccggacatgcgcctgaacatgcggctgagtatgaggctggaaacacggacggaaatgctggcaggagtctgcgtgaggaggggaacgaacagtgaaaataatctggggcatcttcaagcgggacatgtgccacgccacccgcaacgtgatcgccgtgatcgtctcgatgggcctggtggtggtaccggcgctgtacgcctggttcaacatcgcggccagctggaacccctacggcaacaccaaggcattgaaggtcgccgtggccaataacgacaagggttacaagtcggatctcataccggtgcgcgtcaacgtgggcgaaaccatcatcagcacactgcacgccaacgaccagctggactggcaattcgtgaaaagcgacaaggcaatcgacggggtgaaatccggcgaatactatgcggcgatcgtaattccgaaaggtttcagcgccgacatgatgacgctgttctcccccgacatcaaacacgcgcagctcaagtactatctgaacgagaaaatcaacccgatcgccccgcatatcaccgatcagggcgcgacaaccgtggtcaacacaatcgacaaaaccttcgccaaaacgattgcgcaagtcggactcgacctggcctcaagcatcctacactattcgcaaagcccgcaaatggccgaatacatgcgcaacctcaacggcaatctcaccaccatggcggatacgctgagcggcgcatcgcagcaggtaacgtcgtattcgcagctgctcggctcggcgaacgacatcgtggattccacgggcaaactgctcgcctcggcgaccaaggcgggcaaacaggcccagaacgcgttgaagcaaggcaaatcaggtgccacgtcgttcacttcggcaggtgcgaacgtcacctcctcagtgaacaccgcgctcgaccaggtgtcaggcgcgttcgaccaagtagctgccaaggtgaacaaggcgttcgacgcgatcggcaaggactcagacaccgcagccagccagttgacaacgttgagcgaacaagtctccagcagcgaatcgctgtacgacacgtacatcacaagcctcaaccacatgcacgaatcggtggaacaactaccggacagtgattccgcgaaacaggcgctgctggaagccatcgaccgggagatcacgctgctggaagccgccaaaggcgattcgcagaagctcgcgcagcagctgaaagacgcttccacgcaggtcacgcaggataccgcagccgcggaacgctcccgcaaggagatcctgaaccgcatcacctccgcgaagcagtcgatcagcaatgtgcgcgacgattacgccacgaacgtcaagccgaaaatcgacgcgctcgcctccacagtcagcacgctgatctcccaaaccgacaacatgatcacccagctgagcggcaccgccgacgatctggacgatgtgacgggcgatgtggggacgaatgtgacatccatccgttccacgctcggcgcgatcgcgaagaaactcgactcgtcggcagcgacggtgaaggagctgatcacgaagctggagacgggcgggaacgccggtgacggcaacagcgatggtggagacggtgacaacgacgccagttcgtccgattcgggtgaatcggacgaactacgtgcactggccaccgccaacgcgtccacactgtccacgctgatttccgcgcccgtcgcactgcagcgcgtctcagtgtacccgatcgcgaactacggttcggccatggcgccgttctatacgatcctgtcaatctgggtgggtgcgatcatcctgtgcgccatgctgaaagtgacaatttcggaccgcgagaaggcgcatgtgctgggcttgggcgacacgctgccgcgcgtcgccggcccgtccggcccggggaacgcctcacgttggggactgcgcctcgaccacgagtatttcggacggtacgcgatcttcgcactgctcgcgttgctgcagggcacactggtttgcctgggtgacatgtatttccttggcgtgcaggcgaatcatgcgctgcagttccttgccgtggggtggcttgccgcgctcgtgttctcgaatatcgtgtatacgctgaccgtgtcgttcggcgatatcggcaaggccgtggccgtggtgctgctggtgatgcaggtcgccggttcgggcggtacgttccctatcgagacgctgccgaagttcttccaaatgctctacccgttcctaccgttcccgcacgccatcgatgccatgcacgccgcgatggccggatcgtacggcaatgagtacctgcttgacatggtgtatctcgccttgttcctgattccttcgctgctgctgggattggtgttgcgcaagccggtgatccggttgaacaactgggtgagccgcaatctggaatccaccaaggtgatgtgacgaggtggatttgaacgggctggtttaagccggtttagatcggtttcggctggcacacatggacgcgtcattggcgacgcatcaccatcaccgccaacggcaacacacaccaaataccagccgacaaaaacctaagctagcgtggatgcgtaagggcattgtcctgcccggtcacttcccttacgtaccgctgcgccatcccggcgctcctctgcgccgccactaccccacatgtcgcctcctcacacaccaacaagcgtccgattctgcagaatcggacaatcagcggcgtcgcgcaaaccacacgttgatcagcgagccgaccaccaccagcgcgacaccgatccagaatggcatgcccaacgtcacgcccaataggagcgtgctggaagcagtggagaacagcggcgtcgcatacgaaccgatcgcaagcgtttccatactgccatgtagcatgccatacccccagcacgcgtagccgccggcaatcgacgcggcacatgcgagcagcgaaatatagccgccgatgccaggcgctacagctggcaaaccgtcgcccgaaacgaaatggataatccacagcacaacagcaacgcaacagaagaaaatcgtcgtaccatcgtaaccatcggacatcgatggcgtcacggtcgcgtaaatcgcccaaataaaggcgcctgcgaacgcgagcgcgtacggcaatggattgctggcgatattggcaaccgcttcctgcacgtcaaggttttcaccgccgaccgccattgccacgccgacggtggctacgattgcacccggcagcgcttcggagaccgagccgcgtttgtgcgacacggcggcggtcatcagtaccagcagcgtcggccacaaataattgacgaggctgacttccacagattgcgcgttcgttgtggccagaccgatcgacagcgagatcgacgcctcgtatgcgatgaacatgagtccgcctgcgacgaggtacttgcgtggcgcttggttaatcggtttcggccgtcgcacgatgagcaggagcatgccgccgacagtgtagatgagcgccgagccgagcgtggcgccgaacgattcggaaacgagtcgcacgaggccggccatgaagccccacaggacgattgcgaacaggccgatgagtgtcgccgcgtgtgatatggcatgaccaaataggggggtattggggcgttcgcctgcggattcggcgggaagtttctgatccgtattcacggattccagcctacctgccgcccaccccgcatgtccgattctgcagaaacggacactatttgttggtttaccgccgcctggcctccttaaccaatggcacgatgatgaccacgacgccacacagcacaccgccgatcggccacgggacccagaacaccttcatccacgcgtcaacatcactgcccgccattccaagaaaaagcataagcaacgcgacaacagtcgctaacaacatgatcacgccacaaattgcaccggtaagtctactgtaaaatctgtccgactcgctcatcgtcgggtgcggcacggaacgtccctcgcgcacgctttcctcttcggcttcacgattgtatttgtccacattcaccttgtcatgcgtcatcccggacataatgaaacagaacgccgccgcggccacgcaagccagcagaacgctgtccggccaccccgcgtctccgtcggcaacaagctcgtcacaaaacactcgcacgcacacgcccgccaaaatcagcacggcaccaatcgcaacaccaatcgccaatacgaccgacgcacgtgacttgtcctcatccgtgtaaaaatcctgcacatacgggtggcgacggcggaaatcgccatgcatgattccggccggtatcagcaaagcgagaccgacaatcgcgccaaccaacgtgcataccgtgaccagcacgtcgttcaccggcgacggccccaagacagacccctccggcgaaaacaacatgccaaccgcgacgccgaggatgattgcggccacaccaatcgcaataagccacgcaaaacgcctcatatgactgtcgtagccaaccacatcctgcacgatatgtcggggcacgctttgcggaatgtccgtcccatctcgcgtgtccgattctggagaaacggacaattgaacaccggttttggcaccttgtgcgtccgattcaccagaatcggacattcctgcgacctgcgatgccgcaaacccgattacccccggaaccgcgccaacagcagcgtcggccaccccaaccgacgcggccacaccatccgtatcagcagccaagtccacgcgtcccgcacccccacagcccgccgacgcgcgcacgtcgcccatgaccaaatcatccaacgtcacgccgaacatgtcgcaaagcatcagcagcttatccatttcggggtatgccttctcggactcccatttcgaaattgcctgccgggaaacgcccagcagcattgccagctgttcctgcgtcatgttgcgcgaaccgcgcagatactgcagattctctttgaaactcatgtccgccctttcgtcgagtttccatatcgcctcgacttgcgattattggcgattgccaagcaacagcttgtcataagcgtcgcgttccacgccaccatctttcggttgcattgcgattcgcaaccaaattttgcgacgcaaccgacagttgcgcggcgcgaagttgacttcacgggtcttttacggcaatagaaaaacccttggaattccaacgattccaagggtttcgaatggagcggatgacgggagtcgaacccgcctctaaagcttgggaagctttcgttctaccgatgaactacatccgcaagattgtgccttttgggcacgaaacttcagtttagcacgcaacggatgcgtatgcggacacagaccgacatgcgatatcaattttccgcaatatcacggaaactcagccgcgcgaccgctgcgaatagtcacgagaatatctgccagccgagccgcccgaatcatgtccggacccatactgcgttccaaattgcggaccaccggcaccagccatcgcagaacgtccgccttgccgaatatccgccgccgcaacgccgctcgtggcataaccgccagccaaatagccggactgcacgccctgcgccttcatctcctgactcatctgcatcaaccgggcaatacgatcctcagtcgccggatgcgtggaaaacaggcgagaaaaaccttccgcagaaaacggattcgcaatcatcatcgcagcaaccgactgcgtaccagcagtcttctgcatcggcatcgtctcagcgccgttcgaaatcttattcaatgcggacgcgagcgcctccggatcttccgtaagcatggaaccatcttcgtcagcatcatattctcgcgtacgtgaaatcgccatctgaataagcgaagcggcgattggcgcaagaatcgtgctcaacagcacacccagtaatccaagaccattagaggatgagtcattgcgatcatcgcgcgaattgccaccaccgaaatacatgagcgaatatccgagatacgaaatgaccgtcgccattgcggacgcgatcgcagaagtcaggatatcgtgattgtacacgtgcataagctcgtgcccgagcacgccgcgaatctcgcgttcgttcaacatccgcagaataccctgcgtgcagcaaaccgccgcatgacgttcattgcgtcctgttgcgaacgcattgggactcatggttggggcgatataaatacgcggcatcggcttgcccgccttcgccgacagttcgcgcacgattttgtacagtaccggcgcttcctgctcgctgacttcctgcgcgcgcatggatgcgatcgcgagtttgtcggaaaaccagtaggatgcgaacgttgagccaagtccgatgagaatgtagataccaagcgtgcgctggctgccaccggtcgcccaccaaatgagcatgatgacgccccacatcaacgcgaataacagcgttgtcttcaagccattgcaatggccatgcacctgcaatttgccgttcatggtcactagcgtagaaacggagtctgagtttttgctggatatgcgctggagactgggttgcggaaaagactaggttgcggaagttcgcatgctcagcttctccccagatgtccgattccagagaaacggacatccaatgcatgccaagaggcctttgggtgaccgaatcgggagaatcggacaagtagcaagtccttcgtccacattacatgtccaattcaccagaaacagacatacagaacatgtttcggacactccagatgtccgattcaccagacacagacaagcacaggataaaaaatgcgtcttgggtgaccgattctccagaatcggacatccaagacgcatgaaagaaacctgggacctatcagatcagatcccaaacacccaccttaagcgtgagccagggcgcgcatctgctccggatcgatgaccttcttgtgctcacggccttccttcgcaccctcggcacgttcgaacgcatcgatcttcttccagccagcgaagtcgatcggcttgacaccgcgcgattccagcagccggtcgatggactccggatcacgatcggcagccacacgaccgccttcagcagccttcgacaaatcctccagcatattggtcacgatcagcagtgcgtcggacttggtggagccgatcaggccaaccggaccacgcttcgcccaaccggtcgcatacagacgctcgcgcacttcatccgtggcttcagcggccgtagtgatacgaccgtcaccgttcgcgttcgccaagtgcgcatgacgctcgtcgtacgcaatgcccggcgcggtggccggtttgtagccgatcgcatggtacacagcctgcaccggatactcttcgaattcgccggtacggctcatcttgccgtccgccgatgtctcggtcttttccacacggatgccaacgaccttgccgtcctcacccaacacttcgaccggagcggaattgaagtgcacgtaatatttgcggtcagccggattaccctcataatccacgtcaccgtcatcttccatgtcttccgccatctcacgaatcgtgaacagctcttcgaccatctgacgagtcagcttgtctttgccggcctcttcaatcgtgtcttcatccaaatcgaaatcgtcttcgttgatgatcagctgcactcccggcagcttctccatctcacgcaattcctgcacggagaacttggcctgcgccacaccgcgacggatgaacaagtgaagcacacgcgccttgttggacttgatgccctcatatacgttgtccggaatgtcggtgcgctccttcagatcatcggcattgcgcatgagctcgcgagccacgtccatggccacgttgccgccgccgatcacggcgacttcctcagcttcaagcggccattcgcgagcgccggtcggataaccgtcgtaccattccacgaacttggctgcgccgtatacgccgtccagatcggcgcccggcagtccgagcggcttgtcttcgactgcaccggtggcgaacagcacggcatcgtaacgttcgagcagttcgtcgagcgtcacgtccttgccgaattccacgtcgcagtacaggtggatgtccggattgtcgagcgtcttttcgagtgccgacgcaatgaatttgatggacggatgatcgggggccacgccgtagcgcaccaggccgaacggcaccggcagcttttcgaacaggtcgattcgggcggcagtgccgaggccgagctcctcgccgagcttcttcaactggcgcaggaaaatgtcagaggagtagacgcctgcagggccggcgccgattacagcaatacgaagttcatgagtttcagtcacgcgctctagcctaatgcattccctgcatttgcaacaggggcgctcatgtactttcttacgacttcttcgccttgtgcgcactggcgttggtgtttgcgctgaatccagatgaatccaacgtgtggctgcattaatcgtacgcgatgagcgcggcagatgcacgtacaatcgcaagtagtcgcagaatcgcgggatgtaggaatccgaaatatcggaattcgtccatcccgcaatcgcaagcaagtacttattaagtaccaggcaatcgtaagaaggtggcaatgcgcattcacatcacatataccggcggcactatcggcatgattgactcgccgaacggcctgattccgggcgccgacactcgcggatggctgttccgtctgctggaggacgcgcacatggacgcgagcctgttcacgttcaccgaacttgatcctcttatcgactcgtcgaatgcgactcccgacaattggcagacgatggtcgacgatttgcgtgcgcaccgcgatgatgccgacgcgttcgtggtgttgcatggcaccgatacgatgagctattcgagcgccgcgcttgcgtatgcgttgactgattttggcaagccggtgattttcacgggttcacagcatccgcttggcaagatcgagtcggacgccactgcgaatgtcacgggcgcgctgaatgccgcgatgagcggacgattccacggtgtgggactgttttttggacatcacctgtttgcgggcaatcgtgtgagcaagtcgtcgagctgggcatttgaaggtttttcggcgccttccgtcggcccgctggcacgcactggcacgccatggcattggtatgcgggcgattccgctgcggttggctgcggttggacgtcgcctcagccttactctcgccatgatgttgcggtgatcgatatggcacccggcatttccgcggcacggttggaagcgatgcttacgccgcggccggaagcggttttgttgcgtgcgtacggcgtcggcaatgtgccaagcgacgagcctggactgactgacgtgattgccgacgtgctgcatgatggcgttcccgttgtgattgcatcgcagtgccagcaggcggaagtactgctcggccattacgagacgggtgatgcgatcgcacgcgccggcgcaattggatctggcgatatgacgctggaagccacgtatgcgaaaatcatgttcctgctgtctcaaggcgtgaccggagccgacttcggcaagtggatgcacacatcgatcgctggagaaatctccccgagctcgctgtaaacaatcccaaaacttccgaatctgccttatacatgccttatgtatggcagattccgaagttcgtccggagctatctgcgttatgtatggcagagctgttttgagaaaccggacttagagggtgtattctcgccccctaagtcaggttttctcatatggacctgccagatataagcgaaatacttgctgacagacctccaaatctgccatatataggcgagatacggggtttcgaggcgcaatcaggctgattcgccacggtcgaaaagcacggtgagcgcccacagaatgctgacaacatcaatcgcttcctgcatgaacgcgccgacaaccacgggaatcagattgaacgcggccgcgatcatgccgataatcgcaaggccgaggccgatcagcaccgcctgcaacatcacctttttcgtgcggcgcgcgatggcgatggcccgcggaacggacgcaatgtcgtcattcatgatgaccacttgcgcagattcggaagccgcggtggacgtgccgtcggtcatggccatgccgatatcggcaaccgcaagtacgggggcgtcgttgacgccgtcaccgaccatcatggtgatttgacgattcttggattcgccggttacgcgttgcttgatgcgattccacaacgacagcttctggtgcttggattcagtggcgctcttgacggcggcaaccttgtcttcagggaacagttcggactgcacgtcgtcgataccgacttcgtttgcgatgatgcgggcggacgcagccttgtcgccggtaagcatggacagttccttgacacccaactcgtgcaggcgagccaaagaacgcttcgcattctcgcgaggtacgtcacgaagtacgatgcgggcggcaagacggccgtcaatcgccacgtatgcagccatttcgtcaggagcgagcggggcaaacagcgagtttgcggtttcaggcttgcgagcggcggattgggttgcgacggacgcggaagtagagggcgcggctgcaggctgcgcatcgttaggcaccccgttcctcactcccatagtgtccgattctggagaatcggacaagtaaacacacgttttagccctctggatgtccgtttctggtgaatcggacatccgcagcgcattctgagtctcccgtttgtccgattcggcagaatcggacacgtaatacgtcgcatccggcatatgcagcaccggcatgaatccggattcgtcagccgtcacgtatgcgaaccgccccacgcgcacctgatgcccgttcacttcgccggatatacccttgccggactcctctacaatgttcttcaccaccggatagtcgcgcccgtgccccggcaaatcgcgctcgacgcacagcctctgccccgccgcataccgcgcatacaaatcatccatagccttgcgtccggccgccgcgatgcctttcgacagaatgtgcaccgaatagccttccaccacgctggccatcatgagaatatggtcctcattgaacggcgaactcgtctcaaacggcttctctacacgtacgacctgcggctgcttgacggtgagcgtgccggttttgtcgaagaaaatatgcgatacgcgacctagattttccagcacatcctgcgctttgatcaggattcccgctttggcaagtcgcccggttccagccacatatgcgaccggcgcggcaatcaacagcggacatggcgtagcaagcaccaatacttgcgcaaatcgcagcggcaatccggaaatcgcccatgcaatcccagcaatcgcaagcgaaagcacggtaaacggcactgcaagcatatccgcggtcttcacgacagcggggcgcgactcttgcgccgacgagaccagctccaggatcttctggtattgcgaatcgtgcgcaagttgcgtggcgcgcatggtcaatgttgtggagccattgaccgcaccggacatcacgcgagcgcccgcatatacttcgcggggaacgggctcgccgttgatgttgcttaggtccaacgtggccacgcccgacagcagctcaccgtcgaccggcaccgtttcgccgggcaacaccaggatcacgtcgccgagctgtacctgatcaacggggaccgtttcgaaacgctctccagccgcatcatacgtctgcgcggcaccttttgtgtccgtttctggagattcagacgcaaaagcacgcttttcaccgtcttggttgtccgtttctccagaatcggacactctgacagtacgaaatccgtcggcggtcacgtcggccgtatgctcgctgcccgacgcgtgcacatgcccccgcatgccgggcagcacgaccacgtgcgcggttcgcggtgccgcgtcgatcagcgcggtcaggttgctttcggcctttgactgcgcgaattcctcgatcgcctcgccggacgagatcatcagcaccacggcccatgcggcccaatattcctgcactgcgaccgtcgacgcaatcgcgacgaccgccagcagatcgacgccaacatgcccgtgccgcagatcgtcgatcatgccgcgtaccgtcaccacaatcgtgtacgcaaccaacgcgatcacaatccactgcccaacgcccggattgaacgcactcaacccgtcaacgccgacttgcgaaatccacgaatcccacgcagcctcgccccacggcttccactcccccagcaatgccaacggaatcgcggacagaatggtaatcggcagtaacggaacctgtttgcacagtcgccagcaaatatcgatgattctacgcatgagaatctccttacgctcgtatcggacgccttgttaacccatcggcgcctcgcccgcgcgagccatcgatacacggcgtaaaaagatattttcagcatagcaaatatttgcgatttttgtgccgcaatacagcaataagggctgtgcgattgctcacacagcccttattgcattcttcttttggcttgctttttgttgattttcgcggttttcgttgtacttgcgatttcgtggtgccagccgcgtcttcgccgtcagcctatcgggtggcttccgtccgttcgcatgtcgcgaaacgttttagccagcccaacagtcttgacttgcgcaccgcaacaacttgcgtccgtcaattcacgcaccgcatcaacatctcgctttaccacaggccgaacgggtcgaacaggccgccaccgtcaccgtagccgttgccgtcgctctgtccatttccgttgccattgccgtcattaccgtaaccgttgccattgccgttctggctctggccatcattgccgttgttccgctggttctggctgttggcggagttcgtttgggattcctcctggtcgagtgtcacgtcaagctccatggtgttgccgtcgcgcacgaccgtcaatgtcaccttgtcgttcatggcggaggcgcgcacgtagccgagcagcgaatagttgttgttcaccgccttgccgttgaacgccacgatggagtcgccggccttcactccggccttggccgccgggctgttgtcgaccacggactgcacctgcgtgcaaccgcgggtcacgccgtccgcctcaaccgtggagctcttgatggtgacgccgagcgccacatgctgcacggtgccgttgtcgatgatctcgttagccacacgctttaccaggttcgacggaatggcgaagccgatgccgatggatccggcggtgccggaagacgttgtggtggatgcgatggatgagttgatgccaatcacctggccggccgcattgaaggtcggaccgccggaattacctgggttgacggccgcgtcaatctgcacggcgttggtgacgatgtcgttgttgttgtcatcggacacggtcaccgggcggttgagcgcggaaacgatgccgacggttgcggtgtcatcgtagccgagcggattgccgatggccatcacggattcacccacggcaagattgtcggaatcggcaaattccgcggctttcagattgctcggcggattgtcgagtttgattacggccagatcggtggtggtgtcggtgccgacgatttgcgctgagtagatggtgccgttggcgagcgtcacttgaatctgcttcgcgccggaaatcacatggttgttggtgacaatgtagcctttgtcgctgatgattgcaccggagcctttggcgctgccgtcgctggttgccacgtcaatggacaccacagaatcggacacttctttcgccaccgcgctccagtccgcggcctcgccggatttggctttcgccgaaccggatccggacgtgttggacttcacgctggtcagtgagctggaggtgggtacggtcacccatccattggtgattgccgcgtagccgacgccgaggcacaatgccgcggagacgagggccgccaccacgccggtcatcacatgcccggtcacgccggaagcggacttcggcttggttgctgcgccattctgctgcggggcaccgaacggattaccgttattcggattcccaaacgggttgccgttattgggagtattcggcgctgctggcggcacgttggctccgccttgcgcagcgggcttcatgaatggattgccgttattcgattgcgcgttctgctgatcgttctgctgatttccacccacatacggatttccgaagaaaggattgcgaggccgctgcggctgctgtccggaagcctgcccgtacgcgccatattgcggctgcgggggtatgttcggcgcaccattcgcagtatcgttcgcggctgcggtgccatcagccggctgcgtcggcacgggaccgtacgcaccatattccggtgccggacggtactgctgggccggcgcatcctgcgtggaaccgccaaccacggtacgttcgcccgccgcggaagcataatccggcgtattgcccgccgcagccgcggattccgccgaagcgccatcgttcgcaacaggcatggcggccgtcggctgatcctcaataccgccctgcacgtcaatcggttcggtagccgactctgcagcatacggctcacctgcgtaagtttgcgtctgttccgcatcaaccgacggcatcggcacggtctgttgttcgtcattctgcggctgcacggcgttctggtcgttctcttcagccattttcgctccttattcgtctcgcggcatttcacaaatcagcaatcgtgccgctcgaactgctatctatgagtaaagatactcgctctggaagtttcctgaatgtttgttgaaagtagcagccaaatacgttcaacatcaccattgaatctgaaaatcgcaccaaaatgcgatcggcaccttcatcgcactttccacatcttccttattttcatttcaccgatcgcattctttgcagcactttcaagaatcgctgctatcgcataaaatattccgcatgacaagccttaccgaatcatctaccggcacagcgcaagacacgcaaaacgcggcaaccgcagtgtccgaaaatctcatcgaacatccgcgtggagcggaaccaggcaagccgggccgccgcgacgccttctatttcgaacagaaaaaccgccttcccgacgcggcggacggtaaggggcgaggcggcgcacgatatggtcgcaccggcattattcacaccccccacggcgatattcacactccagcgttcgtgcccgtggccacgcaggccgcgatgaaagccgttctgcccgaaaccatgaaggacctcggcgcgcaatgcctgctgtccaacgcgtttcacctgtatgaacgccccggcgaacaagtgctcgacgaagccggcggccttgccaaattcatgaactggaacggtccgaccttcaccgattccggcggtttccaagtgctttcgctcggcgcaggcttcaagaaaaccctcgccatggacgtgaccggcatgaaatcagacgacgtgatcgccgaaggcaaggagcgtctcgcgttcgtggacgaggacggtgtaacgttcaaatcgccgctcaacggctcactgcaccgtttttccgccgaaatttcaatgggaatccagcataagatcggcgccgacatcatgttcgcgttcgacgagctgaccacactgatgaacacgcgcggctaccaggagcgttccgcggaacgcacctaccgttgggcgcagcgttgcgttgccgagcataagagacttaccgaagagcgcgtcggcaagccgtatcaggcgctgtatggcgtggtacagggcgcgaattatgaggatttgcgcaggcatgcggccgaacagatcgcttcgttggatttcgacggcgtcggtattggaggtgcgattgaaaagcgcattatcggcgacacttgcgcctggatttgcgatgcgatgccggaaagccgaccgcgccacgtgctcggcatcgccgcagtcgacgatattttcgcatgcgtcgagaatggtggagacacgttcgattgcgtcgcaccggcgcgttgcggccgaaatggcgcgattttcacgcgcggcggacgttacaacatcaagcgcgcgcaattcaagcatgattttggtccacttgaagagggctgcgattgctacacatgcacgcattattcgcgcgcttacgtggatcatgcgttgcgtgcccgcgaattcaacggtttcacattggcgacgatccacaacgagcatttcttcgtgaagctgctggacgatattcgcgcgtcgattgacggcggatatttcgacgaattccgcgacgaaaccctggcccgcttctacgccaacggttcccgcggatgatgcatttcacttgggccttccacccaaacgaatgctgagccatacttccgcattccaaggcgccgacgaacaaacccgtcggcgccttttcatgcatggcgagcccgcactcgccgtctcgttctcagacttgtcaccagatgtgtccgattctggagaaacggacaaccacaccacatgtttcatgccctacatgtccgattcgggcgaaacggacaaccacaatgcttatctcacgttctacttgtccgattctggagaaatggacaagtaagcaacctaaaaacactcgctggatgtccgaaacgccagaatcgggcacacagagcgtcgcgccgcttgaattttcctacggaaaatggcgggatcaaggatggctccgtcgtacggaagcccacagggcttcctccctcctcgcgtcgcgccgcttgaattttcctacggaaaatggcggcgcgacacgccgatttgaggttgcgcaggttttggtgtagattagtcgattgtctgcgagcgtggcggaatggtagacgcgctgtcttcaggtggcagtgagtgtatgctcgtgggggttcaactccccccgctcgcaccatggtgaaaggtcggagccgaaaggttccggccttttcgtttcccaagcggcagtagagctcagcggctcccgacaactccagtgactggaacaatcagaactcgtgttcgtttcggtaatggtttccccatgtcttcatcgcatcgatgatcgggcgcaggctttcgccgacttcagtcagcgagtattcgccgtggtcgtgaacgcggtcggcgcttggaccgaagagactctgccggcaatcccgaacactgccaagcatctggccgacgtgctcgccggcaccgacgtgcgcaccaataagtgtccgtttctggtgaatcggacaactaaggtatgggttttgcgttctggatgtccgattctccagaatcggacagtttatggctatggcgagcggtcagcgcacgaggaagaccatgatgatgatcatggcgaagccggtcaggtcggtgaaggtgaacgtttcgccggcccatgccactgcggtgatggtggccatgaccggttcgctggtgccgagcatggtggcacgcaccgcgccgacgcgcatcacgcctgccatgtagagccagaacgcgaggaacgtgccgcatacgatggtgtagagcagcagaagcacgcctcgcgcgtccagtgcgggaatgttcgcccacggttgcgcgaacgggcataatatgagtccggacatgaggaatgtgatgccgttgatggtcatgttgccccatttgagcatgagcacgaccggcaggatggacatggccgcggtgctcaccgcgtcaaccagtccccatgcgagcccctgccatggcaacgacagcgaggcgaagttgccgccggtggcgatgaggaacgtgcctgcgaacgccaggagcacgccgaccaattcacgcttgaggggcagtcgtttgccgcgcaggcatacccaggcgagcacgaagatcaggttgagcgtctgcaatacggtggcggttccggagttcgtccagtcgatggtcatcaggtaggagacctgcaccagaagcacgcagagcagtgtcgtgaccagatatttcggatacgatttgacgtctttgaccgctccggcgagtttctgcggtgtggtgatggccgatccgaccaggaagatcaggctggcgaatagcgcgcgtacgcaggaaagccagatcggatccagctggtagtcgcgcatcagcagtttggccacggtgctgttcataccccacatggcaccgcccagcaatgtcgtgccagtgccgatgagcaggcttttcggcgtctgttccagcacatgttccgtttttttcgtagtttttttcgcggttttttgcgattcggaagttttctgcgattgcgacgcctgtcccgacgtttgctttgccacggcctgtcctcgctctctccacggctttcacggcaaattcacggcgattgtaacgcacacggtacgcatattaaacgtcagttatgcaaaacagatttattccgccaagcttgcgttcggcgctgacaaaaaatcgaggattttgccgagatatgatccgagcacagcattcggcatggagaaaatttcgtgcaatgactggctgtatcgcactttttcgatggaaccgccgccttctcgcacacgttcgacgaagtcatcttgtggtccgttgagcacccacacgtcgcgtccggcttggaatagcaataccggagcttcgatagctccacacatgtcaggtttgagcacggctcgggaaagcgccatcgcctggtttgcccaatcgaacgtggccgcgttggtctggcacgtcacgtccgccaaacgttgcttgtggaaccagcggatgcgtgcctccgaggccccgcggtagtcgtcgagattgaggttgccgtcgaaatcggcatgcccgaacacacgcgatttgccgaagccaagcccgcagattacgccgaccacaatgcgtgcggcccacgtcggcatgccgaccaccggcgcgatcatcggcgcggacagcaccgccttgtcgaacagcgacgggtaacgttccagcgcggccgcgccgatgccgccgcccatggaatggcagtacaggtacattgggccaccatccgccgcctcacgccccacagtctgtgcaaacgtggcgaaatcggccacatatcgccgccaatcgtcaatccataccaaacttggattgctcatatcgtgcgcggaatggccatgcccgcgatgctcgaacacgcacaccgaatagccggccaacagaaagtaccacaccatttcgctgtatttgcgtccgaattcggtgaatccgtgcgaaatgacgatcgtgccacgaaatacgcccgaagcgccttcctcgcgcaacacgtcgaatgtgcgcgcgtcgtagcggtagtaatgcaaccggccggggcgctccaacttgggcaacgccttgccttcccaatcgacggtggccggttccatccaaccttccgtcatgcaagcctgcagcgcaggcagcaccgtagcgtccatttcggcgtcatagcgcgcctcgtcgatgagcgtgatagtcatggttccatcttaggcgaacggcgccaagacgaaactaagcacaggcctacgcgctgtataacgatgcgtcagtgcatcaacggcgtaccggaacaaccgaatcgtcacccccgcgcgccatcctcgcatactatggaggtatgaagttcgtttcactgctgatggtggtaacgctgtctctcaccggcacaccaacgtatgcgtacgcggcggcaactcccgttgacaacaacggtgatatctccgctgcccaagattccaactgcccaacatggctgcaatggctgtgcggaaaaggaaaatgatcgcatgatgtccacgcgggaaaagcatcccaagattcaccgcatcgcgctggtcgacaatgatccgcgagcgctggattcgctcagtgccgtcattgccagcaaagtgccgaccgcgtatgtggtgtggacggcgacttcaggctgtgaggcgatagaacgttgccaggatgcgaacggccatgtcagtttgttgattctcgatatgtcgatggagggattgcaaggccccgccacgtgttgtcggttgcgtttgatgggccagcgcatgccgattctcggtgcaaccagtttttccatcaatagttatcgggacaagctggttgaggctggtgcgcaagggttggttggtaaggagaatgccgaccagttggcgcagattattatgcgtatgtgcaatggcgaggtgatggagggatttgagccgcctgcgttggccaatctgcgtatcagcagggaggctgagaccactcccgcgcttaccgttcgtgaggagcagattatttccttgtgcgcggagggcatgcttgaccgggacatcgccgagcgtttggggatttccgaagccaccatccgcaaacatatgcaaagtattttaagaaaactcaactgcaagacctcgcgtcaggcagtggcactgtgggtgaggtccaatgcgctctaaacccgcaactcagtacattgcgtggcgcaaccgtatgcgcacgcagcatccgaacctgtggcatccaatccgtttcgccattatgctgatcgtgcttgcatggaccatatacggcgtttgctacgagcctcctaccgacatatttggcgtgatatgggttgcgatgctggttacggcgctcgtaccgtctccgctgtttctgaaaagtacatcggtggcgattctcgtgattgcctccataggcgatctgtttactccctacgcgcatttgggaaattctcttcccgcgcagctttacgcctatggcatgctcgcatacagcactaatgccattatcgtggcaacgttactcatatattacgttgttaacattctgctgattgacccccctgacccaaataccaaccccgtcgccatggtcagcatgtatgccatggtgctactgcttggtcggacgttgagttggagcgaaaaaacaacgcagaaaagcttcgaagcggcgcagaacaagaatcgtctgcaggaattggaaagccgcgcacgcattgccgatgccattcacgatgcggtgacgggcgatttgtcagcggcgtcgtttgtggcgcaacggcatatcggtggcaactctagcggccctggcgtcgctgctgaccctgccaacgcaaccacaactacggcaaccacaacagccgatgccgaagactggcgtcaaatcaacgaatatattctttccgcattgacgaacgtgcatcgcgtcatcgacgaattgaatatggacgccaccactctccccggcgacgccgacggcgaagcgttggccaatctgctgcgagcaacactggatgacggcgatcgtcgcttgcgcaagcttggcttcaatatcacgtccatccggcactgcgcgggcggcaagccgagcgcatcgcaagcaatcgccgaacttgccaataatctgctgcgcgagatctatgcgaatatcgcacgccatgccgctccgggaagcaaggtcgatctttcggtgatgctccggccgaatgccatcgaaatcacgcaaatcaatcccatgaaagaggacatggctggagctgacgagcgcgatgacgaactaccgggcggccacgggctcgcctcgttcaagaagcagctcgaatcgtatcagggcacgctcaccacgtctgcgcaggacggcagttggacgttgtttgcgtacattccggtgaccgtcatcgacgattcgcccggtttgcttgaacaagtgcaggtttgaccatagctgcggatcagggttaggacgagcccgatccaccgattccgtctttttcaagcccagattttttttgggggggggtacacaaatgtggtcccccctcgcttgcgaagtcgtttcgcctgttttatgttggcattcgagaagggaacgcgttcgcccacgacgttcggatgcttggcagtccgggaatcgcaggggaacgcgttttgtcttcctacggcgctttgcagcactttcgtttgcgatgttgccgttaccgttactgcactgtcgtcacggtgccgtcaccccaacgcttccgcaaggaaatcgcgctgcaggatcagcagattttcggcaaccgtctcgtcgttggtcatgtgcgtgatgccggtcagcggcaggaacgtgtgcttacgtccggttgccatcagcgcctggctcaggcgcaggctgtgcgcgatcgtcacattgtcgtcggcgaacccgtggatgagcatgagcgggcgatcaagctgcggcgcgtcggcgatgatgctgttgcgttcgtacacggccgagtcaaggccgagatagcgttcggtgtaatgcgtgtcgtacagcgtccagtcggtcggaggcgcgcccgcgcaggccgcggcgaacgtttccggcgcctccaacacggcgagcgcggagaggaatccgccgtacgaccagccgatcatggcgacgcggctgagatcgggttgcggaacgttggctgccgcattctcgccagccagcgcttccaacgcttccggcagcgcgcgcacggcgtcgatctggtcttcgagcgttacggatttcatggtttcgtagatggcgcggtcccattgcgggccgcgtccggtggtgccgcgtccgtcggtggtgaccacgatgtagccttggtcggcccaccattgcgcgtcccaatagaaggattgactttcgatgacctgttggaagccggggcctccgtagggtttcatgagtaccggcaggatggcttcgtgcgcgtattcactatcggatgagggcagcacgatcgccgtgtacagctcacgttcgccgagtcgggtgaagtgcacgttcggcgtgaatccgggggtttcggcatggttttcgattggtgcgaccaccattgacgccacgtccgtaccattttcgtcggttgtggcgatgttcatgcaatgctgcatttgcacggttgcgtcgtccatgccccgtccggtcaccacgcagccgttgccggcgcgagacatgctccactggccgggcgcgtaggtgaggggttcccatgtgccgtcatagcggatcgacaccacgtcgaagctgcgggcgtcatggtcggcggcattcgactgccagaggaacggcaggtcgctttcaggcaggatttcaggggtgcgctgcaccacgcacagcacgtcgtcgtcggtcacgtcgagcacttcgcgcacctgcagtccggccggagtgaagggcgtaccatcaacggtgagtcggttcgtatcgacgtccatgtcgttcatcgcgcagatcaagcgtccatccggagtgaatgcaggggtgccgtggatgaggtcgagccagtagtcgttgccgtgttcctcaagcacgcgcgtggtgccggggcgttcgccttccgcgtattcgggaatggcgatggagaaggtttcgacctcgtcgccattgtcgtcggtgaagccgttttccgcgtcatgcatggtggcgatcggctcgcctacatggatggcgagcacctgatcgtgctgctggaggcggtcttgcacaaggatgatcggatcgtggccttcacgccagcttacggcggccagatattcgtaggattcatggtcccactgcacttcgttggcgattgccccgtagcagcagttgtcgctgtcgtagccgagttccagcagggtcagccgcacgtcggcattggcggtcaacgcttgcggatagcggttggcttgcgccggattggttggattcgcggggtccgacagatgccagatcggttcgggggattcgtcgtaggtttcgaagagcacgtatttggagtcgggtgaccaccagaagccgtcgtagcggtccatttcttcgcctgcggcgaattccgccaatccgattttccattcgccgttctgcggtgccgaggcgaccaccgaaatcgcgtcgccggtttcttcatcgttagcgagatccacgtccaccagatacgtgccggtggtgtacatgatgtgccgtccgtcgggactgatgcgcgggttcagcaccggtttgagttcatcttcctctatcgtgatggctcgcgtcgcgcccgccgtaaggtcggtgaggaaaagctgcccgttgatggtgaaggtcacgcggttgccggcaccgtcgacgcaatacgagacgatgccggatccgccttcgcgcgcacgttcgcgtcgcgccttctcttccgccggaacgtcttccgcgtcggcgtcggcaagcaatacgcgcggatcggcgagcggaatctcaccgatgttgccgtcttcgtcgatcacgctcatccacagcgaggtgacggtgtcttccggaccgtcggaacgcaggaacagcgcgcgggagccgtctgcaatcacgcgcgccgaacgcggagcgccgcaggaaaatcgcaaggtacgtgcttttttacgggggaactgtcgaatcgcatctgtcatgctcccaacctatcaccatcccaattccaccttccgtgaattcgtgcatcgtggaaatcgggggcgaaggtagtcatattcgcggataaataccccctaaatgatgctggtgatggatttatgcatgaaatttttgcaattaaaggacttacgaattggcgctcggcgctctaccgcgtaggatgggtgaggatagaaagggacaagcatgagtgttctcgaccgatttgagaaaagcgtggaaggcgccgtcaacggggttttcgccaagttcgggtccaaggacctgcagcccgtcgacctttccagcgctctggaacgtgagattgacaaagaggccatgcccgtcacgcgagaccgtaccgtggcgccgaatgagtaccgtttcaagctgagcacgccggatttcaacaacatcgtcgaatggggcgcggaagcgttggccaatgagctggccgacaacctcacccagtacgcgaaggaccagcattacgcgttcgtcggtccggtcgtggtgatcttcgaagaggaccttgacctcaccaagagcaatttcaagctgacgagcgaatccgtgcaaggcaataccgtgcccgtcaccaccgacgcgcagaccgaagactgcccgatgctggaaatcggcgaacaccagtatctgctcacggaaagcaagaccatcatcggccgcggatccgactgcgatatcgtgatcgacgatccgggcatctcccgccgccacatgcagatcgacatcaccgacaacggcaacaccgtcatcgcacgcgatctgggctccaccaacggcatgtatgtcgaaggccatcatgtcgaggcggccacgttgctcgacggcaacacgatcaccatcggccgcacccgaatcctgtattgggcctcttcgcaggatcaggagtaaccaaccccaacctcgggagttgcctctatgctcactgaacttactttcgcgatcctcaagtacggcttcctcgtactgctctggatcttcgtggcctgtacggtgcgttcgctgtacagggatgtggaaacgctcagcccgcgcaagtcgcgggctcatcgccgtaaggagcgtcgcgcgcgcaaggccgtcgaagcgcccgcgcccgtggccgtcccggcaccagtcgtcagcgccacatcaagcgccaaacccaccttgctggtcatcatcgatggcccccttgccggcagttccgtccctttgtccggcaacaccatcacgcttggccgttccgcttcgaacaccgtggttctggacgacgaattcgtctcgtcccaccatgcgcgcgtctatacggatcccgccaccggcaagtgggccatcgaagacctgggttccaccaacggcactgtggtcaaccagcagcgtctgaacgctccgatgattctcggatcgcgcgttcccgtacgcattggcgcaaccacctttgaattgaggtgacccgtttgccgacttctcccgcttcacaaccgctgttcatgtattccaccgtcgtttccgatgtgggtaccgtacgttccaacaaccaggattccgcgttcgccggcgagcatctgatcgccatctgcgatggcatgggaggccatgcaggaggcgacaccgcctccaccatcgccatccgttcattggcgcatatcgagcaagacaacgtgcagggcgatgtccagattatcgcccacatgatggaaacctcggttatggccgcgcatgacgcgatcgttggcaaagcgaagcgcgaacgtcgtctcgcgggcatgggcaccaccgtcacgtcggtcgcattggtggccggatattgggttttggcgcatatcggcgattcccgcgcatatctgctgcatgacggccgtctgatccgcatgacgtccgaccacagctacgtgcagcatctgatcgacaccggccgcatcagcgaggccgaggcgcgcaaccatccgcagcgcaacgtcgtgatgcgcgttctgggtgatttcgatatcgattcgagtccggacatcgccatacgcaaggcacatccggccgaccgctggctgctctgctccgacggtttgtgcggcgtgcttgaggattccacattgcaggaggtgctgtccgcctgctccgatcaggaggagtgcgcgcaacagctggtttcgatggcgcttcgtgccggcagcaccgacaacgtcaccgcggtcatcgccgacgcgacgctcgcccttgacgcggacgcgttcgatctgccgcatcagacgccattggttggcggcgcggccagcgcaagccttgagccaatcgccgacatcatcaacgagccggtcgcatccgctcccgcactgcgcgagggcaagaagtcgccggccgcccgtgccgcagcactgcgcaacggcaagaatcccaacgaggacgacaatcctccggaacagcgcgtggcgcaaccgtccacggtacgcgaggagaacggcgaccgcaccaatcccgacaccggtgaaatccccgtcgtacagaaggacgacggccgcatttccgccgatccgaacgatccggaagtcgccaaagccatccgcaacgagcatatcgagcagcgcaaaacgaagcgcacgcgcacccgacgcaaccgtgtgatcgccatcatcgtcaccatcgtggtactgctgggactggcgggcggcgcgttcgcaacctaccgttggagccaaaccaagtactacatcggcgacgacaacggcgaagtggcgattttccaaggcgtgccgacaagcctgttcggcttccagctgtcgcacgccgtcaccgacacccatatgaagacgagcgaactgccgccaagctggcaggaacagcttgcgcagggcatttccttcgacacgtacggcgaggcgaaaacgcatacgcgactgatcaaaaagcagctgaagcaacagcaggacgaagccgcgcagaaggaacaagacaaggcaaacggcgaatccgacaacaaatcctctggtacgacttccgacaagtcgtcgggcaaatcagacaaatcggacgacgcttcggcaaacaagtcaggcggtgaccagtcatgatggcaacccgtctgaagcaattcggcctgctgctgttcagcatgctgatttgcggcgtcgcgttcttccagatgttcgaacgcaccaccggcggttttccgcagaattatttgtggatgctcgcttttgtcggcgcattgttcctgacttcctggggattgccgctgcgtttccagccgtatgccaaccaggcgatcatgtgttgtgtgatggtgctgactggcaccggcatcatgatgatcgcccgcatcgaccaggattcgaacacgtccgtcgcgttcaaacagttgctttggctgtcgatagcgctggttttggcgaatctgctggtgatcttcatgaaggattaccgtgtgctgaggcggttctcgtacgtcagcatggtgatcggtttggtgttgctgctgtcaccgatgcttccggtgatcggttccgaacagtatggcgcgcgcatttgggtgaagattcccggtttgggatcgttccagccaagcgagttcgcgaagctgttcctcgcgtttttcttcgcctcctacctgtatgaccaccgcgaccagctggcggtcggtggcaagaaggtgctgggcctgcagctgccgcgcatcaaggatcttgggcctatcatcgtggtgtggatcgtgtcgatgggcgtgctggtcgtgcagcatgatttgggcacgtcgttgatgttcttcgccatgttcgtgtccatgttgtacgtggccacggggcgcaccagttggattgtgattggtttcatcgcgttcgccgtgggcgcgttcgccgcggccaatattttcagccatgtcggcgcgcgcgtcgacgcctggctgcacccgttcgactcggcgcagtacaacaaggagtacggcggatcctaccagctcgtcacgggtattttcggcctggcatcaggcggcttgatgggcaccggccttgggcaaggtcacccgtcgctcactccgatcgccaactccgactacatctacgcggcacttggcgaagagctgggcctcaccggtctgatggccattctgatgctctatctgctcatcatcgccgccgggatgatcactgcgatgaaaatcaaggatgggttcggcaagcttctcgcatcgggcctcgtgttcaccatggccttccaggtgttcaccgtggtgggaggcatcacgttagtcatcccacttacgggtttgactcttccgtacatggccgccggcggatcctcactcatagcgaattacatgttggcagcactcctagtggtgatttccaactcggcgaacaaacccgaatccgatatcgatagcgacacgttccaatatgaggcgatgcaggcgctgcgcgcccgcaagcagagccgcgcccgcagaagcgtggcctccgcgcaatcgcaggcctccacgcaggcctccacacaggcctccgcgcaggccactgaaatcatctccacggagacgccggtttcaggcacgccagtcgtaccacccgctcccccatcgggcactccgaacgtatcggacagcatgtcagaggggagccaagcatgaataagtcactccgccaactcttcaccatcgtggtggcgctgttcgtcatcctgggcatgtccaccaccatcatcacggcgattcgcgcgaaccagctcaacaacgacccgcgcaacacccgcgccctctaccacgagtatggcgctccgcgcggtgcgatcctcgcttcggacggctccgtcatcgccaaatccgacccttcgaacgacgcgttctcctaccagcgttcctataccgccggcgaactgtacgcgccggtcaccggcttcttctcgatcagccaacgcggctggaacggtatcgaagcgtcgcgtagctcgctgctgtcgggccaatccgaccagctggtatggcagcggttcaaatcgctgttcaccggccaggaaaacaagggcgcgaccatcgaaacgtccattgatccgaaaatccagcaggccgcctacaacggtcttgccaacaatgacggcgcggccgtggccatcgaagtgaaaaccggtcgtattctcgccatggcaagcacgccaagctacgacccgaaccagctggcgagccacgacacgtccgaagcgaacggcaattattccacgctttcgcaagacgagtcgaatccgatgctcaaccgtgccacctcgcagctgtatcctccgggatccacgttcaaaacggtggtggcggcggccgcgctggaaactggcgaataccagaccgacaccgagattccggccggatcgagctacacgcttccgggcacggtcacacagttgacgaacgcggtgtcgcaggccgacggttcggacggcaagatcacgttggaagacgcgatggcgtattcgtcgaacaccgcgttcgcccagctgggcgtggctttaggcgatgacaaggtgtcgtccatggccaagaagcttggtttcgacagtccgatcacggttgacggatccgattccacgggcacgccgtggatgagcgtggcgtcgaagttcccgaccgacacgaccgacgacaagctcgctttggcgtccatcggccaaggagacaccgtggtgactccgctgcagaacgcgctggtggcggccaccgtggcgaacgggggcaaggtcatgcagccgacgctggtggatcgcgtgcgttcctccgacctgtctgttatttcgcagaccaagccgcaggtgatgagccgcgcgttcagttcgggcaccgccaacaagctcacgcagatgatggaggcggtggtcaccaaggagaacccgaatctggccatcgacggcgtgcaggtgaatgcgaaaaccggcaccgcgcagatcggtgacggcaatacgtccatcgacggctgggtggtcggcttcgccccggcggacgatccgaagatcgctgttgccgtggtggtgcacaatgtggatttgtatggctcgttcgcggcgggtccgattatgaaggcgatgatgcaggaggcgctggcagagtgcaactgattgaaggacagctcatccaccgacgctacaggttggatgcccgtctggcccagggtggcatgggcgaagtatggaaaggctatgatatccagttgggtcgtcccgtggccattaaggcgttgcgcggcgacttgggcgtcacgcaggaggccaagctgcttcgcctgcgtgcggaagcgcataattccgccaatcttgcacacccgaatatcgctgcgttgttcgaatattacgaacatgacggcatcggcttcctcgttatggagtacgtgcccagcaagtcgctggccgacctgttccacgagcagaacggcccgatggagccgacccgtctgctgccgattctcatccagaccgcgcgtggcctgttcgtcgcgcattcgcatggcgtgatccaccgcgacgtgaagcctgcgaacatcatggtgtccgattccggcgaggtgaaaatcaccgatttcggcgtctcctactccaccaatcaggagcagatcacgcaggacggcatggtggtgggcaccgcacagtacatttccccggagcaggcgcagggccagcatgccacgcctcaatccgatatctattcgcttggcatcgtcgcctacgagggcctgtgcgggcatcgtccgttcacgggtgccacgccagtcgacatcgccgcagcacatgtcaacaatccggttccgccgctgccagactccgtcgacgtgcagctgcgtgaattcgtcatgtcgatgctgtccaaagacccgcttgaccgtccgaaggacgcgttgacggtgtcgcgcacgttgtcccgcatcgaacgccgtctgctcgaccagcagacacaattggctgacacgatggtggtgcctacaggcggaagacttccgcgacgcgtggtcagcagacctcatatctccttgagcactgatgggaaggaacagggatgaacatcaacatgcctacctctttggctggtggacgttaccagctcggccaactggtcggccgtggcggcatggccgaagtgcacgtggcgctcgatacgcgccttgggcgtaccgtcgcggtcaagatcatgcgcgccgacttcgccaacgacaagatcttccttgagcgtttccgtcgcgaagcccattccgtggcgcagatgaacaatccgaatatcgtgaacatctacgattcgggcgaagaggtcgtcgccacggaaaccggccagaccgaacatctgccgtatctggtgatggaatatgtcaagggccagaccttgcgcgacattctcaaagtgaatggcgctctgagccagcgcgacgccgaacaggtgatgatgggcgtgctcaacgcgcttgagtattcgcatcgcatgggcatcatccaccgcgacatcaagcccggcaacatcatgatttccgagcagggcgtggtcaaggtcatggacttcggcatcgcccgcgcgctcgacgattccgccgccacgatgacgcagtcgcagggtgtggtcggcaccgcgcaatacctgtctcccgagcaggcgcgcggcgaaagcgtcgacatgcgttccgacctgtattccgcaggctgcgtgctgtatgaaatgcttaccggaaggccgccgtttaccggcgattccgcggttgcgatcgcctaccagcatgtttcggaggtcgccactcccccaagttcggtcgttcccggcttgccgaagatgtgggattcgatttgcgcgaaagcgatggcgaaggatcgtcagaaccgttacgccacggcttccgagttcaagaacgatttgctgacgttcatgaacggcggcgtgccgatggcggccgcgttcaatccgttgaccgatctgaccaatatgaaggcacgcaagcaggccgaaatggacgcgaacaccgtggccatgactcctgccggtgaaaccgccgcgacgcaggcgttcaatcccgttacgggccagttcgaggccgtgccgaacccacagaacggcgtatccacaaaaacccgcgcggaacagcgtgccgaggccgctaaggcgcgtaagaagaagcagatcatcatcggctccgtggtgggcggtctggtggcgctgctggtcattctgggtgtgttcttcatgctgaacaagagcgactccaccgccgacatggtggaagttcctgatttcaccgccacggcgaatatttccgaggcgcgtgtcgaagagcagctcgcggccaagggtctgaagctcgatgcccgagaggattccgattcgagcgagccgaagggcaccatcaccaagcagaatccgacgggcggcaagaaggtcgccaagggctccacggtttccgtatggttctccaccggccctcagtcagtcgccgttccggatgtgtcgaacaagagccaggatgacgcgaaatccattcttgaggccgccggcttcaaggtgggtaacgtgcgcacggtcgacaatgcctccatcgaaaaagacaaggtggtaagcacggatcctgccgccaattcgaagcagactaagggcacgatcatcacgctgtacatttcgtccggcatgaccaagattcccgataatctgatcggacagccgaaagacacggttatcgagcagctgaagcaggccggtctgacgcagatcaccatcgaaagcgaatattccgattccatcgcttccggcgccgtcacccgcgtcgagccgggtgttggaagcacggtcgaggccggtaccgcggtcacgatttgggtgtctaccggcaagcagcagatcagcgtgcccagcgtggtcggcatgggctatgcgaacgccaagagcctgttggaaagctacggtttccaggtcacggtttccggcccggaggatggcacggtcacaggcatgtcaccgatcgccggcacccagtccgacagcggagccacgatcacgttgaccacgaagtcgtccagcaccaataatggcggcaacaacggcggcaacggcaacaacggcggcaacaacggcggcaacggcaacaacggcggcaacaccgacggaggcaacaacactcccgaaggcaactgatcggtcgagataaccgccatcattcacaaggaaggcccagctgaaatgccagctgggccttcctcattacggtcttatgttcttttgcgattcgtgttttcttacgattttgtattttcttgcgattgagattgcgcgacttacgtttccacgcttgtaccatgcgttttcgcacttcccacgtcttcttgctgcgaccttaggccgcgaccttgggctgcaatcccttggaacgttccacggcgttctcctggccgcacaccttcagccagttcgcaagcagacggtagccgtcctgcgtcatcacggattcggggtggaactgcaccgcatacatcggcttgctgcaatgcttgatgccctgcacgatgtggtcgacctgcgtccacgcggtcaccaccagctcttccggcacggaatcgggctccacggccagcgaatggtagcgagtggcggtcatcggattggcgacgccttcgaagatctcatcgtcgatatgctccaccaagctggttttgccgtgcatgatggtcggcgcgtggcttacggtcgcgccgaacacttcggccagcgcctgcatgccgaggcacacgccgaacatgggcttggactgctccgcgcacaggcgaatcatgccttcgctggcaccggaatcggccggagcgcccgggccgggagaaataagcacgccgtcgtattcgtcgatcacatcggcttcgcccggatcgatcgcatcgttgcgcaccaccgtcaccgcggcacccaacgtcttcaaatagccgacaatcgtgtaaacgaacgaatcgtagttgtccacgaccaaaatgcgtgcggaatcggtcatcatgctcctatcaacgtcggaatgtcggcgttcgaatgcttcgaatacttacgttgcgcgaatatttgcgtttgcatagcagtgtacgtgcgcaacatgtcgtgacgcggcgcgcgtctcacgcagcaatcgtgataatcgcagatcgcagcaatcgcagcaatcgctttcacgtctgccagcaaaactgccagcagaccgccggaaggcacctgaatacagctttatatggccgtgtaattcgacatttcctgcaatgccggaatattcgtcgcagcccacgggaacagccattcaaagcacgatgcggccgccgcgaaaatcagcaacgccatgagcacaagtcgaatcggaagcacacccggctgcaatcgcatcaatccgccgtacaagctgaattccggcttttcgcggcgtcctgcgcgcacgtcggcgagatacggccaacgccatgccaccagcgcggaaaggaagatgatcgcatatgcggcgagcgcgccgagaatccacggtttgagtgagctgacggatgcgacgatcgacgatttttcgttgttgacgaatttgactttgccgttggagtcggtggaggcgagctcctgggggatgccgtcggacaccttcgcccagtatgagaattccgcgtagctgatccagcggtgtgttggcgtggagtatttcggttcgcatgtggtcatggtcagcatgcgtttggttggcgtcgcgccggggttttcggggttggcggcgaccacttcgatgtcggtcggcagcacgattttgtagctggtgtagtggtagacgtaccagtaatcctgcgtgcgcacgatgatcgggtcgccttcctgcagtttgtcgacgtcgccgagtggctgtccgtagccgttgcggtgccctgcgaaggcgaaattgccgacttggccaggcatttgcgaatccttgtagtggccgagtccatgcttgttgagttcggtgagagaggtgccttcaacgaggttgcgctgccattggctgccgaatcgcggaatgtagacctgggcgatgagctcgccttcctgtgcgctttgcggttgcgttggcgggtcgccttcctgcgcttgtgcaatggtgacgctgtcggattgtccggggtcggaccatgatacggattggcgtgtttcgatttggttgtgttcggcctgcacgcccgtccaccacatttgccatgcgatgtagagcgcgcagacggccgccgcggtcagcatgagttcggcgaggatgccaagtatcgtccagaccacgcttttgcgacgctgttttggtgccacgtgcttcatcggttacttcccctcttgcgattcctgcgtttcgtccgtttgctgcgatccgtctgtttcgttgttcatcgcctgcgcgtattgcagcggctgttgcaatgcgtcggtcgcgtcgaaatggagtttttctttttcgtcgacctgccatcccaagccgaacgtgctgacgtactgccggtatatggtcacttcctgcgaattgtcgagcgcctttttcattgtctcgaccgggccgatcgcggaaatggtgaatggcggcgaatactttttgccctgcaaaagcagcacgttgccggaacagcgcactgcggaattgaacagcacacgctggtccatgatcatcatggattccgcgccgcccgcccaaagcgcgttcaccacggcttcgacgtcttgctggtgcaccacgtaatcgttgatgttggaggtggagccgctggaatcgaccatgttttcccagagtggtgaatcgtcgagcgtcaccacgagtccggggccttccaccgcgggcagcatggtgccgttgccggcgctttcgctgtcttgctggtcggcgtcgtcctggctgttcagggttttgctcagatcgttcacgcgggagctgagcgcgtcgacttccgtctgcagggagttgacttttttcacgcgttgttccacgagttcggcggtgtcgttggtcaccacgacggaacggttcacgcgcaggttcgtggcgagcaggaatccggagaacatgagcacaaggaatgccgccactccggccgctttcgaccgtttcgcggtgtgcttgccggtgtgcttcgccatgcggaccttcctgattcccattaagcatttgctctgattatgaacagttttgcgctgtgagttcgccgctttcgagtctacccactattatgacttttagcctattaaaggagactatgctgatggctgacgaagagctgcacgaaaccaccgcggacgatcagaacgatctgcagtccacggacgacaccgctgccgttgaagagagcaacgaaaccgttcaggatgccgctgaggaaaccaccgtcgattccacttctgacgaatccgctgattccgacgacgatgacgatcacgacattccgatggatcgcgtcgaagcggtgctgaacgctaccgccgataaggactccctgagcccgcagatgcagcgcatgatgaaccgtcaggcggagaacacccgccgcgtggaggaaaccatcaagggcaccaagtccaatccacgctggttcgtgccgctgttctgcgcgctgatgatcatcggtctgatctgggcggtcgtctactacctgacttccgactacccgattccgaacatcggcgcgtggaatctggccatcgcattcgcgatcatcatgatcggattcatcatgaccatgtggtggcgctaaagcgtagtttcgcctttcctgcgatttgagggcgtctgtacaacgtgcggtcagacgcccttttcgcatgcccttttacgattatctcgcaatcttttcgtaggttttcttcgtaggtttcacgctctttcgcaaacgtacgcggtctttcgcgactgccttgccaatcccggttcgcctgtttcttttttcgattccggtttgtttttcagattttcgacgtgcgcagcagcacatgatcgcagccttgcatggtagtgccgaacagatagaccggaccaccgtcggcaagcttcaatttcttgcgtagctgcggtgcggtaagcgggaagttacgtaccgcgatattggcctgtttcgtgccattcagcagtcgttttatatcctttttattcatgccgccgatcgcttcaatcgcgaatcctctgccgggaaaatcggcaaccggcgttgccgacacgaaaaggtgactgcttggaccgacctgcgtcacaccgaatcgttcctccaccagatcgaagcaaccggccttcataatcgacgcattcggctcatacaagtagtttttcgcctccggcagcggtttgccgccaatgcgcaggccctgcgtatatgcggcggaatcatagtcgatccgctgattgtcgttcacgcagaacacgcgcggcgcggatggttcctcatgcatctgctgacccaataccagcaacagttccttgcattcgttgccggtggccacgatatgcacttcgcgtacggtcccgtcgaaatcggcgaccgccttgcgccaatccaacatcggcgaaagcttgaccagcgtgtactgcgatttggcgagcaacaggtcacgcaattcgaacacgttcggcgtgcaatcctcgatcgcgtaagtgcgcgatccatgctcgtcgcggcgggccggatcaaggtagatgaagtccaccggacccatctgcctgaggtattccacgccgtcgccgcacacgatgcgcgcctggtcgagtcccagtgcggccatattgtgttcggccagatcgcacagatgccgctgccgttccacataagtggcttggctgaatccgcgcgccagatacgagaagtccacgccgaacccgcccgtcagatccaccatcgcccttttcgccaccaatgtgtccgattctggcgaatcggacatccacgcgcccattttcatctcttgcgtgtccgattctggagaatcggacaactggaacgcactttttgccgtttgcatgaccgattcggcagaatcggacaactgtggctcacttttcgtggtttggttgtccgattctccagaatcggacactctggcgcgcacggttgcggccggcgcaagcagtgtttgtgcgatttctgacttgtattgggctgtgaactgcgatgagcactgttccatggaaatgtgcggagggtatacgattccctcgcaggaggcccattgtggcagttttttgcgtgcgatctgccatccggcaatctggtcgagcgccaacggcaggtcgagcccttccacacgtttggccttcaacgccagttcgcgcacgtcctcgttgcgatgcatcgccacgaattcgcgcgtctcgtcattcatgattgtcattggtgacgtacctgatttcgttgtgttgattcgtcgtcattctggggattttctggtttcacacgatgtggataagtcgtggattattgtggacgaatgtggatagcatctatatcttgtaggcagttttatggctgtccacaatatataggatggtgtttttccccatttttccactgtgcacagtcgggttatccacattttccaccgttgaaaagccggggaatccaccgttttgtgaatatccttgtggataatgcaccgagttatccccgacttacccacagctcaaccctcacttatccacacacttatccacacttgtggataagtgtgtgtctgcgattccccaaatctgtttttctccttcctgccactaggagaacatgccaagaagggggtttgtgagaagtggattgctcatattgcatgcaacgacaatcgcaataatcacggccaacatgattacgccgtacatcagcgtgcgctgctgcaggcttttgccgcgcaacgcatgcagaccggaaaccaacagccaggcgaacactcctccgatgatgaatccgccgacatgcgcctgccatgcgatgttcggcgtgatgattggcatcaggaagttgatgagcatccagatcagcatggatcgaatgtcgatgccaatgcgctggtataccaccagaattgccgcgaacaggccgaatagcgcgccggaagcgccgtatgcggatgtcagccaaccgtcttgcgagaacagtgcccagaccatcatgccggcgcttccgccgagtcctgacagcacgtataacgcgagatatggcagatgccccatcatgcgttccaatacaggcccgacgcaccacaaggtcagcatgttgaaaagaatgtgccatagggaggccggctggtgcaggaacattgacgtaatgaaggtccatgggcggtgagtcgccagcgcgggcatgaatacgcctgagccgacgaatgcgttgcagccggtcggccagacgattttcaatagtgtttcgacaatccagaccgcgacgcatatcgccatgatcgtaacggtgatcacaggatcgccgttacgccaacggtatcgcatggaacgtgcagagaagaagtctttgaacgacggggaatcgggaaacagactgaaacgttgataagccatgtttcaaccctactggaacgtgcgaatccgcgaatctgcgaaatcattgcaaatgattgcattcttgtgaatccccggcgcgtaaatccacccaatcaacacattcaaggaattaatatagtgaacagagttggcttgaacgagcaggtcagccaatgttcgccgatatttgggaaaggatccgtcatggagaacaagtcttctaacggttggaagttcttcgcactgctcttcggagctttgcttgccggtgtcgtcggtctgtatgtgtacaagcagcagaatccggattacgatccgtgggaggagccatgggagaacagctcgtctcctgtcgatcttggcctgaccaaggatgccgaggatggcgaagccgaagtcgctcccgccaccccagaagctgcctgatttctctttctttcaagccctgcgccccacgcgcagggctttttgttttgccctggaaaacgaaaagggacgattccaaaacggaatcgtcccttcgtcatcacgccctatctaacgctacgagtcatacatcacgcgataattcacgtcacatatggcccgtgcgaagcgaaagtaatgacgagcgcagtatcacaaggcgtggaaggcacaagcgtacgaaaatacgtcaagccttccacaacgcagataacgctccgtcattacttgagcggaccggtcatccagatgcgctcgaggtaatcctccatcgagcggtcggagctgaagtagcccgagttcgccacgttgatgagggccttgcggttccattcgagcggccgggcgtagagggcctcgatttccgactggatggcggtgtaggcgccgaagtcggcgagggtcatgaaccagtccttggtgagccaatcgtggacaaggtcttcgtacacggtcttgtcgccgttggagaaggtgccgtccgcgaccatgtcgatggcggctttgagacgaggatcggcctcgtagtacttcttcggatcgtagccttcggcatagagggcatccacctcgtcgacggtcatgccgaagaggaagaagttctcagcgccgacgcgctcacggatttcgacgttggcaccgtcgagggtgccgacggtcatggcgccgttgagagcgaacttcatgttgccggtaccggaggcttccttgccggcctgggagatctgctcgtcgaggtcggttgccgggatgaggtgctgtgcgagacgcacgttgtagttccacgggaagtagacgttcagcttgcccttgacatccgggtcgttgttgatgacgcgggcgacgttgttgatcagctggatggtctgcttggcgaggtagtagcccggagcggccttggcgccgaacacgatggtgcgcggcatgacatcgtcggcggcgatcctgccggacttgatgtcggcgtagcgtgcgatcacggcgaggatcttcagtgcctgacgcttgtattcgtgcagacgcttgaccatggtgttgatcatggtgttcgggtcgatgtcgaagccgtattcgcgcttggcgtagttggagaagtcaaccttgttggcctgcttgacggcggcgaacttcttgacgaattcgtcatcggctgcgagcggttcgaggcccttgagcagttcgaggtcgctcacccacttgtcggtgccgaggccttcggtgatgaggtcggacagacgcgggttggcgagcttgacgaagcggcgaggggtcacgccgttggtcacgttggtgaacttgtccggatacacgtcggagaagttcttcagggtgacgtccttgagcagctgggagtgcagctcggcaacgccgttgacgtgggagccgccgtaggtggccaggtaggccatgcgcacagagtcgccggtgtagatggccatgtccttgatggtggcttcgtcgacgcccttggccttgagctcggctgcgaactggtcctggatcttctcgatgatttcgaggtgacgcggcaggagttcgccgatgagcttggacggccacacttccagggcttccggaagcagggtgtggcaggtgtagttgaaggtcttgttggtgacggtccaggcggtgtcccaatcgtagccgtactcgtccatgaggacgcgcatgagctccggaatgccgatgaccgggtgggtgtcgttgagctggaaggtgatcttgtccgcgaaggtggtcagatccggcttgtcctgacccgggtagaagacgcggatggcgtcgtggatggaggcggacacgaagaagtactgctgctcgagacgcagtgccttgccctgcggggtggaatcttccggatacaggatcttggagatgttctcagcttcaacctgcggcttgacggcgtcaaggtactcggacttgttgaaggtgagcaggtcgaactcgtcgtagctcttggcggtccacagacgcagggtgttcacacgaccggaggcatagcccggaaccatgtagtcgaccggcaccgcacgcacggaccaagccggcttccataccttcttgccatcttcctcaacgacttcgccgccgaaggaaaccttctggtcgcggttgtaatcgatgtgtccccacggctcttcattggtcagccagtagtccggggtttcgatctgcttgccgttttcatcgaacttctgctcgaagatgccgtacttgtactgaatgccataaccgaatgccggcacgcccagcgaggcgagcgaatcgatgaagcaggcggccagacggccgaggccaccgttgccgaggcccggctcgtgctcggcgtcgacgacgtcctgcacggagaagccgagttccttgaccgcggcgtcgaactgctcggtcagaccggcgttgagcagcgcgttgcgcagctgcttgcccatcaggaattctgcggacaggtagccgactgccttggtgttgccgttgaccatgtcggactgggtcttgaaccaggaatccatgaggtggcggcgcactgcggcggacgcggcgacgtacacgtcggccggcttggcctgctcgacggtgacgccctgggtgtacttcagctgctcgcggatctcgtctgcgaactgctccgcggtgaccgcggacttcggtgcggtaatttcagtcattaatcgactccctttgacggattactctccaggaacattatgccttaccccagcgtccttgcattagcggccgcatgaacactaagtaacatcatgcatacgttctcatacatagcatactacgtaatcataaaaagatgaaatttcaagcaattacaagcaagcattcgtttgcagaaataatgcaaaccggctgcaaaaacgttgcgagcaacatgcaaacgacatgcaacaacattgcgaacgctgtcaagaatcgcaagtattttccctctcttcacacccctattcagttgtgactacgttgtctgcaacaccccatcatagtcgctcgcaaacggcaaaataacacgtatggctgttattcgagaacaagatctgcataaggggcatgacgcatttgcacaatggctgcaaacgtctcatcgcatgatcgccgacaatattcccgcaaataccgacgcggcccgcgatttccgtctggaattctctccacgattgccacgccagctgtgggcgatggcggtgcgctactcgctgcatctgctggagaaaaaagcgcccggggcgggcgtggaagttcgtgtcgcgccgtggggtgccatcaagattctcgacggaccggcatccgatccgcataatctcacaccgccggacgtgatcgaactggaaccggacgtgtggatgagactcgccacgggcatcaccagctgggctgaggagaaggaggcaggacgcatcacggccgttggcgaacgcgacgatttgagtagcttgctgccgttggtgtgacaggctgcgagaagaccgtcacaggcgcaaaaacgcatagcaaaaccgcgatgtggatacacctggcaggcatatccgcatcgcggtttcacaaagtacctgatatgccgatcagtcctgcttcttcggcttcagtgcgctgggcatcggcatcgggatgggcttgtgtggcttcggcgcggcggacttggctgccgggaactctccgctcgtggccttcgccgccgcctctgcggcccactttgcatactcgtcgaggtcatcctcggcgtcggtttgcgcggactcctgagcatcttcagaaatctcatcttcagcgtccgcatcgtgagaatattttgcttcgatatcggcgaaaggatcaaaagaacccgaaccaggctcctgggcaccgagctccttggcgagctcatcataatcggtgtcggtggtcaggtacttgagctttcgggctattttctgctgtttggctttctgacgtccgcggcccatctgaccccctgaggattactgtgctatcaattcatcaaacaagagagtaccacttgctgtgccatatttcgttgtcggctcagacttttacgataaaatcgctgattttcttaagaaaaggacacgtatgacggacgaaacccaggagcagcagatcaccgctgtcggcaatgaaatgagcgcgagcttcctcgcagcgaagaagcgttccgacgcaacgctcgccgcaatcgaacagaatccgggcaagttcaccatgctgaccggcgaccgtccgaccggacgtctgcatctcggccattattttggttcgattcgtgagcgcgtcgccatgcagaatcgcggcgtgaattcgaatatcatcatcgccgattatcaggtgatcaccgatcgtgacacgaccgcgcacatcgaagacaatgtgctcaatttggtgcttgactacatggctgccggcatcgatccggaaaagaccatgattttcacgcattccgccgttcctgcggagaaccagctgatgctgccgttcctgtcattggtgactgaggccgagctgcatcgcaatcctacggtgaagtcggaaatggaagcttccggccatgcgctgaccggcctgctgctgacttatccggtgcatcaggcatgcgacattctgttctgcaaggccaatgtggtgccgatcggcaaggataacctgccgcatgtcgagatcacgcgcaccatcgcgcgtcgtttcaacgaacgctacgccaagaagcatccggtgttccccgagccggccgcgattctgtctgaagcgccggagattccaggcttggatggccgcaagatgagcaagtcgtacggcaattccatcatgttgggcgccacagcgcaggagaccgccaagctcatcaagaagagtccgaccgattccgagcgccgcatcacgttcgatccgatcgcacgtccgcaggtttccgcactgctgacgaccgccggtttggtcaccggtcgcgatccgaaggagatcgccgaggagatcggcgattccggtgcgggcgcgctgaaggcgtatgtgatcgaatcggtgaacagcttccttgagccgcatcgcgcccgtcgcgaggaactcgccaaggatatggattacgtgcgcgacgtgctcgccgaaggcaacaagaaggccaacgccatcgccaacgaaacgttggagcaggtgcgcgacgccatgggtatgcgctactaaagctccagaaacaccataatcacgctttaaacagcgtttcagcatcgacaaaggccggattgcgtattatacaatccggcctttgttgcgtttgagtggcatgtgccacattatgtttgattagattttcgcgcgcttttcgccggaagcgatttccgctgcgaccaaatcgtcatccaccttgcggtcatcgggatcatcaagataatgatcgaactcgtgcagcacttcagcatcgggagccggagtcagcagcgacaccaccacaatgaacagcagcgagatgatgaacgccggaagcagctcgtaaatagcgaagacaccaccaagcggcttgatgaaattatgccagatcagcacggtcgcagtaccggaaagcatgcccgcaatcgcaccgaatttattggtacgacgccaatacagcgagcagagcatcagcggaccgaacgaagcgcccaaaccggcccatgcatacgaaacaacctggaaaatcgacgaattctgatcgaacgcaaccacaatgccgaaaatgaacataaccagcaatgtgatgcgcgcaaccatcatcacctgacgatcggtggccttgcgatagagcaatccgcggaaaatattctcaccgaccgcggaagcgccgataatcaggtatgacgacgacgagctcatggacgcggcgaaaatgcccgacaccacgatgccgcacatgaagctcggcagcagcgcctgcgaaaccacgatgaaaatgttctccgcagcggactgcgtgacgaactgcgtcggcatcatcgcacggccaaccaaaccgatgcacacgccgcacgccagcgacaccacacaccatgtagtggcgatgatgcgagacttcttgatctcttcggaactgcggatcgacaggaatcgcacgagcacctgcggcatgccgaaatagccaagaccccacgcaagcatggaaatcatggtgatcacgccgtattcggtaggcgcgccgaacatggcctggccagccttgacaatctgctcgccggcatcgttcagaatcggcgtggccatttgcgtgccgtcaaggaagcctggaatgcctttgaggaaggcgacggtgttgtcgacgccgccgacggatgcgacggaaccgatgaacaccactgccagcgcgaagaacatgagcaagccttggatgaagtcggtcacgaccacggaaagatagcctccgatcacggtgtaggcgaacacgatggcagcgccgatcaccatggtcaggtggtagtcccagccgaacagggtcgagaaaagtttgccgaccgtcacgaagcagctaccgacatacacacagaaaaatacgaggatgatcagcgccgcgatggtggagacgatattgcgtttgtcatggaatcgtttggagaagaagtccggaatggtgatcgcgtcacctgccaccacggagtagcggcgcaaacggcgtgcgacgagcttccagttgaggtaggtgccgagagccaggccgagggccgtccacagcgggtcggcggcaccggtgaagtaggcgacgcccggcagtcccatgagcagccagccgctcatatcggaggcttcggcgctcaatgccgtcagccatggaccaacgcctcgaccacccgcgaaatactgacgagtggaggaattggaccgcttggagtagatgaagccgatggtgagcatggccacaaaatagatgaccatcgccagcagcacccaaaaatctttggtaaccatgaattctctcttcttagattgctagccgaatttctttcgaatctctttcttcaaatctctgtcgaaacgaatttctttcgaatctcttctgaaaaaaaaaatatgcgattgtcccaatgtaccggtcgaacattgcgacaatcgcatttatctcatttacgcacccaaatgccgaaacggatcaaatatcgtatctccaagacttatcggtgataacgcgagccatggctaggccgatcggcagacagataatcaccatgaacgcgcggaaagcccagtcgagggcgttcaaggtgtcgaattggccgaggtggaacatggcttgatacatgtacaaaccgggaaccatgatcacgatggacggcacggtcaggcagatgcgcgggtagccgagatgcggggcgagccagctgcgatgaaccgcagaacgccatgcggaggcaagcaggcctgcgagcagtgcgccgatgaatgcgccggcttcggcgggaacgcccatgtcaacgatttccaaacgcaaggtgtcagtaatggcgccaatggtggcggcgacaaggcacatgcgctgcggcgagttgaacatggtggagaagccccagacgccgatgaatgcgaacacgaaacgcaacaggcaattgacaaccggattgagtcccaacggctcgaatccttccggattcaaatgcacgatcgaagcgaccatccagcctgcgagcgtcgccatcaaaataatgcacaacacgtacgcaacgcgctgaatacctgacggaaaatcaattttcgccatatcaagtccacccgtaatcagcgggaatccaggaatcacaaacagcatggcaccgatgtaagccgtatcatgctgcaatgcgacgggctcgaaaataccaatcaatcgcagggtgcccgtgcaggcgagtgccgcgacggccacgcatacgaacgtcacgaagaactggttgaggtggtgggcgaacaggcggcggcgcagccagtggccaagtcccgcgccgatgaacgcgccgatcatgtcgaagggaccgccaccaagcaggaacacgaaggatgcgcaggcgcaggccgaggcgaatcccgcgaacgccggcgaatacaggggtttgcgtcgttcgatcatgtcgagtcgttcgtgggcttggcgaacggtgatgccttgcgattggtccgcttcttttccgacgtggtcgaaatgttcggcgtattgaccttttggcggcttgtgattgcgatttttgcgcgcttttttcgtggtcgattcgcttgacgtaacgttggccgtaccggcagtttcacgcttggtttcacgttcggcttcacgttcaccgcgattatgctgctcgcttgccgcttcgatatcacgcaagtgcaacggctgcgcggtggtatcggtcacttcggcgcgttccgtcaccatttcaagcgcgtcgagcacgggatcgtcagatccctcctgattctgttcggctttctgacgttcgcgaagacgcttcgacaggtcagccgacacctgcgacgcatcacgcttgtcgagatgctgcataagtccttcggacacgtcggattggctgtggtacatcgatcctttgccgaggttcacgttgaaccagtcagcgaagtgttcgagcagccaaatgcgttccgtgttgacgccggtggttggcaggtcgacgacttcggtgatacggtctttgccgtcggtgcaggaggcttcgatgtcggtgaggttcacgtcggcgcgcacgtgcacgcccagcggataggcgatgcggtgcatcatttcgcgtacgcggaagcttccggtgcccgcgccgagatcgagcatgccgacgcgtacgatcacgctggcttttgctgcgattcccgcttcagcgaccggcttgtcccaatcccgttcgatatcttccatatcgagcggaatggagtgtgtatggaatttgctgacggccgaagcgcttttttccgcgctatcgaaattcgtctcatgttcatgttcgtattgtgcgctcacaagttcaggtctaacgtgtgggctggtcggaggattttcgaaatttccgtcgatttcaccttgtggacaccactggaccacgatgcggacattttcggtatttccgtaaccaaactgtcgatttgccgcgcatacaatggtcgtgcattaccgaccgaacttagggctgtgggctcgcaacagacggccaaaacaatcgcggaggtgccgcgaaggaccgacagaccgggcaacccgatggtttggagaaggaggtctgatgacaatagaaaacgaacagatcacgcctgccgacgcagctatcgtctcgtccggcaccggcaccaaaggccccgaggagcgtgatcttcccgcttccctcaaagaggaaatggatctgtgtttgcagattcttcgcgaggtgctcggcgaattcgatgaaaagctgctggccaagttcgatgaagtgcgcgaacacgcactgaacgctagcgccgaacgcttctccggtattctgacggatacgaatccgaatcaggatgacctgcagaaggtcgtcgacatcatcgataaaacggatgtgcatgaggcacaactgctggcccgcgccttcaccacctacttccatctggccaacctatgcgaggagaactaccgtgtctccgtgctgcacagccgtgaggccgccgtagatgacacccaagccgtcgacccagtgaacgaaatgacctgcgcctaccaccagctcattaacgaaatgggtccggccaaagccaaggaactgctcgaccagctcgagttccatccggtgttcaccgcgcatccgactgaagcccgccgcaaagccgtggaaggcaaaatccgtcgcatctcccagctgctcgcaacgcacaagctgcttggcggttcagacaagaaggaaaactcccgtcgactcttcaacgagattgacgcgctgttccgcacctctccgatcgcactgaagaagccgactccggttgaggaatctgaaaccattctcgatattttcgacaatacgttgttctataccattccacaggtgtaccgtcgtttcgacgattggatcctcggagataaggctggcctcgtgccgccggtatgcccggcgttcttccacccgggaagctggatcggctccgaccgtgacggcaacccgaatgtcaccgccaaggtgagccgtcaggtggcccgcaagttcagcgaccacgtgctgggcgcgttgcaaatcgagacccgccgcgttggcaagaacctgacgatggaagctgagaccactccgccgagtgccgagctcaagagcctgtggaaccatcagaaggaaatgagcgagcgcctgaccgacaaggccgcactgatctccaccaaggagctgcaccgtgccgtcatgctggtcatggccgatcgtctgaaggccaccatcgaccgcgatgctgatctcatgtaccactcctgcgaggattacatcgccgacctgaaggtcgtgcagcgctccctcgccgaagccaacgccaaacgttccgcctacggcccgctgcaggacctcatctggcaggcagagacctttggcttccatatggtcgagatggagttccgccagcactccgtcgtgcattcccgagcgctggaagatatccgcgaacatggtctgcacggtgagcgtggcgaactgcagccgatgacccacgaggtgctcgacaccttccgcgcccttggttccatccagaagcgcaacggcatcaaggccgcccgtcgttacatcatctccttcaccaagagcgcccaaaacatcagggacgtgtacgagctgaaccgtctggcgttctcccatcccaaggatgttccaaccatcgacgtgatcccgctgttcgaacagcttgaggatctgcagaactcggtagacgtactcgaggaaatgatcaagattccggaggttcaggctcgtctgaaggccaccggcggcaagatggaagtcatgctcggctactccgactcctcgaaggacgctggcccgacctccgcaaccctggccctgcattccgcacaggaacgcatcgccaagtgggcggaatcgcatgacatcgatctgaccctgttccatggccgcggtggtgccgtcggccgcggcggcggcccggctaaccgtgccgtactcgcacagccggtcggctccgtaaagtgccgcttcaagctcactgagcagggcgaggtcatcttcgcacgctacggcaacccggcactggccatccgccacgtcgagtccgttgcggctgcaacgctgctgcagtccgctccaagcgtggagaagcgcaatacggacatgaccgccaagtacgccgacatggccaacaagctcgaggaggccgcgcataaccgcttcctcgacctgctgaacaccgacggcttcgcaccgtggttctccaccgtcacgccgctgaccgaaatcggcctgctgccgatcggctcccgtccggccaaacgtggccttggagccaagtccctcgacgatctgcgtaccattccgtggatcttctcctgggcgcaggcacgcatcaatctggccgcatggtacggcctgggcaccgcgtgcgaacagttcggcgatttgaacaccttgcgtcaagcgtatgaggaatggcctctgttctccacgttcatcgacaacatcgaaatgtcgctggccaagactgacgagcgcatcgccaagatgtacctcgccctcggcgaccgtgaggacctcaacaagaaggtcctcgacgagatggagctcacccgcaagtgggtgctcgagatcgtaggcgacaagtggcctctgcagcaccgccacgtgctcggccaggccatccgcatccgctcgccgtacgtggatgcgctgtccgccacccaggtgctcgccctcggctcgctacgcaagcgcgtggacaaggaagagctcacgcacggacagaaggagaactacacctacctgatcctgtgcaccgtgtccggtgtcgcagcaggcctgcagaacaccggctgatcttcggctgaccgcctgacaaacgcgagcggggaggttccgtgccgataaacggcgcgggcctccccgttcacgtcgcgcggccctagcctggccggcgacagcgcacaaaacaggcacgcaggccgagcgacagactcccaatcatccgacgtaacccggcgcctgtccgcgtttacccacgccgcgacaccgacagccatcgtgggcttatacaactggttcggtcagacttatattctcggcagattgagcctagtcacatttctctatttcttcctcgtcctgcttataaccccaatgacaacccttttggttacggctttccttcatgacaaactgtcttggaagaagattgttcgcatcatagcgctgtcttactgtttgaccatattgggtgtatttctgaacgagttgtgttgttgacggaagacgccgcactcgaaggtttttgttcagcgcctaacatgcagcactagcatacttatcctcaatccactcatgattcagtaacaactgcatgactcctgaaacacagacacatagcgaagccctcgtttgtaacttccacgagagagaacctttgctattttcactagaaaatcacaccctagagtgcacccctactcattttccattagaatactcttaatatcttaatcattgtcgattgagattaaattttcacatggaggaaattatgaaatccagaagagtttttttattctccacaattatctcagtttgcctatgcacagttatgaccactccagcctttgctgtaaattggtggcaggttggatggattgtcgccaataacgtcatcgaccgggtagtcaatctcgatgggcaaagttcaaatgatcaatattccacctatatggtttcaccttccattgttttcaacaatggcaccaatgggggcgaattctatatgcgccctcaagtctccagccgtgtgaccagtttcgaaatgcacgcgcatagagctaaccccgtcgattttggagccaatatagttctagccttgtccacaacctcaggcaaaagggttatcaataaaacagtagggacaaaccagtatgtctcatacaccagatcaagcagcgatggcaccggaacatgggacgctcgtttcaccgaagatgacagcgggaaaaattggcagtgttattaccgccaatattacggcaatggaagaagtcttccaacgatcatcgacgtcccaaataccgatctaatcgactacctggctaacgatggcaccacgttccgatacaacgccaacccagatcaaccaagaacaacaaaagccccaacccttgacatcaaacaacttaacaatcaattttatgacgaaaaaagtggtatatcagtcgattatcttcgcgactacaatacaggagatgatattatttttgaagatatcatagataaaattcaattcaatcccaatgaaaacaatacatcactcttctttttattagacaacgaatatattgaatggaaatttaatggaaatatcaccaacaagtacaagaaagaagacagaattaaccttcattttaaagtaattaccgtgaagcaatataaagggattacatttgagagtatcgatttcttcaaagattcaagcaacggaataaataaacaaggaccatacccttgcatctccgactacctaaaataaggagaacagtgcagtacatatatctcacagcacttgccctgctaggattatgtatgcttatttttccaaggcaactctggaaaataagcaatttcctctggactcaaaaaggagatccgagcaatctatacacatccttaatgagaataagcggtgccgcctttcttgttttagctcttattcttttcatcttctgcagactgcagtaacacctacccgatcctgtgcaccgtgtccggtgtcgcagcaggcctgcagaacaccggctgattgtagccagtttctttacagggtccccgttcgcactgccgatcggggaccctttttcatacccatatctgccttatatatggcagaatcggagccttgtcatgagccttctcgcttatatatggcagaccatcatgcgaaaaacccacttcgggggtacatttttccggtttttcaccttcgggactgccatacataagcgagatatcgctctatttcccagcgaacggtcagaccaaaacgtatgatgttggctagcctgaacaatgaggggtggagtcaatggcagacgaactgtttgtagaccagaacgaggtcgaaggtacggcaagcggcgcatggagccgcatgctggcaggcaatcgcaggtttgcggaaggcaaaccggaacatccgaatcgtggcgccgaagcacgcgcagcacttgtagacacacacgcaccggaagcggccgtactgagctgctccgacgcgcgggtaagcccggatattattttcgattccggtcttggcgacctgttcacggttcgcacggccggtcaaatcatcgacgaagccgtgcttgcatccctggaatacgcggtgaccgtgctcggcgtacgtttgctggtggtgctcggccaccagaattgcggtgcgatcaagcaagcttccaaggattacgaggcgttactgcacaaactgaccgccgatgccgaggattcgctgatggccgccgacagcattgccgacatcgacgaacgcatctgcgcttcggattcgctcatgatgcgcaccgtcggtttctcaatctggcaggcgcacgagtcggaattggaatccagcgaggatttcgaacgcgtgcacatcgcgcgcaccatcgaactcttggtggaacaatccgaagcgatccagcaggcgctggcatccgacaaactcatgatcgtcggcgcaaggtaccagctggactccggcaaagtcgaggttcttagcttctgaaacggattacaattcggaaaacggagatttgcaaaacagagatccaaaaaagaacaatccgaagctaagcaatctaagaataattgagaaaatccaagaaaatcaggagatacagacactttgacataccgccccgatagagtggaaccatgtctctaggtttgaacattctcctgattttcgtttttctgttgctcggatcggtgttcgccggcaccgaactggcgttggtcagcctgcgtggatcgcagatcgaccagatggaacaggaggatgcccgcggaaagcgcgtcgcacagatcgcgcgagatccgaacacgtttttgtcgaccgtgcagatcggcgtgacgttgagcggtttcctttccgcatcgttcggcgaatcgtcgatttcgccttatattgtgccgatcgttgaaagttggggcgtgccgacgagtgtggccgctcccctgaccaccattgtgctgacgttgatcatttcgtactgttcgatcgtgatttcggagttggtgccgaagcgtatcgccatgcaacgcaacgagcagatcgcgcgtgccgtggtacctgcgattcatgtgtttgcgaaggtgtgcaagccgattatttggctgatcggcaagaacacgaacattatcgtgcgcttgcttggtttcgacccgaacgaaaccgacagcgaagtgtccgacgaagagctgcgcgtactcgtcaacaccaatacgaacttgagcaaggacgaacgcacgattctcgacgacgtgttcgacgcgtccgaaacgattgtggccgaagtgatgcgcccgcgtgccgacgtggtttttttggatggcgatatgccgattgagaaggcggccgcatatgtgagagaaatgccgtattcccgctatccggtgaccggcaaggatttcgacgatgtgcttggtttcgtgcatgtgcgcgatctgctcgatattcgcgatcccgaggcgaagacggttgccgacgtgacgcgcgagggcatttccctgccgggcacgtcgaagctgctgccaagccttgagctgctgcgcaaacgaggcattcacctggccgtggtgatcgacgaatacggcggcaccgacggcatcgtcacgttggaagacatgaccgaggaattggtcggcgacatccgcgacgaatatgatctgccggaagagaaaggcggcgaacgcacggaacgtaccacgttcgtcaatggcgtcgccacgatcgaaggcggcatgacgattgaggatttcgccgatttgaccggtattgagctggaagacggtccgtacgagacggttgccggctatttcctggcgcatactggaaagatgggcgaaatcggcgacgtgctaccttccgacgacggttatgacatgaccgtcacgcaagtggatggccgtcgtatcgaaacgttggaaatccgcaagcatactgttgacggcgatgctgcgaaagctacgaaataatcaaaaataaaacgaaaataaaatgaaaataaaacagacttgcgattatgtaaatgctgattttttatgcaatcaacatcagtaatcgcaagtctgctctgttattaaatccgctgagttattgcagattcagccgcgcagcatgggatggcattcgtcgttccaccatgcaagctgcgcgatattggcgcggatatgctcgcaggacgcatggaatttggcccgttcgctttcggtgagtgtgggattgaggacttcttcaacgccgttcgcaccgatgatgcacggcaggctggcgtaattgccgctttcgccttgttcgccggtaagcagcgtggagcaggcggtcgcatagtgttcatcgcagagcacagcctgcgtaaggcgtgccgcagtggctgcaatagcgtattccgtgcactctttgccggcgtacacgcggtatccgcctcgacgggcgtcctgctcggtttcgtccttgtcgagggcgaatcgttgcggatcgtcttgtgcgagttgatcaagcggcttgcctgcgatgttcacgttcgaccaataggcgaactgcgaattgccatgctcccccagcatatatgcgccgattgatttctgatccacgttgacgcgtttcgcgatggcgttgcgcagtcgtgcggaatccaacgcggttcccgttccgatgattttgcgcggatcgtagccggtgatgtgccagatttcggttgcgaccacatcgcaaggatttgagatggtgatgatcacaccgtggaagcctgcgttgaacagtcgggagatccaggtgcgtgcaatgtcggtggtgacgaacagttcgccgtcacgatctttggcgctggttttcacgtcgccggcagcgttgattaccacgtcgcagtcggctagctgctcgtattgcgtgccgtagttgccgatcacgcagttatgcggatagaaacccaacgtgtcacttaaatcctgacattcgctgactactttttgctcgttgatgtcgcacagcttcagttcttcggcaagtcctgcggaaagcacggcatttgcgacatgcgcgcccacgtgtccgatgccgataatgccgacttttctcaatacagccacaatcgacccctccctcacttattcgatctttctgcgtggactgtttgcacgcaaacgtttcagtcgtcacgattgtaggcttgcaaatcgcggatgttaagcgttctgtacatcttatgaacaaaaagctatacgaatcacctatacgtcgttatcaaacgtgcgtaagccgtggctagtcattgcaatccgcgcaatgtgacggcagtggcgtgatatcgcaagtatttcaacatcacaggcaacgcaacaacatcgccctacgcaagctcatcgcagcatggcagcgtgacggcgaacgcaacagcatcgcgagcatcacaacacaacatgacggttcagctcccgccgcaattgcctccattgcggcaaatatgcgctcatacgccgctgaaagtcctctccgtgcccgttttcccacaggtgcgtcatttcgtgcacaagcacgtattccaggaatctgggatccataagaccaagttgcaggttgagtcggatgcggccggttttcggcgtgcatgacccccatcgcgacgtcatgatgcgtaacgtgacatgcgtcggcttccgcccgataatcggcgaccatttcgcaagcagcaccggcagttgcgcattgatggcccgtacggcccgttccttcgccgcgtcgttccacacgaaaacgcgcggattattcaagctattgggatcgcctggattgtttcgatcgcccacgccgcccgaattttccaggccattcagattatccggaccatgcgaaccattcacacggtccaaaccattgaaatcgctttgacggatctgttcatccttggcttgcagcatggtgcgtcgcgcacgttcgatccatggtttgcgttccgtcacaaatcgtgcgattgccgcttgcgacatgcgagaaggtgcggagatgacgatttgcgcgttcggcggtttgatgcgcaggtacatgtttttgatggctttacgcacgatggtcaccgtcattccagcgatttgcgtggtttcttcggatagcgtgcgattacggttgcgcactcccctgctggctctcccactgttgttacgctggctacgatgattgttcggcatggctgcattatgtcacgacacgccgaagacacaccttgtattgactttctctgaaattcgcgtattatttcaattcgttgtgcttaacagtgcagcaggaacgggcccgtagctcaggtggttagagcgcatccctgataaggatgaggtcggaggttcaagtcctcccgggcccacggtgattaagagcggcgcggccgctttttttcaactatggggctatagcgcagctggtagcgcatctgctttgcaagcagagggtcgccggttcgaacccggctagctccacggggctatggcgcagctggtagcgcatctccatggcatggagagggtcaggggttcgaatccccttagctccacagatagggtttccggtgatttccggaaacccttttttcatacccaaatccgaaatccaaaccagcatcccaattcctccagtcactggagaaaaccggacgcagccaggcacctcacagtccaaaaacctccaccgagtggaggaatcctcccaccaacaagcctcccagcatcccaaaacctccagtcactggaaaaaactagacgcaaccaagcacctcacagtccagatccctccagtcactggaacatatgacccgctgaggcaccttccagagtccgtattattccagcgcatggaagaatcaccccgctgaaagaccattgcaaaaggccgtctcagacgggacttgcgtcaccgcttgaaacggccttggattattgattattacgatcgcttgcgatgactaccgcactgcgactgcaccggcaacagtgtcggaatcgttcggcacgttctgtgtattccgtgcattctgcttggcaagttcgtcgcggatttgctgcaacagcaggatcgtctgctcttcggtggagatttccggctctttggcagcttcctcctcggctttgctccgttcttccgcaagcttggttttggcgagcaacgcctcggtcacgtcacggaatttgttgatcggcacgagaatgcagaaatacacggcagccgcgataatcaggaaattcaatatcgcgccaagtaccgcgccgaacgaaaccgtcgcattattgaatgtgattgccagcagaccatccatattcggtttgccgaaaatcatggcgatgaacggattaatcacattgttggcaatagagttaaccactgtggtgacggcaccgcccatgacgacaccgaccgccatgtcgatcatgttgccgcgtgcaatgaatttcttaaatccttcaatcatgatgattctcccattatgtgagatcgtgagatgttattgcggacgtactctctcccacgctttccgcatttccatcctataggcaacacaaggcacggcaatcccgtaaaaagaagcaggttcagaaccagcactcgcaaaaagcgtctccaaatcctgaacaaggtcttgtgccgtccatattcgtgcacatagaatgagaccgtctattggtaacccaactatcccgaaggggaagaatatgctcactgacgagtacgtcaagcgcgtgtacgcgcaggtcgagaagcgcgacggcgaccagccggagttcctgcaggccgttcgcgaggttttcgaaagcctcgagccggtggttgcgaagcatccggaatatgagaaggcgggcgtgcttgagcgcatcgtcgagccggagcgcgtggtgaagttccgcgtcgcatggaccgacgatgagggcaaggtgcaggtcaaccgcggttaccgcatccagttcaactccgcgatcggcccgtacaagggcggtctgcgcttccacccgagcgtgaacgaaggcgtcatcaagttcctcggcttcgagcagatcctgaagaactccctgaccagcctgccgatgggcggcggcaagggcggatccgacttcgacccgaagggcaagtccgacgccgaagtcatgcgtttctgccaggccttcatgacggaactgtgccgtcacatcggccagttcaccgacgtcccggccggtgatatcaacgtgggcggccgcgagatcggctacctgttcggccagtacaagcgcatccgcgacgagtattccggcgtgctgaccggcaagggcctcgaattcggcggctccctggctcgtaccgaagccaccggttacggcctgtgctactacaccgccgaggcaatgcgcgtgctgcgcaacgattccttcgaaggcaagaccgtggtcatctccggctccggcaacgtggccatcttcgccaccgagaaggctcaggccctcggcgcgaaggttgtgaccgcctccgattccaacggctacatctacgatccgaacggcattcagctcgacgtggtcaaggacatcaagctgggccaccgcggccgcatcaaggaatacgccgagcgtgtgccgggctccgaatatcacgagggatgcaagggcgtgtggaccgttccgtgcgatatcgccctgccgtgcgccacccagaacgagatcgacgaggaatccgccaaggctctcgtcgccaacggctgcaccgtggtgtgcgaaggcgccaacatgccttccactccggaggcaatcgccgtctaccaggccaacaacgtgctctatggccccgccaaggccgcgaacgcgggtggcgtggcggtttccggccttgagatgagccagaactcctaccgcctttcctggacttttgaagaggttgacggcaagctcaagtccatcatggagaacatcgtcgccaactctctggaagccgccaaggaatacggccacgagggtgatctgatgctcggcgccaacgctgccggcttcgtgaaggtcgccaacgccatggtcgcccagggcgtgctctgatctagccgttttagccaatctagccaatacggctggctcatcgaaatacattgagggcctgtctggtttcattccagacaggccctcttttcgtatttcaacacgtacttcagcgcacccaatctaggtgcagttacatttgaaacaatcactcaaaatcacgatagttccggttataactgaaactatctctaaaaatcgcaatagtttcagctataaccgcaacttcctctcgcgcagctccgctatctcgcttatatatggcagatttgagagttcgtacggtgatatctcgcttatatatggcagccttggtaggaaaaatgacccaaaatatacccccgaactggctttttcgcaagttgacctgccatatataagcgagatggtacaggtcggaaggcaaaatctgccatatatagggcagatatgggcagattgcaggcaggggagagtcagatagggtttggcgtacggtaagagacagactggtctagaaaatacgaagacggtctgtgtcgtgatgggaatcacgacacagaccgtcttgttgcgtttgagtttgctatcgccgctactgacggcgcactgcgctatttcagcattgcatgcgacgctcgcggacgctatcgccgctcgctgccattaatagcgcactgcgctattaatcatctccaagcgtgacgtggatgccaccgacgagggtgctcaccacgttgtacagcagcgtgaaaatcaccacgagcacggtgatcagcaccacttccacaatggagaagatggtgacggcgctcagcacagtgcccaacgagaacacgttggtcaggtcgaatccgccagcgtccaagccagtggaagacacaatctgcgtaacttggtcgaacacgccgaccacgttcagcatgccccacagcaaagccaccgcgacaatctgaatgatgcctcccgcgatggaaagcatgaacgccaccttggcggccgaccatgcatcgatacgcgtcagagacaggctcatacggcgtgcacgcggagcgccgccgcgacgcttctcacggaccttcacaccgccggaagcggaggaggcaccctcgtgcgcctgaacctgatccgcaccaatcagcggctggctggaagcggaacgtgccacgcgcggtgcctgcccaacctccggcatttgctgtccttcgatgttctcgctcatcgttgctccttgcaagattgtgcccagttcttagctgaggctaccagttttcgcagacgattgcctgtcttgtcttcatgcctctacattctcgccatcgccgttgccagcgttggcttcagtagcggcttcagacgatgccgaagcaccctcgttcacggttgcgttcgtcccagattccgcggattccgttttttccgcagattcgccagattccgcggattcgtcatccttctcctcgttgcgtgcgatggagatgatctcgtcgttcttgtccggcttggcgaacgtcacaccttgggtggtgcggccggtgcgcttgacctcgtcgacgttggaacggatgaccttgccggacttcatgatggccatgatctggtcatcttcctcaacgatcaccgcgcccacgagggagccacggccttcggcgagctgcacggccttgacgccaaagccgttacggccttgcaaacggtattcgctgatggcggtgcgcttggcgaagccctcgttggtaaccacgaacagatccttgtcggaatcgccccagaccacgtccatggccagcagctcgtcgccttcgcggaacttcatgccctgcacgcctgcggtctgacggcccatcgggcgcagctgctcgtcgttggcctggaacttcaggctcatgcccagcttcgacacaagaatgatgtcatcctcggcgttgcacagtgcggcaccgatcagctcgtcggcgttctcgccgttctcgccggtcataaggcgcactgcgatcaggccgccctgacgcggggaatcgtattcggcgagcgcggtcttcttgaccttgccggaacgggtggcgagcaccagatacttggccacttcgtagttcggaatcgacagcacggtctggatcgtctcgtccggcccgaactgcagcaggttggccacatgctgtcccttggaatcgcgcgatccctccggcagctcgtacgccttcaggcggtacacgcgtcccttgttggtgaagaacagcagccagttgtgcgtgctggtgaggaagaagtggtccaccacgtcgtcctcgcgcagcttggcgcccttgatgcccttgccgccgcgatgctgcgcacggtattcgtcggccttggtgcgcttgatgaaaccggagtgtgtaacggttacgaccacgttttcttccgcgatcagatcttcgacgttcatttcgccggagtacggcaggatcttggttcgacgttcgtcgccatacttggacacgatttcgtcaagctcgtcgcccacgatcttacgttgacgctccggcttggcgagaatgtcgttgtagtcggcgatacgacgcatcagctcgttatgttcgtcgagaatcttctggcgttccaatgcggccagtcggcgcagctgcatggccagaatggcgtcggcctgcacttcgtccacgtccagcaggtccataaggcccgtacgcgcgacttccgcagattcggacgcacgaataagcgcgatgacctcgtcgatcatgtcaagagccttcaggtagccctgcagaatgtggtcgcgctcttccgcctcacgcttgaggtaggcggtacggcgtgcgatgacttccagctggtggcccacccaatggcggatgaacgcgtccagagacagcgtacgtggcactccatcgaccagtgccagcatgttggcaccgaaggtctgctgcagctgggaatgcttgtacaggttgttgagcacaaccttcggcacggcgtcgcgcttgagcacgagcacgagacgctgtccggtacggccggaggtttcgtcacgcatgtcggcgatgccctggatcttgccgtcacgcaccgcttcgcggatggaaacgaccagtcggtccgggttcacctgatacggcagttcggtgatcacgaggcacatacggcccttgatctcttcggtgttcacaaccgcgcgcatggtgatcaaaccacggccggtacggtaggcctgttcaatgcccttatgtccgagaatcgttgcaccagtagggaagtccggtcccttgatgatgcggatcaggttttcgagcagctcttcgcggcttgcgtccgggtggtcaagcgcccaatgcacgccttcggccacttcacgcatgttgtgcggaggaatgttggtggccatacccacggcgatgccagacgaaccattgcacaacaggttcgggaatcgtgccggaagcacggtcggctcctgcgtcttgccatcgtagttcggcaggaaatcgacggtgtctttgtcgatgtcgcgcaccatttccatggcgagcggagccatacggcattcggtgtaacgcattgctgcggccggatcgtcaccgggggagccgaagttgccttggccgtcgaccagcgtgtaacgcatcgaccacgactgtgccatacgcaccaacgtgtcgtagatcgcggaatcgctgtgcggatggtatttacccatgacctcgccgaccacgcgggcgcacttggagtaaccacggtcggggcggtagccgccgtcgtacatcgcgtagatcacacggcgatgcaccggcttcatgccgtcgcgtacgtccgggagcgcacggtccacgatcacggacatggcgtatgccaggtaggaatcgcgcatttcctgctgcagatccttcttctggatgcgttcgcccaccatcaggccgtaatcggtgtcgtcggcctcctgcgggctcaacggctccatggagccatcaggcacgaactggccgtcttcgttgctgttgttttcgtctgccaacttctaagtccttctaaatccttatgaaaccttgcctgaagtccttgaaatccctacgcgtcgatccagctgacgttgcgtgcgttgcgctggatgaacagacggcgaggttcgacttcgtcgcccatgagcatggagaaggtttcgtcggctgcagccgcgtcttcgatttgcacctgcttcagaatgcggtggtcaggatccatggtggtttcccacagttcctggtagctcatttcacccagacccttgtaacgctggatgccttcgcccttcggcaactgacggccggcggccttgccttcggcgagcacgcggtcgcgttcggcgtcggtgtacacgaagtcgtgcgcgcctttggtccacttgagtcggtacagcggcggcatggccacatacacgtaaccagcggtaatcatcgggcgcatgtagcggaagaacagcgtcagattcagggttgcgatatgcgcgccgtccacatcagcatcggccatgatgatgaccttgtgatagcggactttgttcaggtcgaaatcctcgccgtaaccgccaccgaccgcggtgatcagcgattcgatggtttcggacttcatcatgcggtcaaggcttgcacgctcggtgttgaggattttgcctcgcagcggcagaatggcctgcgtgatcgggttgcgtccctgaattgcggagccgcctgcggagtcaccctccacgatgaacagttcgcattcttcaggattgttggactggcaatccttcagtttgtctggcatgcccgcggattcgaagattgacttgcggcgggtattctcacgtgccttcttggctgcaagacgcgcacgggaggcttcaatggccttctggatgatgttcttggcttcgctaggatgcgaatcgaaccagtcgccgagcttgtcggtcatcacgcgctgcacgaaggttttcgcttcggaattgccgagcttggtcttggtctggccttcgaactgcggggtggtgagcttcaccgacaccactgcggtcaggccttcgcgcacgtcgtcgccggagaggttctcatccttgtctttgaggatgttcttctcacgtgcgtaacgattgacgagcgaagtcagagccgcacggaagccttcttcgtgggtgccgccttcggtggtggagatggtgttggcgaaggtgtgcaccgcttcggagtatgcggtggtccactgcatggcgatttccgcggaaatgccgattttcagatcttccgcttcgaaatcgatcacgtccggttcgaccggggttgccttgcgggacttcaccaagtaatcgacataatccttgatgccgtcgttgtattggtaggtgaccgtctgatgcttcggttcggcattgtcgtcgctttcgcccgcgacttcgtctccggcctgatccggttcgcgcaaatcggtcagggacagtttcagccccttgttgaggaatgccatctgctggaagcggttacgcagaatctcgaaatcgtaggtggtggtttcgaagatcgcgccgtctgcccagaaggtcacggaagtgccggtggactcgtcttcgcccatcggctcgcccttggcaagacgtgcggtcggcttctggtcgatgtaggtctgggtccagtggaagccctgtcggcgcacttcgatgtcgacgcgggtcgacagcgcgttcaccacggagatgcccacgccgtgcagaccgccggaaaccgcatagccgccgccaccgaacttgccgccggcatgcagcttggtcatcacggtttccacaccggaaacgccttcgcccggcacttcgtcgaccggaatgcctcggccatcatcgaccacgcgcacgccgccgtccggcagaatcgtcacttcgatatgcgaggcatagcccgccagcgcttcgtcgacggagttgtcgacgatctcatacaccaggtggtgcaggccacgggggccggtggagccgatgtacatgcccgggcggattcgcaccgcctcaaggccttccagaaccctcagatcggacgcgtcgtaatgctccggagccaaggtgtcgtcgagctgcgcatcttcgagctgatcgttttggatctgatcttcctgcgtgttttcagctgattcgttcagcgaatccgcatcaaggtctgccacagagattccttcctgcatttttcccgccaatgagggtcattcacgcaggtgataccacctagaacgcaaataaaggccccttctaggcgtttacatacactacttgatattctactcatgcagggggacagcgcaccagaggcatttatccttgaaattcagccgtttacccctgttttttcgctttcggaaaacaacattcgaccgttgcgaacggcccgcttggaagcgtcgcagggggaattcttcgacgaagcgccttcaacgaacgtctgatagcacgtggtgtcgcgctaatatcgcggccttcgtgtcattcgtcctcggctgaatccctgttgttgcgggccggtgacgcgcacctcgttgatggtcagcccctcgagcctacggcgaatggtgtcggtcagcagcggaatcatgtacgtcaaggtggtggtccatgcggggctgtcgcatcggatcgtcagaatgccgtcgcgcaggtcgacggggtaggagtggcgcgcgttttcgacgccgaccacctgatcccaatgattctgcatctgcgcgattttcagatgcggcgtccaagaaccttgcgttgcgatcacgttgaaaatattgccgaccgtctgcgggtcgcgtccgggtttgccgaaattctcccacgcctgccgcgcacgttcctcacgttccttatatcggccggcacgtcggctgatacgttcgaatacttcggcgggcaacttgcgttggtcgagatgcaatgtttcgcagattggaggattcggcatcagcgctgctcctgtcgattcaccgactgttgcgctgcagacgattgcgttgcagattcccgtcccgcgacaagttgcgccatcatcgccgtcaaatcgtcatgctgtccatcttgcgattgcctgcgcaacgcggccacgtcgatcacatgcgcgtccgcgtgaaagcgcccagcatccatgcgcggaatatcgcttgccgcggcgacggtgatcagcacctggtcctgccgcatcgcaaaatcgaggatctgcccacgacgggcctcgtcaagctgtgcgaacacatcatcgagaatcacgattggcttgctttcaaaatgtgcggaaaccgcctcatatagcgccattttcaacgccaaagccatggtccacatctcaccgttggacgcgaattcgcgtgcgttcatatcgttgagcagcaaagtcaggtcgtcgcgatgcggaccgatcagattctgcccgcgcgccacttcgccggggtagatgcgttggaaatggcggctgatctccgcggccggatcgtcgaacagcatcacttcgtcgaaggacggctcgtaggcgagcgccgcccgttcgtcatctcccgccaaagacgcgtagatccgcgcaaaaggctcttccaagcgtgagatcacgttgttgcggtcccgcgtcagctgcatgccgaggtcgatgaattgccccgtccagatttccagcccgcttaagaccgcctgctggccgtattgcgggtcgagattcgtgccgtcgccgagttgtttgagcagtgccgtgcgctgtttcgccacgtgcgtgaactgttgcagggtctgcgcatagtgggggagcagcagagacgcggcctggttgatgaagttgcgtcgggttgcgggatcccctgctaccagacgttgatcttcgggggtaaaggagacggagggcgtgcgcccgatgagatccctcatatattgagattttccgccgtcgatgcgcgctcggttagcaccccgtgccacgatggtcgcctcgtaggtgtgctgcgtttcactgtcttccacgttggctcggatggtggccgacgtgcaccctttttcgattaatggcagtgatgatgacgcgcgatggctggatcctgtggaaagcacttcgatggcttccacgatattggttttgccgagtccgttggcaccttgcagaatgttgattcccggtttgaaatcgagcacgcaatgttcccacgatcgatagtggtcgagtgccagtcgggaaatatacatgcaagatccttgagatagtgcgaatttcttacgtaaataatcgcaattaatcatgcaaatgggctgaactggcaataacagccatgttcagccctattttttgcgatgtatccgcgttttcgtgtaggtcagcttagttcagctgttgaagcgcatcggcacgagcaggtagcggtagtccatggattcttcggaattcgattcctgctggccgttgaattccaccggcttgaccgcggtggtcatcttcatgcgtacgaacggctcgctgatggcgctcagaccttcgatcaggtaggcgggattgaaggccacggtgatgtcttcgccatccatgtcgatgtcgaggatctccttggcttgggcttcatccaccgagcctgcggtcagcgtgagttcctggctggtgaaggccatgcggatcggagcgttgcgttcggccacgagggacacgcgcttgatggcgctgatgagatcctgcttgttgatgaccgcatgaatcgggtattcgtcagcgtacaggcggtccaccgcggggaattcgccgtcgatcagctgcgaggtggatacgcgtccggcgttctcaaagcccagcagcgacggattctccggatcgaaatccacgacgatgttttgatgctcgtccaaggaacgggccacatcgcgcaacagtgcgccgcgcacgagtgcggtggtgttgatgtccgggttttccggcgtccaggtgaagctcgaacgcgacaagcggaatcggtcggtggagctcatgatcaccttgttgccttggaactgcacacgaatgccggtcagtaccggacggttctcctcgcgggaaacggcgacggacgcctgggcaacggcctgtgcgaaggtttgggcgtccacctgccccagtttggcgggaaccaccggcagatccggatattcgttatccggcatgagctgcatggtgaaggtggacttgcccgacgtgatggtcagtgtggatccgtcagtggataggtaggttttcgcggcgggaagcgacttggtgatatctgccagcagcttgccgagcaccagaatggatccgctttcatcaacgcctgcttcgatatggtggcgtgcggaaatggcgtaattgaaggcggaaagctggagggtgccgtcgatggcctccaagcgaatgcctgccaaaatgggggatgcaggacgagcgtcgatcacgcgagtggtccaggctactgcgtctgccagcgcttgggaattgacttcaactttcatggctagtttcctcgtttcgttcggtccataagtcattctagcgagactgtcggcgtttgacgaagcgtggggaattccccacttatgacgacgatgatgaatttcttataacaacctacattcgtcataataaggcctgtggataatgtgggtaagtgctcagaccccacgttttgcaatggctcacaacatctcattgcttgtggataacttttggacgaagtgtggacaaatcatcgggttatccacagcctcgtcgctttgaaaaagttatccacaaaaccatgtggatagtccacaattcatccaccggcgattctggcgtttccaacgggttttccaccgagaaatcattgatttgtgtataaccatgtggataacttcaataaaaatcttccacaggccggcgtgtcaggatggtcggtaaaacagctgataaagaatttactgatactcatacttggcttgtgaaaatcgcctgagaaaggcagaaaacgcctaaaatcgtttttttgagacgcacgaaaacacatgcaaacgcgcaaagtcgcatagaaaacgttatttttcgccggaacgctgcttgagctgcagagtcagttccgtcacgtagttgtagatctcctgcttttcctgcatctcgtcgctgatgcgggtgtatgcatgcatcaccgtggtgtggtccttgccgccaaacacctggccgatgtcgttcaggctcatgctggtgagctcacgcaccaaatacatggcgatctgacgcgccagcgcgatcttcttcgtacgcgaacgtccgacaatgtcatcgaacgtaatgtagaagtacttggccacctgggtgatgatgtcggtgggcttgatctccacatcggtcgagaaaaagtcctgcaacgtctgttccgccaacgcgcgggtcaccggctggccgctcagcgatgccatggcggtcacgcggttcagcgcgccttccagctcgcgaatattctcggtgaaccgctccgcgatgaggttgagcacatcgtcctgaacgttggtgccgtgggcgatcatgcgcagaatggcgatgcgcgtctccagatccggcggcttgacgtcaacggtcaggccggattcgaaacgggagatcagacgttcgttgaatccctgcagatccttcggaggcacatcggatgcgatcacaatgcgcttgttcgcctgatgcagggtattgaatgtatggaagaactgttcaagcgtcgcgtccttgccgctcagaaattgaatatcgtcgatgagcagcacgtcgacttcgcggtagcgacggttgaattccttgatttgaccggaattctggttggtgtcacccaacgcttcgatgaattcgttggtgaattcctcactggtcacataacggactttcagcgtgggatccttgaccagtgcgtaattgccgatggcgttcagcaagtgggttttacccaatcctgatccgccgtaaatacaaagcgggttgaaatcgtgaccggaaccttccgcgacggccaacgcgacggtacgtgcgaaacgattggaatcgccaggaacgaaggtgtcgaacgtggcgttcttattcaaatgggtcttaggatccagcagaggcctgttttggccgcgttggaagttgttgcggcgctccggcggcatgacaaccggaatcggcagctgcccctgcgtggtttcctccgcatgtggcgcgggggagaagtgggggtattcctcgacggcaggttgggccggttcctttttttccacaatcttgaatgcggggaaaatatcctgttcggcggcttcccgcaaggcttccagcaggggctggttcaattcgttctgcaacgtctgctgtgcggccgcgcttggcacgcataagacaatggtaggaccccacatgccttcgggaaaaacgttttccagccagcttttatctcggatggacagcgccggattctggtgcaacaacgccagcgcgtcggaccagactccccgagcctgctcgagagggtcagttgtcgtgtcggccacggattcccctttctcgacagactttttccaagtgtgcaactgtttatttgtactctcttttccccaagttatccaccggtaagcgtgttgaaaagactgaattgtgaataacatcattgtagtttgtggataacttttgtggggagtttggcgacatatcaacgtttctgtggattgttttgtggggagaatccccatgaaaatgtgaaggatttgatatgcgtattcatctctgttcaggggtcagagtaacttggtagagcttgactcatgaggagccgtgccttggcatggcaaaaaacaccgggagcattaattatgaagaggacattccagccgaacaaccgtcgtcgtcacatgaagcacggtttccgtcagcgcatgcgcacccgcgcaggccgcgctctgatcaaccgtcgccgcgccaagggccgcaagtccctcgctgcctgatttaacggcatagagcggtggaacggctgaaaagccatcgcgatttcgtcgcggtgctcaaacgccgtcgtagggtatcgcgagaagacatcgtcgtgcattatttggtgcacgacgatgccattatcgacgattctgcggcgatgcggggccgacgtgtcggtttggccgtttccaaggctgtcggcaacgctgtgacgcgtaatgccgtcaagcgtcgtttccgcgtgcttgcacgaaagtacgaatctgccttacctgaatcctgcgatatcgtgttgcgtgccaagccaagtgctgcgcatgccgattttctatcgttggaacagcagatcgcagcatgttttgaagcggtgaatcgtaaggccgtgcgtcggtaatgaacgccggtcgtaacggaaattggatgattcgtgccattcgctggtaccaacgtcatatttccgcgaataccgcgccttgctgcagatattatccaagttgttccaattacgcgattcaggcgattgaacgatttggccgccttaagggtggccttcttgcgttattgcgccttcttcgctgcaatcagtggaaccgtgggggaattgacgacgttccgcagctttattccttgttttacagatgttcgtggtcgaagacacacgaggaacctcggctcacgcctctgaacgtagaaaaacctataggcgataaggagactggcctgtaatgaatcaaaatcaattcctcctcgacagcggtttctggggctggctgtataagctcctgtatcccgtcgagtggctcatgacgcagatcatggccgtattccataagttcctggtgatgctgggcatgaacgagatcggtttctcgtgggtcatgtccatcgtattcctagtacttgtggtccaggcatgcgtttttccgctgttctacaagtccatgaagggtatgcgcaagatgcaggcccagatgaccgtcctgcagccaaagatgcagcgtatccaaaacaaatacaagggcaagaacgatcccgccagcaaggaagccatgcagcgcgagatgatgaagctctaccaggacaatgatgcgaacccgatgggtggctgcacttccatgctccctatgttcgtgcagggtcccgtattcatgtgcatgttctatacgctgtcagccattccgtacatcgcacgcggcaaattcagggacggacagggtcttggcgctttcgacatcgccacagccaagcagttcacgtccaccacagtgttcggtgtgaacgtggctgataacttcacgaccgccgccgtgcatggcaaagtagttatcgccatcttcgttgcattgatgtgcttctgcctgtggttcatgcagtacaacagcatgaagcgtaacatggctcagtctgcggcaaacaagcagaccgaaatgatgcagaagatgatgttgtggatgttcccgatcatgtacattttctccggtattgccatgccgttcgctgtgctggtgtactggctcaccaacaacatctgcaatctgttgcgttccatctggcagatccacgtcttcccgactccgggatctccggccgccgaagcgaaggaaaagcgtgatcatgttcatgagaacgcccgccgagccaaggccggtctgccatccctcgaggaagaggcgctgcagaaggccaaggaagccgccgaagtgaaggaaaagagcggctaccagcgtcagcagccgagccgtaaaaagaaaaagaagtgagtaaaagtgtgtcccgtgtttcacgtgaaacgcgggacacaccacttttatcagcgtttattgtcgacgtggtaaacaggaattagactttacacaataagactttagtaatagaaaccccgctcaaaggagtacaaccactatggcgcaagatgaggaaaagaccatcgatcagctcaacgaggaagctgatatcgctgccgattatcttgaaggactgcttgatatcgtcgattacgaaggcgatatcgaaatgggcgtgcgcaacaatcgccctaccgtgcaaatcgtcgccgatgatgatacggacatcaagcatctcatcggacgcaacggcgaagtcgttgacgctctgcagcagctgacgcgactggccgtgcagcagaagaccggcgagcgttcccatctcattgtggacgtcgacggctatctgaagcgcaagcgccagcgtctgcacgacatcgcgctggacgccatcgacgaggtgcgcgagacgggggagccggttgatctcaagccgatgaactccttcgaacgcaagatcgtgcatgatgtggtgcgtgaggagggcatgaagtcccgttcccacggcgaggaaccgcgtcgttacgtcacggtgtatctcaaggcttccgctgccgaagatgctgaagacgaggatgaggcctgagttcggctcgtttcacgtgaaacatggcgtcaccatttggtggcgcttttttttgcgattttttgagtgacttcatgctggctgtgcgccggacatgtgatattgccgtcaatggtcggaaagtacttgctggaataccggcaatgaggaagagcaggatataggatggtgcccatgagtgatgtgacagacgaacttgatgattcgccgatgcttgaggaagtgctgggggatgcgttgggcaagcttcgtgttttccatgcgaaacttgccgaagaaggcgaacctcgcggtctgattgggccaagagatgttggcattatttgggaacgccatattctgaattcggccgccattgtgcctttcgtaaaggaagccacggccaaggagcagttcaagacggttgccgatatcggcagtggcggcggttttcccggtattgtcgcggccgcctgcctgccggatcaccggttcacgcttgtggagccgatggaacgtcgtgtcgaatggctgaacgagtgcgtggccgatatggagttgaataacgttaccgtggtgcgtgccagggccaatgagatgatcgaggccattgcgggtgctgctggcgctcaaggcggcaatcgtggcaatggcagcgccaggaacggcaaaggcggcaagaacggcaggggagtggccgttcgcggtcctgtactggatttggatggcaagcctattcaggcgaaacgtccgtttgccgtggtgacgtgccgtgccgtggctcctatgaccaaactttcggggtggacgctgccgttgcttgagcgcggtggacgtttggtcgcactgaaggggcggtccgcgcaagaggagatcgaaaaggcttccaaagagatcgccaaatgcggtggcattcgtccgcgggtggtggatgccgaggttggtccgggcttggaatcgacccatgtgctcatggtggataaaaagtaagttatccaccatttcggtgagttatgcacattgtccacaactggaaaatcgactaaaaaaagcggcggaaaaatgttgaagtagcaacgaaagatcggtggataactttttgcgaacaacgtaagttatccaccgactatccacagctattcacatttgtgcacagtgggtgagatgagctgattctgtccacccgaatgatgaaacttgaatgttaagcatatcgtaaggaaggctagtgtatgactggacctgaaggaccagataacctgacatcgatggaatcggcaacggaaaccatcaaacgaattttcggaggatcggattcccctcttggttcgcagattgccgacgaatcgactcgctatcgcgccttgcagaaggccgtttgcccaaagccggagcagacgcgcctgatcgcggtcgccaaccagaagggtggcgttggcaaaaccacgtcggccgtgaatctttccgctgcgttggctcagttcggttccaaggtgctgctgatcgatatggatccgcagggcaatgcgtcgaccgcgttgggcgctccgcatgcgtcgggggagccttcggtgtacgacgtgatcgaaggcaggaagaccatcgccgaagtcaagcgcacatgccctgattttgatctgctcgatgtggttccagcttcgatcgatttgagcggtgccgagctggaagtcgccgacatggaaaatcgtaatgtgcttctgaagaccgcggttgacgagtttctggaaaccagcgaggagcactacgactacgtgattatcgattgcccgccaagcctcggcctgctggtaattaatgccatgtgtgcggtgcatgagatgctgattccgatccaggctgagtactatgcgctggaaggtctcggccagctcatcaataccatcggactggtgcaggagcatttcaatccgtcgctgctggtttccaccatgctgatcaccatgttcgataagaggacgttactcagccgtgaagtgcatgacgaagtcaaaaatcattatccgactatcgtactgaataccacgattccccgaacggtgaaaatatcggaagctccaagcttcaatcaaagcgtgatcgcctacgatcccaagggaatgggagcgattgcctattgtgaggccgcattggaaatcgcacgtcgctcgcagacggtgctgaaggctatcgatgcaagaaggaatgagaactgatcatggctacgaaatcacgtttaggcaagggtctcggcgcactgtttccgtctcttccaggagagtcggcgaaatcggaagccgctactgaaccggctgtggctgttgcgggtgcaaaggctgataacaagatcgctggaaaggtttcagaaaacgtagccggtggtgcgactgttgccgggcaatccgcggggaagaccgcggtcaagagttccgtggcaaccgccaaggcttccgtcgatgccgtccatgacatgaagaagaacgtttcacgtgaaaccaagaaggggagtggccatcgagccagtatgccttccatcacgttgaatgagactgctcatcctgccgacatgttcttcggttccaccagtcctgttgccacttccgaagtgaagcaggaaagtgtttcacgtgaaaccgctgcggtaaaaaagaccgaagataagaagaatgacgaacctgaactgttgccggtgcagggcggttatctcgttgaattgcgactgagtgatgttggaccgaacctgcatcagccgcgtaccattttcgatgaggatgatcttcgtgagcttgccgattccatcaaagaagtcggcgtgctgcagcctattgtcgtacggaagcgtccactcgcgcagattgaggctgctcgcaaggagaacgccgctaaagatgccgagtcgcacaatatgttcgacgggcgcatggatagcatgtacgagctcattatgggtgaacgtcgttggcgcgcatcgcagatcgcaggtttgaaaacgattcctgcgattgtcaaaaccactgccgacgacgatatgttgcgtgacgctttgctggaaaacctgcatcgcgttgcgttgaatccattggaagaggcggccgcctatcagcagatgatcgacgattttggcttgacgcaggcgcaattgtcaaagtcggtgtcgaagtcgcgtccgcaaatcgccaatactctgcgactgctgaatctgcctgcgaccgtgcaaaagaaggttgcttccggcttgctgtcggccggtcatgcgcgcgcattgctcggattaccgacggaagctgacatggaacagcttgcgacgcgcattatttccgaagggttgtcggtacgcagcaccgaggaaatcgtgtcgatgaaggtcgctgaatcggaccagccgaagaaagcgaaaaccaacaagctgaacccttgggccggaacgccgatgcaggtcggtcttgaaaagaggttcggcacgaaggtgtcgatcaagggatccaaggagcatggacgcatcgaaatcgtgttcaaatccgaagacgacatgaagcgcattgtcgacctgctcatgcccactgccgaaaaatagtatttcttaagttttttggtgtccgcggaaggggcggcatattctgttcacgacacactcaaggccgtttggccaagcttacagtcgtgaacagaatatgccgccccttccgctcgtttttcaagtttttgtagggtatgaccgtgatgggaagtgttactgctggaggtaggcttgggcatcgagggcggcccggcagcccatgccggcggcactgatcgcttgacggtaaatactatcaacacagtcgccggctgcaaaaatgccggcagtgctggtgcgtgtgctggcgccgtccacctgaatatatccacccgcatctcgctgcacaatgccgtcaataaaagctgtgtcgggggagtggccgatcgccacaaaaatgccgtttgcggcaatcgtgctggtctctccggtgatgacgttgcgaatgttcacggattgggctccattgtcgtcacccaagatttcctccaccacggaatccgtgacgatggtgatcttcggattctgctgagcgcgttccacgagaatctgcgatgcgcggaattcagaacgacgatgaatcaacgtcaccgacgatccaaatcgtgaaagaaaatcagcctcggtgaatgcgctatcgccgccgccgaccacaataatcggcttatctcggaagaagaagccgtcgcaggtcgcgcaatatgacactcccttgccggaatattccgcctctccggggatgtcgagtttgcgatattccgatccggttgcgatgatcaaagcatgggtttcaaaaacgtctccctgatcgacgctcacggttttcacgccggtgacgtcattgttgctcacggaaacaacatcatcccaaacgatttccgcgccgaacttctcagcctggcgttgcatattatccatgagttccggtcccataacgccgtcggggaaacccggaaaattctccacttcagtggtgttgacgagctgcccgcctggggtcagcgcacccgcgatgaccagtggtttgaatccagcccggcccaagtatatggccgcggtatatccggcagggccggatccgacaataatcacatctcgcaaatcactcatattcccactgtagcgaaccaccaaagcaaccagccgcgcactgcacgatttcacgcattcctttttcttatggcgtattatcaagtgctttccaagctggatcatctacagagtttcacgtgaaacaccagctgttgtgcgtggttgcgtgcggtgctgtgtgtgcagttgctggggtggctggattcttggcgtcgcttgatcggaacatgagaaagggcttgcgctccacatggagcgcaagcccttcggtcgtgttaatgtgacgcctgcctgtgcgggccttggatcacttgttgatgaccttcttgaacagatcggcgctggccttggcgagtgcgaactggccgaagcccggatcgacggaagcgaggttggcgttgatgatctggttgaaagtgttgttcttcatgatgtttcctttcgttcggcttggcggcgttcttgttttctgttctttcctctggccgctgccgtaagtctgttgctttttggttacgttcagcgcgggtggcgttgccgtttccccgcgtgtggggtgcggctccggttttctctccggttcctgccgcatcgtgtctctttgttctgttgtgccttcatcataggcaggctcaaccgtcgatgtcatgcaacgatcgtcgattcttttgtattttcatcggctaatcttgaaataaacgtaacgatgctgtgatgaacatcaatcgtcgattgcagggcagtattgccgtcgcaaaagaaacggcgcgatcttcagattttctatcttttctatcttttctatgaaagtctcaaaatcgttctcccgtaagacttttcgcaaggtcggcattgttctatccattttctatcttccttatttgcgggagtatttgcgcttgttgccggcgaatgtcaggttacattgattgatatcgggctgattgggctgggctgattggtgtggctgttcgacaggctgattggtgtcgggcataagaaaggaacgtgatatggcgactattcctgaacaatatgagagccagcgcgtgggcgtgcagggatatcgcgtgctcaatctcgatttggacggcgtttgcgcggattacaagggcgcgatccgcgattacctgcagcggcagggcattgacgtgccggaacgtgcgctgcagaccgcgcattacaatctcacgcgcgaggacggatggccgttcgagacgctcgacgattacatcgaaacgcacaaagccgcggagcgtgagcatctgtatgcgacgatgaagccgcttccgggggtcgcgcaggcattgcagcgattggcgaatgagcacgtgtacattcgcattgtcacgcaccggctgttcgtgtccggccagcatcagatggtcgtttccgacactgcgcaatggctggacagcaaccgcattccgtacatgagtctgtgctttactgggctgaaagacagtatgcaggccacgattcatattgacgattcgccggcgaatatcgaaactttgcgtgaggcagggcagcatgtggtcgtgttcgatcagccgtacaacagtacgtatgctggtcccagaatcgacagttggagcgacaccaacgttgaaacgctcctcaccctcttcgaatcctggccggagtaaggggtgtgctggcggtagctgcgattccgtccgtgtgactctggtaatcggttttaggtgcgggttgtgcggacgggattatgtgagcgaccgcatgatttgtcagttgaccgcacgatttcttctatctggcctcatgattttgttttggcgacctcacgatctggaaaagagtgtccccgattgaaatcgtgaggtcgccagatcacaatcatgaggtcagccaaaccagatcatgggtcagactaatgctggggtagacgtttcagcgcgtcagccagtctgcggcggaatatacctgctcgtctttggcttgaaaacttgattccacgcgagccgccacaaagcgccgctcagagcgcaaagacgcaggaatttgtggaaagcggtcacgtttcgcacattgagataaccggccacgtctcgctcgacatatgtgctgagatatgacgaaaagaagagttcaagcggcatttcggaactgtagagacgggggtagccgtcgcgcagcataaaatcatccgcgagcaagctcccgaatctgacattagagttctgacatcagagtgataaaaatggcgaaaagttggttgtcgattcttgagccaagttccatcgcttttcgactacgaccatattccaaaaataaatacgaaaagagcctgccatacgtgaggtgacgcatggcaggctcttttcgtatcgcaatcttcagaagtaatcggatattgcgatgtgctgacgatcagaacacttgaatgctttcgatgtacagctggttgcccggcaggctatcaagtgggacccacagcatgatgtcctgcgtttccacggccttgtcgaacttgatgtcggtcgtgccggaagcgtcaaacttgaactgcgccacctgttcgccttgggacgggctgtttgtcgcattcacgcgaatatatccctgaccaccggaagaacgaattttgatgaccatgcgatacgccttctgcggctggctcagatgcacgtaatatccgtagccctgctgtccgtcaggattcgacaggaattgacgattgtcgatttcgtacgcggtcgtgttttccggctgcttcggatccggcactttcttcgactgcttatcggcggtcacgaccttgtcctcggttttcttgggttgcttggacgccgtagactcgccggatgccggcgtattggcggaagcatcggaagaatccttggaattggacgaatcggtattgccggacgtatcggaattggaagaatccgcggaattcgcatccgactgatctccctcgccgaacggcacttcgtcaagatttatttccggccatggtccttttgaatcagtcgtaaccgaatctgaaggctgcatcaaaccatgaactgcaaacccaagcgcaaccgcaacaacgatgaccgccacgataatcgcaacgaccttcgttttcagcttgccaaacagtttcgcgtcggcaacgtcagtattcgccgaagcggaagaaggattctttggcgtgaagctcggcggaaccgcggctcgaccggcggcatacgcggcatcgatcgcctcctgctctgctttcaacgcacgggcggactcctcgccgggctgaatgacctgaccatccgcgccgatcactggaatgcgaccggttttttccaactgggaatcgtcggatgacatgccatcgtccggtacggaaaccctgatggggaaggagaagggagaatcgctggtgtcggtcacgccatcgatgtcttcttcgctcagcagttcacggccgctgctccacaacgatttcaccgctccactggtggccgcgacgcttttcgccaaagcctccttgccatcggaaaaatcgttatgcggttcgggagccgtgaacgtcatttccggaatgcttccagccgctgccagcgtatccggcagcgggagcacatccttctcaagaatctgcagtaacggaacattggcgattgagcattccgaatccatggaaggcaacgtgatatccatgcttcccaacgatgacagcggttggtactcgccaagcaacgcttccaattccgcaatggttgccatcggaacggtggggaagccgtcgtcctcttcaagttcgagaccgcgcttgcagatcacgcggaattccatcggcgtggtcggcgcgagcgcttcaagacggaaatccgtcgacagcgtggacgggcgtcggatcagcatagcgtacaacagcgctgagatttgacggatcgcaagctgttcccgattttccaaagcctgcgcgcgggaagtgtcggcaagcatgatgctcactggagcatctgcgatctgaatgccggaacgggtcagtcgcaccgtgtcggtgctgatggagaaatgcgtgagattgtctttttgcagcgcatgcaatgattcgatgacttcgccaatgatggagcgcatggctgtatagctcaacggctggttggcgttcagcgcaagatattcactgagggtcatgccttcgtcaagctgcgtcaccaccagcgcgacctggccggcatgctggagctgcagcactttcgtgaagtgggaatcatgcgaaatagccagcatggaagcggttgcgttgacttcctgcaatgccttgctgctgctgacaataaacagctggcaatcccgtgcgagcacatggtcgctggccttccagacctgcagtccggtttcttcgcgcaatggcgaaacgagcacgtagcgattgctgatggtatctcccagctgaggtttcatgggttccttcaactttttgtaaacgtttgttctgcctatggtcactcgccgttttcggcgtcgtcctgttccagtctatcgttggggctggtcggcttgcgaagtccgggaatacgtgaggaaatcagtgcgatcgcctccttgaattcctcggaacgtagcagccgcaacatgcctacgtaaacgatgaaggccactatggccagcagtgcggcacacgccactgcctgaatccagttcatatgaccgtccaccgctccgatttgggcgccgacaagctggtagacgctgtcacgtaccgtcacgccgatgaacatggtagctactgccgcgccaatcgatttcagatacgagatggctatgcgcggaccgtcgatattgttttcgaatcgtttgcgcagcatggcatacaggatggggatcggcagtatgtagctcatggctcctaccatgccgatcattgtcgtccattcggtaggggggagtagtttcgcgccgatgatcacgcttaccgcttgaatgcccatggcgaacagcatgaaaatgaacggcgatttgccgtcttcgaatgcatagaacgtgcgctggataatcagatacgcgctggcgaacggaagtcccacgccaagcgtgaccaacggtcccgccataagaatcgcctctctgacgctcacagacggcagcaacgcgagaatgatcggaacgggcatcaccacgaaagcgaccgcgaaatagcacatgatcacacccatattgcgcagcgcctggctgagatcgatgcgcgcttcggcgatattatgatcggcgaccgcacgggatattttcgggaaaatcgcggttgccagcgaaacggcaatcagcgaatacggcaacatgtaaatcgtgtacgcgttctggtatgaagcattgccggccacgtagagcggattgatgccgaactgctgctgcgcgagcatcggcgcgttagtggaggtacgcgtgattacgatattggcgagctggtcgattacgacaatgccgacactccaagccgcgaccggtcccatggaacgcaatccaatgccacgaaggccgaagatggggcggtatttcaatccgattttggtcagtggaatgaacagtaccagcgcctggaatgccacgcccaacgtccacgtgcctgcggtcagggcgattttgtcggcggtccaaaaatcaagcggatgctcggtggcacggccgaatagcgcgatgaacgtgccgaagccgatgcagctgatgatgttcgcacccacggaactccacgcatacgcagtgaaatggtctttggccgcgagaatctggccgaccaccgtatataggccgtagaagaagatctgcggcatgcaccacagggtgaatgaggtcgccaacgccatggtttcggggctaccgttcacatacagcttggtgagcagcggcgtgcatagggccatcaggatcgtcaccgccaacagcatggtgatggcaagcgtgatgagcttgttgagtttggtttcggcgtcttttgccttcaacgtgcgcacgatctgcggcacgagcacggcgttgaaaataccgccggaaaccaaggtgtagatcacctgcggaatcatggatccggcttggtaggcgttcgccgcatagccggtggtgcctaaagcccaagcgagcagaatggtacggatttgcccggtcacgcgcgaggccgcggtgccggaggccatgatcagtgaattacggccaacggaagaactcattcgtctggatccttcttacggtggaattggcgccacagtcccaaagctccaagcagcacggcgatgccgatgatgatgaagccggttttgtcgctgatctgcaatgcgctggtgatgtgggtggtttgtgtcgctccgaatgtgatgccctgcctgtcctgcaggctgagcgtggcgtccgcggtgccggaggtggccacgcggatggtgaacgccacttgggcttcgctgtgcgcgggcacttccacggtgtcgaaacgcgaagtgacgatctgcatggagttggtcaatgatgagacttttaccgtgaccggataggggtggctgttgctgatggtaacgggcatttgcgcggtttcgctgaccacgttgacgttttccgtcggtgtgatggccacgccgttgatgagcagggacgccagttgcccggctccttccaccatggtgcttccggctggattttcgccgcctagcgcgtgcagggccatgatgccgtgcgcgttgacgagctgcctgcgccacgctttgaggcctgcgggggtctgcttggcatcgtcggcgacgtcggtgaggatggatgcgttgaatcgtttgatgtcgtttgtcgaggctgccagtgtgttgagcgtctgcctgagattggcttgcgtcgcatcattgattccgtcggattgcggcacgatcgaggctgcatcgtcgccgctcaaggcggggtcggcgttgttgagcgtgttcagatcggtgatgttcagccatggcgattgttcgacgtccgtcatcagtgcgtccacgacggccggatcagagttgccgttcaggcagaccagcagattgcgttccgaatacggctgctccatctggtagaacgcgctttgcgcgacgaatcgcgcgagacgcccggccgttgttccctcgccgtccgcttcggcgtcggcactggtcgccttgccttgtgcaaggttggaaagcacgctttgcgcggtcagtacggtgatgtcgccggcgtcggtggttactacggtcttgccggtttccgcggtggccgcatcatcctcttcgaaatcatgcgtggcgatgacggtgtcgtacccctgctgcttggctttcgccagcgcgtcggcggtccaattgccggtgccctgccatgcatacgtggtcatactcgcgttcgggtcacccaacgccgattgatagtttttcaaggcctgttcggcgttccattgcgaggtgccgacgcctgccgaatcataggttttgctgtcgttcagcgcggaataggcggtgatgtcgaacagggccggttgcgtgatgccgtcgacttgcgtcggcatcggcatcgccttcagataggttggatcggccaccacctgcagtttgtcatgcttggtgaacgtctgttccagcgacttgagtcgtgcctcgtcttctttgccgggaacggcgattttcgagagttccgcggaggtgacgccacctttgttgacgagctgttccagcatggtgttgtcggtggtccatccttgcgcttcgagcggctgcacgatggtgatattcatcgcgggcgtgtcgggggtattgattccagctccggtccgtgttgcgaaagtgtgcgcttcgtcttgttgaacgccattggcctcataactgagcgtgaccggtttcggcccccaggagttgacggacgccagcgtctcctgattcgagtccgcgtcgatgtgcacgttcgccgaagctcccggttgaagcgcgggaacctcgctctgcccaacgatattgggcgtgggaatctgcccgatgccttccgaccattcctggatatcgttgcgcgacacgaacgtgtagaaggcgttcatggcaagggtgagcgtgcctgaagggatttcctgatcggtggtgttggtcaccgtcgcgctcaaatgatagccggaagtgtcggtcagcacggcggtggaggagtcgatcgacagcatggtgtcggattgcgattcctgtgtttcttcggcttcggctttcggcacaggtgcgtataacaacatcaacgccatggtcataaccatggcgaggattgccgaaagcgcacgcatgccgtgcggaacgttccgttgtgcgggttgattcaccttcacgcctgtctgttgagtttccttgcgtacaaccatgctatctttcgttcgttcgggtagctgagaacgtcgtccaaatcagcaaaatccacccaaatcgcgtcttccgcctcatgatccgggtcgccttccaccgtcaactcgccgccgatctgacgcaatgcgaaatgatgcaccagcttgtgcacgcgctggctggttccggtgaaccagtagtcgatggtggcgatggaatcgaccacttcacctaggattcctgtttcctcgtgaacttcgcgaacggcggtttgctgcggtgtttcgcctttttcgatatgacctttcggcaggcaccattccaaatgtccgctacgcgagtggcgtgcgatgatcgccacacggcccttgtcgtcgaatacgagacctcccgccgaatattcgcgcactaccggcagttcctgcgcgtcgagcgaggcgaacgtggtcggaccgtccgtggcgcgccgctgcggcattattgccggggtgggtgcgttgggcgtgatgatggtctcttgccgcaaggaaacggactgcgatgtgtacagcagtttgtccggttccatcggattttgggcatggtcgtccgcagcatgggcaagcatgcgtgcaaggtctgcgggcgtaatcatgattccaaccatactcaattctgtgtgcaggtggggtaacggtatgctggtaaggcagaaacttgtggtgccggaaagggatggcgtgaacttcgaagtgtggccagaggccattgaattagggcgtatgttcgccgcggaaggctatgaattggcgttggtgggaggtcccgttcgagacctgctgttgcatcgtaaatcgcatgatttggatttttgcacatcggcgcgtcctgagcagtttgaacacattttgcgccgtttcgggcgcgatggcttttgggatatgggccgtaaattcggcacgttgggcgccatgcgcaggcgtgaggatggcacggaagtgcaggttgaggtaacgacctaccgttccgacacgtatgaccccgactcgcgcaagccggaagtcaattatggcgacacgctggaaggcgatctttcccgccgtgatttcacggtgaatgccatggcgttgcgtgtgccggaattgcaattcgtcgatccgttcggcggcgcgaacgatttggccaagggcgtgttgcgcacgccggtcgatcctcgccagtcgtttgacgacgatccgctgcgcatgatgcgcgccgtacgtttcgtggcgcaactgggcttccgtatcgaaccggaaaccgctgaagcgctgaccgacatggtcgatcgcattgaaatcgtttccgctgagcgcgtacgcgacgaactggtcaaaatgctgctgtccgatcgcccgcgcgcaggtatcgaagcgctggtcgattccggtcttgccgatatcgtcttcccggaaattccggcattgcagctcgaaatcgacgaacatcatcgtcataaggacgtgttcgagcacaccatgatcgtcattgatcgtgcggttgccctcgaaaccggcccggacggccctgtgccggcaccggatctgacgttgcgtttggccgcgctgatgcacgatatcggcaagccgaagacgcgtcgtttcgaatcgggtggcaaggtgagcttccatcatcatgatgcggtcggcgcgaaaatgacccgcaagcgccttaaggcattgcatttcgaccatcatatggtcgaggacgtcagcgagctggtcaatttgcacttgcgcttccacggctacgtggaggagccgtggacggattccgcggtccgccgttacgtcaaggatgcgggtccgctgtatgagcgcctgaaccgccttacgcgtgccgacgcgaccacgcagaacaagcgcaaggccatggtgttctcgtcggcgatggacgagatggaacagcgcgtgcgcgatctgaaggagaaggaggatttcgacgcgatccgccctgatctgaacggtgacgaaatcatgcagctgctcggcattgacccggggccgctggttggcaaggcgtacaagcacatgctggaatatcgcctcgataacggcccggtcgagcgtgatgtcgctgttgccgagttgaaccgttggtatgaggaacagcaggccgagtagtctgcttgctgacctcacgatttggattctatgaccgcacgattcgatttttcgggcaaaaatagaatcgtgaggtcagtcggttccgaaaagtgcggtttcgggggtattctctggaggatttcgcccgcgatttaacccacgaatataagaattgacctcacgatcttgattttcagtgaaaaatcgaaatcgtgaggtcaatccgaaaatctgcaaatcaaaaatctgcaaatcacacggcgtcgtgttcgggggccttctgtacgtcggtcatcttgtcgacggtaacgcatccctcgaagctgtcgatctccttgccggcggtcggcaccttcttctgattctgcagattgtcgaaagtcgcgccaaccacaacgtcgatcagcatatcctcacgatcgtccatcaccatcgtcgcgtcggtgaagttgctgttcaccgtgtacgcctgattgatggcgttcttgccgaagatgatcatcgtgcgttccactttggagctggtgtagttgccggctgcctgggtgttgaactcgcggttctgcaacgcgctgctgacggcttgcgcgaagccggcgaattcagtgccgttgagcacgcgcacggtgatgttgcggttttccacgtacttgcctttgctgccgtcctgttcctgtgctgcgcaaggggcctgctggccgtaattcggctgtaccgcggccgacttgacattgcccaatcctccaacatggaagaagaacagcagggaaatcaccaatgcgatcgtcaaaatggtgccggtgatggtgaacaccaccttttgacggcggcgaatgtactgtttgcgcgcggcgcgctcgtcgttagcctgagtcatgtacgagtccttctccaaaaatcggttgacttcaaccttactgttacgcgatgatatgcacaatcggatgggccggtgccttggtggcgatgatgcggtcgacgcaacggctttgttgccatgccgactgcacggcgcgtgccgcatcgtcggttggcacgaatgcgattacggaagggccggatccggagacgaacgcctgcttggcgcctgcctgcaacgcttcgtcgatcgcctgtccgctgcgtggatgcagtgagatcgacgcctgttgcagatgattgttgtcggttgcgccggcgccgatttggtcgaacatggcatacacttccggcgtgcgcagttccgcctgatacgcgccgaccagcagacggcctgcaaagccctgatccgtcagttccagcacggcgtcgctgttttcgctgagttgttcgatctgctcgccgaagccggtgcctcgcgcatagcctccggtcaggcagaacggcatatccgcgcccaatgtggcggcaacctgttgcaaccgttcaatggaccaatcaagattccatagcgtgttcaatgccagaatcgtggcggccgcatccgcggaacctcctgccatgcccgcgccaacgggaatgcgtttttcgatgttcaacgccacatccggttcatggccgctcgcttcggccatggcgaacagggcgagcacggcatggttgcgtcgcatgtcgctgccggaggaggccagatcgccaagataggcaccttcaagattcagggagaaaccggatccgggctttttgcgactggtggtgacggtgtcgtacacgccgacggcgcagtagatggtgtcgagctcgtgtcggccaccccattcgctgcgtggcctgcctacgtgcagggtcagattcgttttcgccgggcagtccacgctgaccgtgttgattgcggtattagtgtcgctcatgcttgcgacacctcgcccacggctcgtgccaatgccacgaattcgtcgatggcaagcgtttcgccacggcgcgtcggatcgatgcccgcctgctcgaacgcttcggagggcacgatcttcttcaacgcggcatgcagggttttgcgcctctggccgaatgcggcgtcgataagacggaacacgttttcgcggtccactacggaaccgtcgggattgttggccgaaggcgtgtgcccgccctcatatcgtttgaacagcaccagcgcggaatccacattcggtgccggccagaacacattgcgcccgataatgcccacacgttccgcggtaccataccaagcgagcttcacgcttggagtgccgtagatctttgaaccgggcttttcgctcagtcggtccgcgacttccttctgcaccatcacgaggaacgtgccgagattgtcgaaacgttccagcaaggtcagcagaatcggcgtggccacgttgtatggcagattggcgaccagtgtaaacgaatcatcattttggaaatcaggcagattttccggcgtcacggtcaacgcatcgcgattgaccacgcggaaacgatccaccgcatccggcatgaattcggcgatggtgccgggcagtcgttccgcaacgggcgggtcgatctccacggcggtcatcgtggcgccggtttccaaaatcgccaatgtcagtgaaccgagtccaggtccgacttccagcacatgatcgtcggcggtcacacctgcctcgcgcacgatacgacgaaccgtgcccgggtcgattacgaaattctgcccgaattttttcgtcgggctgataccggcctcggccgcgatacgccgaatgtcggcagcccccaacaggcggccttgcgcggtttcgtcggttgcgttggtttcgttcgcgtgttctgtcattacctcattatccgttcaactggtatgaaaagtgtgcgctgttgcgtttgcgtattgttgcgatcggcgttgtttaataccatccgacctgctcggaatgctcccatgccttcgacgggctgccgtagcgttgcgcgatgtagctcaggccccagtcgatctgcacggccgcatcgtcacgccagtttgcgccgaatgccgccattttgctgccaggaagcgactgcgggatgccgtaggctccggaagatgcgttttccgcataccacagccagctcgattcacgcgtccacagtttcaccagatcggtccagttttgcccggtccagccatattgcgccgcggctccggccgcgtaggcctgtgcctgcgcgggggaggggtgatagaggcggcatcctgccgaaggatcggaaggttgcggtgtcggggtgggcgtcggatccggcgtgggggtcgggtcaggagttggcgtgggggtcgggtctggagttggcgtcggatccgggtccgttttcgatccggaatcgtccttcttgttgtcgtctgaattatccgtattgccggaattactgttcgaatcgtctttcttgtcggaattatcggaattgttgttcttgttcgaattgtcgttctttccggaattatcggaattgccggtatctccggaattgccggatccgtcatccgatcccgaatcgtcggaagatgctgccggtcctactgcgataatctgatcgagggcgattttcgtggtcgtttcgttggtcagcgtctcgctttccttctcgccgtccacatacgtgacgtcgtacgtttgctggatttcgccgtcctcgccttcctgcctgactacgacttcgccgggctgcaggctgggatcgacgatggtttgcgtgccgaaaggcaccgctttcgtgcgtgtttcctcgccgtgcgtcacgcggcggacgcgcaggatcgtttcgccgttgtctttttcgacgctgacgcgatcctccttgttcagcgtgatgcctttggagtcaagaatggaggccgccggcagtttgccattcggcgattcggagctttgcccgtctgcgatgacggtgaccggcccgttttggttgatgatcagtccgccggtgagtttgttgtacacgttgtcgatattgacggtgacttttgccgcgtctgcttcgttttgttcgaagaatccgatcagctgttcggcgctggtcgccactgtccagaagggcacttcctgcccgttgatggtgatggtggtctggtaggcgcttcgtaccgtcaccacgtcatggttgctcagcatgctggtggggctggtggattccacgagatcatgcgttttgaccttcacgccgcgttcctgcagcagacggtcgacgctcatcgcgtatgtggttacggtggtggtttcgccatcgatggtcagagccacggttttgcgcgcgcctacgccgaatgcgagcgtcgaggcgagcgtcaacgagaccacgcatgccgtcactcgaacacgccgaagcgtcacgaatctccggggggtccaccttcttgtcatacgtcctctttccagcgactgcctacatcgccgtcattgtaacggtcagatcgggacgaatggcatggtttccgctggctttatctataccgccacattttcgaggaaaaggagtaaagaaaaaagggggcaggagagaaggggatgtcctgccccctgcccggacgaggcaggttgggggaagcctcgtccggtcgccagaagccataagttgggggaaggcttctggatcacttacccatggtaagaggtcaaagcccgtcaaaacgggtttcgagcctcctgtcgggatcgaaccgacgacctgccgcttacaaggcggccgctctggccatctgagctaaggaggcttgtgccgctttctagcataatgcataaaaacggcaacgattgaatagcataaccagcgtgcccgatgccgtcaacttggaactgcgctttggctggcacgctggcgagtaggggggtataatttttcgattatgaggattgcgtagggctgatcactcgccagtggtgttggagatcggatccttgtcggagccgatggagggcatcacgcctcccttgccgatgtcgtcggacttgattccgatggcctccagcaggccttcctcaatggtctcctgcgcagtgctcaactggttcatatcccagaacttgccgttgatggtcaccgttggggtggtcatgctgtctttgtaggttccggacgtgttccacagttcggagcgcttcggcgtataggtgtcgatggcgtcaagccaatcctggtagtcgcggccgaacgccttgtccgccacatcctcggaaactcccgaggcgatcatctgttccttgatctgatcgtcgctgacggacttgtaattcgagctttcctcaggctggaaatcctcggcgtacattttttcgaggaaggtgatcagatggctcggatcgctgtcatgctcggccagatagatcgcggcattcgctgcgcggcttgaataatcgtcggtggaccacttgtccataaacgccatgaaatgcaaatcaagattgatctgacccgcgtcgaccatcttctgcagatcctcatcaagctgacgatgcagattgccgcagcccgggcacaggaaatccatgtagatctcaacagtcggtgcgccttcgacggacttgccgtagccatccttcgaaatcagcaatccgcccttcttatcgacgagcttaggggtgttttcgacttgctgcagcttgtcgtacgcttcttccacggtctgggtggaagcctgcgtttcggtgttcttgtgcatgttgtgatacacggtgaacgcgccgatcgccaccaggatcaccagcaccgccatcacgatggcgccgatgagggtctgctgcttgcgctccttctccatctgttcggcgcgagccttcatctccgcggcctcagcggccctacgctcggcgcggctggcgcgcttctgcgcatccttactgttctgggccatccacattcctttcgatgttcacatcacgatgctgtgcaccatagtagtgtgggcacgctattgctgaatgaagtatttcgtaaaagctcacgttgccatactacgtgcgattatctgatgtttttctgatgattgcaaacgtttgccgatttttgattttcgctgcgtatttcgtgagatggcgtcactacatatcgtacgattcggcagtggtgccggatttcgggcggccgcgcaatgcgccggcacccaatcgcagcaccaatgctcccggagcgagggcgcataccagccagccgatggcgcagcaaccggcctgggcgacgccgctttgcgaaaccggcccttcaatccaggtcggcagcggaatcgtgaatccgaatatcgacgtatcaaccatggcaaacggcagttgcagcgtgactgtggcaatcgtcaatcctaatgcggcgatgaccgccatgatcagtgcgcgtggcaccgcataacccagccccttgagcacatgccaaggcagcgtggcggcgcgggcgaaccagtcggaagtcctgcggctgcccccacggcggccttcgcgttccagctgcgcctccatattgaatccaatggtggcgagcaaccaggccagcagcgcgcccgcgatcagggcgatccatggcgagaacaggccgcatgcggccacaggaatcgccatcagcacgcagaggggcacgcctctgcctagcagttcgccgcgttgcacgtcggccggattcggcggctgcagtacactctgcggcacgttcgggttgagcggcgcggccggagtgaccggtgcggttggcacggcagatgtttgcatgtcttgtggttgcgcactttgcgccatttcaaccgatgcgttcggtattacggcaggaggccgctggttggcgatgcgctgcaatgcaggtttgatggccgggtcgatctgtgtagcctcttgagcgggattccaagcgtcctggaccggcatcacccgcgtggattgcggtgtatcttgcggcagcacactggtatccccactattgacaggcagcacgagcgtgccggtgccaagaggaatggttgcggtatgcgcgttgatatccatgaccgaggtgccgacatcgggcgcatcggcaataacggtatcggttatgtcagcaataacggttgcgccgattgcctgcgtggcctcaacgaattgcggcaaggtgcgcgtgccgatggcgtcttctcccgtcacatggtctaacgcccgccaaagcattcgtggattgtcgggcgatccatcaaaagggagcatcgcctccgacccggcactatcggcggcatccgaagtattccccgaaatccaagcttgcggattcaacgcatccaacgcaatcgcctgcaacaactcgtctggagtgcaacgtttcgtacgatccggatccaacgccgaacggaacgcggccatggtcccagccggcaatcccgccaaattcgcgcttcccgcggcagcacgctccaataccgccatcatcggtttcgtgccgaacaccggctcgccagtggcggcaaatgccagcacgctcgccaccgaccaccaatcgctcatctcatcggattcggcaccgtcgatgatttccggcgcgatgaatccaggcgtgcccatcaccaatccggtacgagtcacatgactttcgccctcgcccatggcaatgccgaaatccaccaataccggtccggtattcgacaccatcacattcgtcggtttgatatcgcgatgcacaataccggccgcatgcacggccttcaccgcctcgatcagcttgcgtcccaaccgttccaaatcatcgcccacataccggccgttggtacgcacatcttcacgtagattcttgccctcgatcagctcggtcacaatgaaggccagagcatcatccaattccatatccacaatgccgcacacgcccggatgacgcactttctgcagcgccatagcctccctacgcaggcgctcgcgtgcggtcagctgatcgcgggagcgttcgctggacgcatcgtcctcggcaagggaatcgcgcaaaattttcatcgcatactgatggccgccgtcatctcgcacccgccataccgatcccatggcacccgaaccaagccgggaaatcaacgtgtatccgccaacgaggctgcctgcctccagattcaatgcgcttaagtcgctcatggcacccatggtacttgccttacgtaagttgccgctggaacagctcgctgtagtgtgccgaaaatatcgcaggaattgcgattatggagttggaagcgcaatgaagatcgatgatttccgcaatcaaggcaaggatgttgcaacaatctgcggatgagcgcacattgtgccagatgcatgcgcgcaacgggattatatgtgcacgaatggtagttttacatgcgcaggtggtatgcagattatgcacgcgaaacgacaggctgggaaaaatcagggtgcttttttcgcggattttggtgaaatcgaaacatcgacatgaagaagtgtcttcacttctggaaattgcgtgacgcggggcagcgttgcatgatttctggtttcgatgaggaaatcggagcctgcatgtcgtttggttatgagaatcaaggaggaggcagaccatgctgcaaatcaacatggctgacgtcatgaacgttatcggttcgttgacgccgtacctgattgcgattggcgtgctatttgtgctcgcgctgatcattacttttgccgtcaacaagaagacggtgaaggaagtggcgacccgtaagatcatccactccgagtcttggcttgtggctttggtcggcattgtcgtcgcggtttccatgatgctgtccggtccgctgtcgacgctgctcaacaacgcgaccatcaccaagtacatgctgtctgacaccactgtttccaaggctaacgagctggccaaggaagtgcagtcggaagccatcaccatgctgaagaacgatgattccaacctgccgctggctaacaagaaggtcaacgtgttcggttggggctccaccaacccggtatacggcggcaccggctccggctccatgtctgaccagtatgacaccgtttccctgcttgatggcatgaaggaagccggcatcgagaccaacgccgacctgaccaagctgtacaccgattaccgtgcagatcgcccagttgttggcatgtgggcacaggattggaccctgcctgaggttccggccgaccagtattccgattccctgatctccgatgccaagagcttctccgatgaggctgttgtagtgctcacccgcgtcggtggcgagggcgctgaccttccgatgaacatgaaggccgaaggcatcacctatgagaacaactccaaggattacgaggacttcaaggacggcgaaagcttcctgcagctgagccagaccgagcgcgatatgctcgacctggtcaccaagaacttcaacaaggtcacgctcgtctacaacggcgccaacaccttccagttcgacttcctgaacgactatccgcagatcaaatccgtcgtgtggtgcccgcctgcaggccagaccggcttctccgcactcggtgacgtgcttgccggcgataccaacccgtccggcaagacttccgacaccttcctgaaggatctcacccagtcggtgtcttacaacaacttcggcaagttcgaatacaccaacatggaagacaaggccgccaagtacacgggcttcactggtgacgaagtcaccgccatcccgggctttgtgaactactccgaaggcatctatgtgggctacaagttctatgagaccgcagcggccgaaggtgccatcgattacgattccatggttgcattcccgttcggttacggtctgagctacaccaccttcgagcagaagctcaacgatgtgacgtacaaggatggcaaggtcaccgttgatgtgaccgtcaccaacaccggcgacaccgctggcaaggatgttgttgaggtctactacaacccgccgtacaccgaaggtggcatcgaaaaggccagtgccaacctggttggcttcgagaagaccgagaagcttgagccgggcgcttccgaggacgtgaccgtcgaattcgaagacgatgacatggcttcctatgattacaagaatgccaaggcatacgtgctcgaaaagggcgattacaacatctccatcaactccgactcccacactgtgatcggctccaagaagatcaccgtggacgacaccatcacctacgactccgattcgaacacccacaatggcgaccagaccgtggccaccaaccagttcgatgatgctgcaggcgatgtgacctacctgagccgtgcaggacatttcgcaaactacaaggaagtcaccgccgctccgaccaacttcgaaatgtctgataaggcaaaggaaaccttctacaacaacaccaactacgatccgtctcagttcaacgacgattccgacgagatgccgaccaccggtgccaagaatggcctccgcctggccgacatgtacggcaaggattacgacgatgctgattgggagaagctgcttgacgagctgaccttcgacgatatggacaacctcattgccaacggcggctacggcactccggccgtctcctccgtcggcaagatccagctcaccgacgctgacggcccggcctcgttgaacaacaacttcactggtgttggctccatcggcttcccggcttccaccgcattcgcttgcacttggaacaaggatctggccaagcagttcggcgagatgatcggcgatatggctcacgacatgcacgttgccggctggtacgctccggccatgaacatccaccgcaacgcattctccggccgtaccttcgagtatttctctgaggatgcgctgctctccggtgccatggcttccaacgagatcgccggtgccaaggagaagggcgtgtactccttcatgaagcacttcgccctgaacgatcaggaaaccaagcgtaccgagatgctctgcacctggaccaacgagcaggccatgcgtgagatctacctcaagccgttcgagatgagcgtgaaagaaggcggcgcacaggccgtgatgagcgccttcaactacatcggcaacacctatgccggtggcaataacgctctgctgaacaccgtgctccgtgacgagtggggcttcaagggcttcgttctgaccgattacttcggcggctacggctaccagaatggtgatcaggagatccgtaacggcaacgattccatgctggctaccacctccatcaccaaccacatcaccgacaagtccgcaacctccgtgaaggccatgcgtaccgccgcccacaatattctgtacaccgccgccaacagctggcagtatgcagacggtgagccgaaggtcgccaccccgatctggaagaccgccatgtacgtggcttggggcgtgaccgcaatcctggtgatcgcacttgaggctctggctatcaagcgctacatggatcgcaagaaggccaaggctgaggtcactgcctgatctcacttccttctcacaggtcaaaacataactgaataacaattgaaacagcgagagccgtcgacttccctgagtcggcggctcttgttgtatttcagcgtgcgtgccgtcgcaagtgcagccaggtttcatgcttcttcgcgtctcttttgtatttctgctctttctgttccgctggaatcatgatttgcgattgcatttgggtattcatcacatgggaatgagatgtatatgggtatgacacgccgtttatagtttgtttttggttcatgtaggcgttgtcttcggggtctagactggctgtacggccgttcggaggcctttttcgacacgccgatggatgtgtttatttgcaacggttttagggtatctttggaagggtcgatttgcgtgattgccggggttcgtgtaaattgactcttcgctgccgctcggcgagtggttccccggttggggtgcctcgaggcgggtgagcggtggtggtttgagaactcaagagcgtatttgtactacttctttatagtcaatgatcagggtgttcaggaacaagtgccgacagtgaacacctttattcgatcacacacaacatccgactcatcgaaggaggcagatacctcaaacttcccaaagtgggcgtgatgcgcgcccgccagcacaagacgattcccgatgactggaagctcaaaagcgccacggtggaacatctcaagagcggtggatacacggcgacgatactgttcgagtacgagacccaagcacccgaacccgtccgacccgtgcatatcgtcggattggattacgcctcccacggcctgtacgtgtccagcgacggcgaacaagccgactacccgcgtttctaccggcagatggagccacggctgatgcgcgagcaacgcagactcagccacatggtcaaggggtccggtaattgggtgaaacagaagcggcgcatcgccaagctcgccgccaaggtcaggaaccagcgagccgacttcctgcacaagacggccaaccggctcgccgcccgatatgattgcgtcggcgtggaggacttggacatgaaggacatgagccaatccctcgcactcggcaaaagcacgatggacaacgggtacggcatgttccgcaccatgctcgcatacaagctcgaacgacaaggcaagcagctggtcacggtagacaggttctacccgtccagtcaactatgctccgattgcggctaccgcaataaggatacgaagaacctgtatatccgcgaatggacatgccccgattgcggggtctggcatgacagggacgtgaacgccgcgaccaacatcatgcacgaaacacgacgactcgtgcaggaatgataacaaaaaacttacgagaaccgtggggcgcacgggaatagcctgtagacactgactccgctaggagccttgagcaggaagccccctcagaccgcgaagcggtcaggtggcgggagcacgtcacaaatattcgcaccatcagtacgttccggcgttgccgtcatgccaagcatgaaatcaggagtgaaataatcgataattctcttatatgaatccgcggcggcatggtgaacttcgtcgatcaaaatataatcgaaatcatctttgctgaattgtgcaagaatttccggacgagacatggtttgcacagtggcaaacacatatttacgatcatgctttttactcgttccggaaaataatccaagctcatcatcggtgcaacgaagcgctttcgtgaagttcgattttgcctccgggaaactcccaatatccagccagcgacttgccttcgccacggcgtgcgcacaatacttcgccatctttgataatggccgcgcccacaacattgatgatcttacgtgacatcgcggcttcctctcttgtcggaaaatcagatccaggatacaacgggggcgatcgcgccaggcccaaaagattgaaacaaaatagcagtatagggcatgcagacattgacgaagagctggaaatgatctttggaagaaaaaactttcacatcacgtatgccacgcttattttgcttgttgggtgtagcggcagtttgggaagccggtgcacccgtagaatgagcggttcggatcgttgcgattgtgccgcaagcttagggcttcgccgcaattcgggcattgcggaggaagcttgactcctcggaaaatgttcggacagatcttgctatgcagttcatacatgaatcgcgacggacgggtctgatccacgatgaagaacagtttcttcttgcatcgggtcatcgccacgtaaaacagtcgccgttcctccgcatgcgggcatcgctccacttccggcaatagcagaccaagcagcggctcttcgggaatcgtgcttggaaagcctttcaatccgccggaacagcacagcagaaatacgaaatcgcgttgcaatcctttggacgcatgagcggtcatgaaacgaatatccatatccggtttttcgagaaaacgaatatttccagtgctttggtcgatggagaacagaccttcttgatcgcaacgaatcatgagattgatatcgctgcgataccggcccagcagtagtacggacgcggttttcggtagtttgcgcaactgctcgacaatcacattgaatcgttcttcctcagtatgtccgccaagtgctttcaacgaataatccttcttatcgctgggattattgagatgtttgacatacagattggtatcgcgcatcacgaatgctccgcttgcgtcaataaggctttgacggaagcgccgtgtggtggtgatctggaacatgaaggtcggaccccaggcgcgccaaattcggtcgaaatcgagaatgagatgaatgtcgctgcctgcaaaacgataaatcgactgccaatcatcgccaacgcagaatagtgagaaatcatgttgtaagcgaagcgcacgaattaattcatagcgcggtcgtgacatgtcctgatattcgtcaatcagcacatatttatatgggtgccggtacgagccattattgacgcaactgatggcatcaacgatcattcccggaaaatcaatgccattattggttttgaaattctgtatataggcatgataaagcggttctatgagctgcagcatctcacgattgcgaccgatgtttttaccgccataacgttcgttaagggtttgcattccagcaatgtcaatattgtttgatcgcatgtgctgaataatagtttgtgtggtatcgataagattctgacgatattgattgaatgcataatcgtctgttggaagctggaaattctcaagtcgtgcagctgtggaatatttatcaagcaactgttgcgacataagtttaaatgccagaagacgataggaaacattgtgttcaagcaggtattcaaatgcgttacgcaccacattgtttgacgtgtgcccgtcaataattggacgattggcaatggtggaggaacggcagatttccagtccgaggctatggaaggtgcatgcgcgaatgactttgccggtgctttgcgtgatgcggctcgacatttcgtcggcggaagctttggtgaacgatagcaccagaatctcttcgggagtggcggttcctgtgttcagcagccatgcgatatagccgacgatggtagtggttttgccggttcccgcacctgcgagcactagcgtattgtgacccgctccggcgatggcgctgatctgctcgtcgcttaactcatgcttttcgattttgccgatgatatttcgcgcccgttcgatctgctcggcagggagcattggttgcggcataagtttctgagccggttgtgaattggcatgagattgcgctcgcgaacgattcgttgtgacagaagtattgcgagctgtggtttgtgtttgcgcgcggtatgacgatcgcgccaactgtgatgattgggatggttgcgtaagctgttgcgtttgacgtgattgtacagtggacttgcgttgcgtcgtctgctgttgcgtgggattgggaacgttttgccgcgcaagcttgggcccgggctgagtcgccgttttggagacgggcggttctccaataagcgcgttcatgaacttgctcagcaatcccataatgttcctcctcaaccagtgcaaggagaaattatatgtgctgccaatgaatgcttcagcgtcggctgtgtgaacggaatcgcaattcgccgacgctgaaactaatattggagcttaacgttcgaaggggtaggtgaggttccagtcgcggcgcagggagtccatgagttccatgatgcgcagggtgtctgcgtggggcatttcctcgcattcggtgcgaccgtcgattacggcctgtgcggcggccgccacctcgtattcgtagccggtgagctgggcgggaacatcgtaatgtgcaacaaccgtatgattgccgtcatacacgtcaatcgcctcaacattattaatgttctggcacaccatataaccatcggttccccacacggatcccgtgcggtcgctatggcacagaatcgaactttgcgcggtcgccatcacaccgttctcgtaatagaacgtcatggaattatgcgcatccacgccggtttcgtacgctcgcatcgacgattcaatgcgagcgatcggcgcattatgcatgatcatgtcgatgaaattgatcggatatacgccaacatccaacaatgcgccaccggcaagcgcgggatcagtgattcgcgccttcgcggtggtggggtaacacaggttcgcatcgatcgcctgtatttcaccaatcgcaccggaggcgagaatcttatcgataatggcgcgggacggcatgtatcgcgtccaaatcgcttccgcgcatagcatgccggtttcttttgcaacggctaacatctcacgggtctgtgccgcattcgcgccgaatgctttctccaccagcacacccttgccggctttcatgcacaatatcgcctgttccgcatgcagattgtgcggcgtagcgatgtacaccaagtccacgttcggatcggccacaagttcctcatatgaaccgtatgaaactggaaaaccgtatttcgcggcgaaatcggccgcacgcaccgcatttcgtgcggcgacagcatacggttccaccaaatccgcataacgaacgtcttcggccattttcaccagcgtgtcagccatatgttgcgcgatccggcctgcgccgagaatcgcgacacgaatacgagccatatcaaaccccatctttcgtaaactgcatgaatagtgttgattcatttatattgctgcgttgcaagttccagcgtacgccatgcatgatcgcaacgcgcgttgatccatatcgcacttgcacgcgttcgtccggatgcttttctgatttgccgtattttgccggatcttgccataatggtgtgctgtggcagcgcaggaacacgttaagaagaccggaaaacctcggaaatccgcaaaaaaagagaaatacgagcgtggcacgagaagctacatcatgtcgcatatccgaggcaaagacacatccattgaaatgatggtacgcagttttcttttttcgaaaggtctgcgattccgcaaaaacgacaagcggtatccgggacatcccgacgtggtgttgccgaaataccgcacgatggtgttcgtcaatggctgcttctggcatatgcatgaaaactgcccgaaagccacgcgcgtgccgaaatcgaatgtggaattctggagtgcgaaactgctgcgcaaccacgaacgagatgtcaggcagcatgccgaacttgaaacgatgggctggaaagtgatcgtggtgtgggaatgcgagctcgccaaaaaagtacgtgaggaacggctggaacggctttatcatgaaatcgtcggcacgcaacctgcttgatcgacatttatgcgatctacttgcaattgcgtgattcttgccgaacatacgtgatgtatgctcgattaatttcttgtttttcttgatttcgaaacggtatgtaacgtcggtgagacgatgcttgtgattcagcgtgatttgtcgtgtctgaagaatacaaacgaactatgggaaatgctgagaacagcgcgctgccgcagatgtcgcaccgcgcccagattgctaatccgttccgtgccatggtgtttggtgcgatggccgacgagatgatcgccgcaggcaccgatgtggtcaagttgagcttgggggagccggatttcggcgctccgctcgcagtgcgtgatgcgatgcgcgaacagtatgatggccgtccattgccatataccgccgcaatgggtttgccggaattgcgtcaggcgatttccgatttctacaaggaacgccaccatgtggacgtcgatccgaaacgtatcgcgattacggccggaggttccacggcactgctgcttgccgccgcattgacggtgaacgagggtgacgaggtgctgatcgccgacccgtcgtacccgtgcaatcgcgaactggttcgcgcgttcggcggcaaagtcgtggacgtgccgacgaatgcgaccacccgattccatctcacaccggaactgtgccacgaatactggtcggatcgcaccaaagcggtgatgatcacctcgccgtcgaacccgaccggtaccaccatcgccttcgacaccctgaaatccgtgtgcgacctggcgaaagaacgcggcgcatggcgtatcgtcgacgaaacctaccttgacctggccgaccgcgaaccggacggctccgacgtgaaatccgtgctcgcctgcgacccggacgccatcgtatgctccagcttctccaagttcttcggcatgaccggctggcgactgggttggatggtcgtgcctgaatgcgcgctcgaagccatggacgatctcgccaccaacttcttcctgtgcgcgcatactcccacccagcatgcggcgctcgcgtgcttcactccggaaacgttggccgtgtgcgaggaacgtcgtcaggagttgctggagcgtcgtcgcattgtggtcgacggattggctgagatcggtctgccgctggaggttgagccgaatggcgcgttctatgcgtacttcaacatttccggcaccggtcttgacgcgtggacgttctgcgaacgtgcgttaaaggaagcgcacgtggcgttgacgccgggccgtgatttcggcgaggccactgccgacacccatgtgcggctttcgtatgcggcctcccgtgaggcgcttcgtgagggtctgaggcgaatcggagatttcgtagccgaactgcacggatgatgtttgtgagcgctttgcaatcgttgtcggcgctgtgaatgttgcgtggccatcctaggtgaataggatggccactcgaatatttgcaaaggttgtcaatgtaatgtcaggtgaaagggggagtgcgatgtcactatgcttgaaatcatggttagtttacattcgcatgtcactcgtcttggcgtgcttgacattggctccaataccgttcacatgctcatcgtcgatgcggcgcctggcgcccgtccggaacctgaggccagcacgaaaagcactgttcgattgatgcaatatctcaaggccgatggcacaatcaaaaaggccggagtcgaagctgtggtcgcagctgtggaaaaggccatggggctggtcaaagaatatgagattacccaactgctcgtgctggccacatccgcattgcgtgaggctccgaatggcagcaggatcctcaaacgaatcgaaaacgtcgtcggccagccggtcacggtgctgtccggtgtggatgaggccagactcaccttccttgcagctcgccgctggtatggttgggatgccggtcggctgctggtcatcgatatcggtggtggctctctcgaggtggctatgggttcggatgaggatcccacagtagcgctgtccgtgccggcaggtgccggtcgtgtgacccgtgaattcctaccggaaaacggtattgcgaatgatagggatttggaagacgcgcgcaggaacatccgtaagattcttgagccgatggtcaaggcgttcccgaaatcgaagcacccgatgcatgccgtcggcacatcgaagaccattcgttccctggctcgtctcgccggtgccgtggtgcgtcagcccggccgcgtggacacttcgatcatgacgattgaccagcttgaggattggcttccccgtcttgcggccatctcgccggaccagcgtaccgcattgccgggcgtcacgccggagcgcacgtatcagatcgtcggtggcggcttggtgatcgacgagatcatgaaggcgcttgacgtcaaggaagtggaaatctgcccatgggcgttgcgggaaggggctattctgcgctggctcgaccagtttggccgcacgagccttggtttctagcggttcctaggcttccagcttcctcagttcctccaactggttcttcgccttgtgcagcttggtgaagatttcgttgcgctgttcgggattctttgcccgttggtgatcgcgcgtgagcttatcgatctgctcggtaagctgtgcggcctgcatacgccgtgtcatgcgcgcgtccagtgccgtgggagaggcgctgccgagcgtcacctgcgagcataacgactcccacagcgcgtcgatggaatcgaccgcaggatcgccgatgtccagcatcgcttcgccggccggtttccaatctgagacgaacactttgaatgtaggtgtgtgaccggcgcgtcccggcagcgcgcgtctcacggcgaacgcgcactcctgccgcttcgtaccttcgaagtcggcgtcgcgcacgcatacgaacacgattcccgacttgcgttgcatggcaatcagctcgacgatatccgtcggtatggcggcgttcttggcatgcaggcgcaatccgattgccagtacttccggaatgcgtgttccgacggcaagccgtgtattgcttggccgcagcagagacaacatggtgatcgtctcgatgtcgttcgccaatcgttgttttgttttggctgaaaccggtattctcgccatgaacaggcctttcggcaacgttgccttttctgcgggaaccgcagaggagttcggcagacccaatgtgagtgcggaaacggaaccgcaggaggcgatcgtcattgctggccttctttcgtgctttcatatcggttattggggcaacagtagtcgcaagagccgcaaattttgataacggcgcgtcggtatgtgactggcgggaatctataaaactgcgcgtggatgatgtctccatgtattgagcaaaagaatgcattttttcggccatcgcgggaaccggtatcggcggatcgttcgtcaagcccgtcacctccagtgtgcaagtcgcctctttggtcaaagccggttgtggcgatccggtcgacgatcggggagcacccaaattcacctcctgtgcggccaacggcgccgactgcacacgtgccgccaccaccgatccgacatccgcgacgcaagtgggatggcgtatcggcgcaagcgcgctctgttcgccatgccgtgcggctgtgatagacgattgcaatctgcgacacgccgtgatttggtgattgaggcatgtgtgcgtattatttcgtcttgcggtgatcagagcctaggtgagacgcccggtcccattccgaacccggaagctaaggcctagcacggcgatggtactgcactcgagagggtgtgggagagtagcacgtcgccgcacttaaacttttttgaatcccgagtcgagcatcgctcctcgggatttttcgttacgtgattcgcccaagtccaattatgacccgattatgtgcgaaggcgaatccagtggtcactgattgcggcgctcaggtagcgaaaaccaccaacagaacaatgccgtttcaataaaaatgacaggtaatggtatgagccaccaccagcctgtggtgccgaattcgttcgcgggcgcaataatccaaggatgcgagcccagccaccccaagaatacggctatggtcgatcccaacgacatggttattcctaaaggtctgaacaaacgcatgagctggaatcgtgatgcaccgaattcttgaagcgtccagcgtaacgctgactgcgattgacgtgttgatatggccaatgcggcgaatgtcaggccgctgataattgtggccaaagctggtatggcaatggcgcgtgccatgtaggagcggtaagaggtggtgtcgtgttcggtaatgaatgcatacccgcaacggttaatgatgtcggatcgaatcgaatcgcgaacgccggaagcgattgacgggaaatcagtaataacgagagtatgccggttgctcggtgcaaggccaagcgtctttgcctgcggtgagtcgattccaagaaccacgccgggcatggtgtaatcattgagcagcgagtcggtgccctcggtgggaacttgtgctgcctgagttattttttgggttgcggtatcgatgagaatgataccagcgttaccgccttcggcaatatgaacgtcgttggttttaccggctaaagacgagttgctatcaacaagcatgacagtggtttcattatcggaatctgagtagcaatccgcatcgtcggaaccatgttgaatgacgcaatcgtaagcatgggaagtcgcggcgcggaccagataccgggattcatccggtgccgtgagcacgatggctttgtctagagtctcgggatatttgccggcaagatagtttaagtcatcctgagtcaaataatcggcgatgaacagcccattatccgaattgcctgtcgctatcatcatttgcccgctgaacaatgagctggcacctaacaataagagtgccaatgcgcatactggggcagacaaacttcgtgtacgttctatcgcattgcattgtgctggcgtgcggaaaagccaaggcagtgaaaggagcataggtcccagagcgcaagcccccatgaccgagcccactgatccaccaaacggccatgcggctgcatgataacgttctatcgccacacaagaaaacagcagaacggccgaggaaagaatgatgtaccataatgcgtttctggttgtgatgtcatgcttaaaggacatgcggaagaacaaaaccaaccatgtcaagcatagcgagcacagcaaaatcgctgcgacaaaaaagatggacagcagggaagttgctgatggttgccattcccaatattgggcgaatatgttgcctatggtcctgtaactaagaccgaataccgcatatccggccgcgatgccaattgcggctccgggtattgtgcaaataagcaatcctcggaacactgtccatctgctggtggtgagggagaatccgcaagctaccagagcttctaccacagcatctccggaacactgacctgctcggaagaatgccgtcattgctgcgatatgtacgcacagcaagcaaaggaacagaactattccgtaccattggcatcctggcagatcgcgagtacgaaccgtttcttcggcatttcgtattgtcgatttgatgtatccgatattgacattgttggttgcgctctcttttgcgacttctccctgatttacagtagcgtcatcgtcggtgagccacatttgtatgttttggagattgtctttggaagacactgctgttgcatacacggtgttggtgttcgcagcatcgacggtgatgccaatgagcttatagtcgcttgataatgcggaatcgtcacattgcacggtgactatatctcccagctgggcgtcaatttgttcagctgcggcccgagacagggagatttcgtttttttgcgacggctgatgcccttcgatgagcgtgccatatcgtgaggggcctgttaggaaagttatgtctgcgatggtgtttcgtgaagagccgctggcggaggtgaggcctactgatccttgtgtggatttgacgccgatggccttaccgttttggacctgttgcctgagttcttcggctacatcgttgctgcctcctgaaatttggtacgtgtaccctccggattgacctgctgcgccttctttggcggcctgtacgtatagattcaagctgtttaaggccaccacgggtagcatcgccgacaataatgccaccacaaagagtgagatggtgagcatcggatggaatctcaaatatccagaggtaacgtgcctcgtgattccagtgctgtggtaaggcattccattcattgctccaccaacttgtggtcctgaatgcgcacaatgcggtcactgtgctgcgcgaccgtagcgtcatgcgttgcgattatgacaatggatcgctctttgtgggcaatatctgaaagcaatgttgcgattgcctgcgtattttcctcatcaagcgcgccggtgggttcatccgcgagaatcacacgtggtttcatggcgatcgcgcgtgcgatggccacacgttgctgctctcctcctgacaattggccagccaaatggtttgcatagcctgctaaatgcacttcttcaagcaagttatcgattgtgttgttttcagcgcgggaagtttccttaatcttggtttgtccgaggttcttatgcgccgcttcaaacgccagcatgatgttttctcgcacgttaagatatggaatgagcctgtaatcctgaaatatgcgcatgcataaagatccgagaagattttttcgatcaatggaattgacatttgcgccatcaatggtgacggagccagtgtctggttgtaaagaaccgtccatcaaacgcagcaaagtggtctttcctgagccggaaggccccattattgccgttgtcgaaccttcttcgaataatgcgctcgcattgtctaaaatcagacgttttccatacgaaaaccccacgtgatcaagttccagcatggtatagccccctctcggtatacatgagcagccattgctcttgcgtaaggcgtcgtacccccattagttacgatttcttatgtgcccagcgtaatagtatttaatggttggggcaagatggtgatttttgtgtttcgattgtttttcgttaaatttatggagacgattgcgactatttgccagcgaatgtggaagttggggtactatgaagccgcactattgccgatggcgttcgtcatgaactcggttttgatggctgatttgatgattgatgtattgactgatggaacgcaatgcccatgttggaggatgtatggcacggtctggtacgcctacgaaaccgcgtacggcgcaggcgaaggctgttaagcctattcgcacgttgaagaaaactaagtcgcatcgcgtgcgcaatatcatatgcggttttctggctggcattctgtcgattgcagctttgctgggcactgtttcgcacatactgcctgctgagattcaggcgtggccgtatgttcccattatcgtttcgttggtgccttggtttgcgattcttgcggtgattgcgctgatttgcggcattgtctcgaaacgaacaatgtcggtattgctggcgattgcggcgatcgcgttgcaagtatggtggcagtatccgtttttctacaatgagacgaagcttccgcgtgccgcgatcgcagcggtttcgggagcgtccgccaatacgcaggatgattatgctcgtttgatgacatgcaatgtgtttaagggtcgtgccgacgcgcaggaaattgtcgatgtggtgcgtagcgagcgtgtggaagtgctggcattgcaagaaacgaccgatgctttcgtggacgagttgaacaaggctggtattggcgatttgctgccgtatgcgcaggtggcaagctcagacggcgtgtatggcaatggtttgtggtcggcgagtccgcttgttgatccggctgatgatgatgttgattcgagcgcgtcgttcatgccaggagccacggttgcattcaatgatggtcggacgcagatccgtttcgtttcggtgcataccacgtctccgaccgatggatattggcagcagtggaagcgttcactggatgagcttggtcgactccggtacgatacgtctcgtaggtacgtgttcatgggcgatttcaacgcgaccgacgaccatacgccgttccgtaatttcttgggaacacggttcacggatgcggccaaacaagcggccgggggattggtattcacgtggcctgcgaatatcgattatgtaccgacgtttgcgggcattgaccatatcgtattggattccggcatgttggcaggtcgggccaaatcgttgaaaatcgatggaagcgatcacaaggcgttgctggcaaccgtgcaattcgatgtgtgagaagagtgtcggcgcaactgcatatcggctgcgtatccgcataaaaagtgccccagataggaatcgaacctacgacaccttctttaggagagaagtgctctatccactgagctactgaggcaacgaatcttcattctacacacattccggacgagtgtggtatcgaaatgaagaaattcgaaatttatgcatgactgtacgctgcatgaagtacgtggcgcacagtcatgtagaaacgatatattggcggtttttgagattttcaggccagattgtcttgcgtgccagcggtattggccgcagtggcctgttccgcctgtgctgcgtcaagcttggcacgcacttcgccgagcagactttgagcgcgcttggcgagggcttcgccaagctcccactggcgcatggactggtcaaggttgagtccgccggcctcaagtgcctgcacggcctgaatgagctgatctcgagcctcttcgtaaggcatttgtgcgatggcttcgcgttccttgtcggtcaggctggatgcgggggtggtttcgttggtcattgctactccttcgttacggtggtgacttcggacacgatcacgccgtgcttcaatgtcatggtgagttggtcgccggtgttcacggcgttcgcatcgtcgattacatggccgtccgctccctgcactaccgcatagcctcggttaagggtggattgcgggctaagcgcggtcagtgaggcgtgcgctttttcgatggtgaggcttgcgtcgtcaagaatacgtgtcaggccgattctcatgcgggttcttgcatcatcgatgagacgctgatgtggttccagcatggtgagcggctgtgtgaggcttggacggttcgcatagccttcaatcagtcttgtttcattgttgacggtggcgtcgatgcgtatgcgcatgcgttcgatgttcacgttgatcagttgcatctgctcgcgcacgtccggcacgactttcttcgccgcgtccgttggcgtggatgcgcgcagatcggcaaccagatcaagcagcgtccaatcatcctcatggccgatcgcggaaatcagcggcgtatgggcggctgccgcggcacgtaccacgccttcgtcggagaacccgatcagatcttcgaaagcgccgccgccacgggccacgatgatcacgtcgacatcaggatcggcatccatctgcgcgatcgccttgatcacgtcggaagggcactgctcaccctgcacatgcacatgcgtcactttgaaatcgacaacaggccaacgcaatctcacgttggtgatgacatcgccttcggcgcgagcctgcggcgcgcaaatcagaccaatgcaatgcggaaactcgggcagaggctgcttgcggtcagcgtcgaacaggccttcgcctttcagtttcttgcgtaattcgtcgatcatggccttcaggctgcctcctgcgccggccgcgataatggcgtcgccacgtaaagacagtgacgtgcgtttcatccacagattcggtttgccatggatgatgacgcggtcgccctgcacgaaaggcgtggcggctgcggcgaactgcccgaaaccgttgacttccaacgcaatgtcctgataatcatcgcgcagagtgatataggcgctgccctgacgtctggtgttgatctgcgtgatctgcccggccacccaaaccgatggccaccgttcgacggccatatggaatttctcgctgagcagacttaccggccaggggttgtcagcagtggtttcgccggccagtcgtggcagcggtttgctgttcggctgcgctgccgggggtgtgtaatcctggttccaagtcatagttcaagattccatcatcttgcggacaaatgaaacacatgttcgaattccgtgagggtaccccgccttgtatagtccctcttcggtgagtgcgtcaaatcgacactcgggcgacactccgtggcgaaatcgttacctttgtcacacaagttaaggaatggcggaatcaagccgaaaaatggaatatatagttttactgccggcgtgccgctactacatttagtgctggctatggcgtacagtcatggacgtagcaacaatctggcatgcataacgaagcatgaaaacctggtcggatggggtccgacccggaaaggatgatgaatggaaacgcaggctctgaatgccatctccgcaaccgttaaaacgggaaccggtaaggtgctcgtcgagaagcgcgacggtcgtgtggtcgacttcgatccgatcaacatcatcagcgcggtgaagtcagccttcgccgaccttgataagaagatcgggccgcaggaggaacagctgatccgtgatatcgccaatcaggtcgaagccgaaatcaaggatcgttacaacggtcccgccaagatcgaagacatccagaatctcgttgagcacggcctgatcgaagaccacctgtacgatgtggcgcgcacgtacaccaactaccgtctgaacaaagacatcgaacgtgccaaggccaccgacatcaacgaagccgtcaagcgtctggtgaaccgtgacgaggctctggtgcgcgagaacgccaacaaggattccaacgtctactccacccagcgcgatctgctggcgggcgcggtgtccaaggcgtccgccttctccatgctgccggacgcggtctccaacgcccacatgaagggtgacatccacttccacgacgccgactactcgccgttcaccgcacaatccaactgctcgctgccgaactactgggatatgctcgccaacggtttcactctcggcaacgcgccgatgggatcgccgaacagcatttccatcgccgccacgcagatcacccagatcatgaaggacgtggcatccagccagtatggtggccagaccgccaaccgtgccgacgagcacttcgtcgaatacgcgcgcaaggattacgacaagttccttgagcaggcccatgagatcatgcctgacgacttgccgatcgaaatcgccgaacgtcaggtgcgcttggccaaggatgtcgaaccgaagcgtctgcatttcgaaaaggaccgtccggccctgccgatggacgagccgttcaacaaggatgccagccgtttgcagcagttgcgtgaggtgtgggcgaagatccagacccgcaaggccatctacgatgccatgcagaccatggaataccagatcaactccaatcgtgtgtcgaatggccagaccccgttcgtgaccgttggcttcggtttgggcactgactggttcgcccgcgagattcagcgtgccatcttcctgaaccgtatccgcggcctcggttccgaacatcacaccgccattttcccgaagctcgtgttcaccatcaagcatggtgtgaacgccgatccgggcgatccgaactacgatttgaagcagctcgccctcgaatgcgccaccaagcgcatgtatccggacgtgatcttctacgagaacatcgtgaagatcaccggctccttcaaagccccgatgggctgccgttccttcttgcagggttggattgatccggcgaccggcaaggacgtggaagacggacgcatgaaccttggcgtcgtcaccgtgaacgttccgcgcatcgcactggaatcccacggcgacaaggatcgcttctggaagatcttcgacgagcgtatggccgtggctcatcaggcattgcaattccgtatcatgcgttgcaagcaggccgcgccggtcaatgcgccgaccctgttccgtttcggagctttcggtcgactcggcgccaacgacagcgtcgaccagctgttccgcaacgaacgtgccaccgtttccttgggctacattggcctgtatgaggcgaccagcgtgttctacggcaagaactggatgcgcgatcacggctgggatccgcaaggcaaggaattcgcactgtccatcgtcaagcgcatgaacgagctgtgcaaggaatggagcgacgcggaaggctaccactattccgtgtactccacgccggccgaatccctcaccgaccgcttcaaccgtatggaccacgagaagttcggcgaagtggaaggcgtgaccgaccacgacttctacaccaactccttccactacccggtctggctgcagccaaccccaatggaaaagctcaactacgagaaggacttcccgtactacgcgtccggcggcttcatcaactactgcgagttcccgtgcctgcagtccaaccccaaggcactcgaagcggtgtgggattacgcctacaacatcggcatcggctacctgggcacgaacacgccgatcgaccgctgctacgattgcggattccaaggcgacttcgagcccactgaggaaggtttcaagtgcccggagtgcggcaactccgacccggaccactgcaacgtgaccaagcgcacctgcggctacttgggcaacccggtgcagcgcccgatggtgcatggacgtcacgaggagatcgcgcaccgcgtcaagcatatgagcggcgaaaccggtcatgtcaccttgagtgacggttccgaacgtgaatggttcgaggaagccaagtaagggccgcgtcggtagcaaacataaacgaaatatgaaagagggtgggtttccaccctctttcattctgtgacaatcatgaggcaagcagcaatcgcaaaaacgcgacgtaacggcaaaacgtgaagggacaacgtatgatcagcagcgcgaatccagcaattcaacgtcgtgactttgcggcggacgaaaccaatcgcggacctttcattcccacaactcgttccaacaatcccaaagcagggcaatggaccaaccgcatgagccgcaatatgatcgccgactacaaacggttcctcatgaccgatggagaaggcatccgatgctcgctgtacgtgtccggctgcccgttccattgcgaggaatgctacaacacgtcaatctgggatttccaagccggccacgaatacagcgacaagctcgaagcgcaaatcatggatgacttaagccaatcgtatgtgcaaggcatcaccttcctcggaggcgaaccattgctcaacacgggcgtgctgttgccccttgcgcgcaaaatacgcgaacggttcggtaataccaaagatatttggtgctggaccggctacacgtgggaagagctcatgcgcgaaggcgaaagccccgacaagcgcgagctgctcgaactgatcgacattctcgtggatggccgttatatcaaagaattacatgattccctgctgcaattccgcggaagcagcaaccaacgcatcatcgacgtgccgaaatcactggaaagcggacaagtggtgatctggtcgaaactacatgatcaaacacgattcattcccgaaatatacggcaaagaccgttctgcaggggaaggcagcgcatcctgacatggaaatgcttggaagggtttgcgatctcgacattcgtcgagcgtccagatacataattaggcacgttgactggattagttgtctagtttatgcgctgtgtcgtgccttttatgctgattgcgagcactcacgaagcgcttaggcgtgggcacagactacgattacatgattggataaccggggtaggggcttccatgcctgccatggaatgcagcccggcggatagaacgatagaggttgatacatggttgaagcagcagaagccgtgaccgaaacgcacggcacaaagccgttgcgtgtaggtcttgatatcggttccactactgtgaaggcggtggtgctcgatcagtccgacgcgctcgcggacgcgctgttctccgattatcggcgtcaccacgcgaatgtgcgcgccaccgtggccggactactggccgacatccacaaagaattggaaaagcttggccgaggcgacgagccgattcgtctggccattaccggttcaggcggtcttgctcttgcagacagcctcgacgtgcccttcgttcaggaggtcatcgccgaaaccgaagccattgacaaggaatatccgcaggctgatgtgatcatcgagcttggtggtgaagacgcaaaaatcacctatctcaagccgactccggaacagcgcatgaacggttcctgcgcaggcggtaccggcgcattcatcgaccagatggcaacactgctcgacaccgacgccgctggtctgaacgaaatggccgcgcaatacgaaaccctgtatccgatcgcatcacgttgcggcgtgttcgccaaaaccgatttgcagccgcttatcaacgatggcgcggccaaaccggatctggccgcatcgatcttcaccgcagtggccacgcaaaccattgcaggccttgcctccggacgcccgattcatggaaccgtgatcttcctggggggtccgttgttcttcatgtccgagctgcgagccgcgttcaagcgggcgctcgacggcaaagtggacgaattcattgttccgaccgatgctcacctgtatgtggcatacggtgccgcattgcaggccgatcaggatggtgacgaccttgactaagcattacgaagcacgaacctgcgccgacctgctggcgcgactggacgaactggaaaacctgccgtccaacactccgaccatgcctccgctgttcgctaccgaagcggatcgcaccgcattcaacgaacgacatcatcgcgagcatatccatcaaggcacgctcgaaggagcccaaggaccgcacttcctgggcatcgacgccggttccaccaccatcaaagcgacattggtgaacgacgatcgagaaattgtatggtcctcttatgcgaccaacgaaggcagtccgttgacggcagccgtgcagatcgttaaaaaaatccaagccgaactacccgaaggcgcatggatcgcacgatcctgtgcgaccggctacggcgaaggcctcatcaccaccggcctgcaccttgacgaaggtgtagtggaaaccatggctcactatcgcggtgccgaaatggtaagcccgggagtcaccgccgtcattgatatcggcggccaagacatgaaatatctcgccatcaacgatggtgtgatcgactccatcgcagtgaacgaagcatgctcgtccggctgcggttcgttcctgcaaacgttcgccatttccatgggcctgaccattcaggaattcacccaagcggcgcttaactccacccatccggtcgatttgggctcccggtgcaccgtgttcatgaactcgtccgtgaagcaggcgcaaaaggaaggcgcgtccatcgaagatatcgccgcaggcctgtgctattccgtggtgcgcaatgccctctacaaggtgatcaaactgcgtgattccggcgaacttggcgacaccgtggtagtgcagggcggcacgttcctcaacgacgctgtgctccgcgcattcgaactgctcacagaacgtgaagtgacccgaccgaacatcgcaggactcatgggcgcatacggtgccgcactgaccgcacgcatgcactatgccgacgaagcggaagacgaagacgtcgataccaccgacaccaaagaagcggtgattgcagacgtacgtcataccgcatcgaacattttgagcggcgaagaacttgacaacctgtcgatgacctccgaacgagacgtgtgcaagctgtgccaaaaccactgcaagctcaccatcaccaccttccaagacggatcccgttacgtgaccggcaaccgctgcgaacgaggcggagacgcgaaaaagaagcgttccgatcgcccgaacctctacgattacaagtacaagcgttgcttcgcctaccgcagactcaccgacaaaaacgcaacccgcggtgaaatcggcattccgcgcgtactcaacatgtacgagaactatccgttctggttcacactgctcacctcgctcggcttcaaagtgatgatttccggacgaagctcgcacgaactgttcgaaacgggcattgaatccatcgcatccgaaaacatttgctatccggccaaacttgtgcacggacacatcaaatggctgctgaacaagggtgtgaaaaacatcttctacccgtgcgtcagctacgaagagaacctggtacccaacaccgacaaccactacaactgcccggtggtagccaactatcccgtggtcatcggcgcgaacatgcccgaactgcgtgcagaaggcatccgctacatgcgcccatacttcaacatggccaaccatgaacttatggtcgaccgtatcgtcgaagaattcgcttgggccaacgtgacccgtgaagaagccaaaaccgcagtcaaagcggcatatgccgaaaacgaagtcttcaaacacgacgtgcaaatggaaggcctcaaggcactcgcctacatgaaggaacacgactgccgaggcatcgtgcttgcaggccgcccgtaccatatcgatccggaagtcaaccatggcattccggaaaccatatgctcgctcggtatggtggtattatctgaagattcgatctgcgaactgcagccgggggagaagctcaacctgagcgaattcctcgccgccgatgaagacgatccacgtaagaagaatgcagacggcttccgccatgtggaagaccgcaaggtcaccaaaatgccattgcgcgtcaccaaccagtgggcctaccatgcacgcctatactcggcagccaatttcgtggcctcctacccagggcttgaactcgtacaactcaactccttcggctgcggtcttgacgccatcaccaccgaccaggtaggcgaaatcctcgccgacaaggccgacgtgtacaccatgctgaaaatcgacgaagtctccaacctaggcgcagcgaaaatccgccttcgttcactcaaggcagccgtcgaagagcgtgaacgcaacaaacagcgtgaaatcggcacagccacgcccgacaagcgagacagcgtgtccaacaagcagggcgaattccgcaaaaccggaaccgaagcgccgactccgggccgtcaagtcatgcttgacactgtgatgaaagccaatccgaaactcaccgaagccgttaaagctgcatccaagcgtgccgcggaaaacggcgtcgacgaagcgaagaagtccgcacacaattccgccaccatgtcgaaatacgccaaccgcgtgccattcggcaaagacatgaaggactacaccatcgtggctccgcagatgagcccgattcacttctccctagtggaatccgtgatccgctccggcggctacaagttcgacattctcgaacacgccagccgcgaaaacgtggaaaccggcctcaaatacgtcaacaacgacgcctgctacccggccatcatggttatcggccagctcgtggacgcgattctggacggcaaatacgatccggagcacaccgcgctcgccatcacgcagactggcggcatgtgccgagccacaaactatttcggtctgattcgcaaggcgctgatcgatgccggatatccgcaaattccagtgatcgccatttccacgcagggtattgaagacaatccgggcttcaaagcgacgccggcattgcttcatcgcgtcatcaaggcgcttatcatcggcgacctgctgatgaaatgcctgtaccgcgtgcgcccgtacgaggtgacgccgggcagtgcgaatcagctgtacaagacatggaacaccatcgtgcgtgaaacgctcgagaaccacggtcgctcgaagacggcaagtaagttcattggcaagggatacctgccatattcgacgctcgtcaaagaaatcgtcaaatcgttcgactcactgccgttgaaggacgaaccgcgcaaggtgcgcgtcggcgtggtgggcgagattctcgtcaagtaccagccggacgccaacaaccatgtggtcgacgtgatcgaatcgcagaattgcgaggctgtggtgccgggcatcatggaattcatgaccacccgcccgtacatttccgactggaacgagcattacctcggcatgggcggcaacaagcttggctacgcgctgatgcgcaaggcgcttgacttgtataacgctcctgtacgcaaggcgatcgatttggcgcacggcaagttctcccaggacttgccgatgccggaactcgtgaagaaggccgacgaggtcacttccgtgggcgtgcaggctggtgaaggctggctgctaactgcggaaatccttgagctcatcgaatccggctgcccgaacgtgatttgtgcgcagccgttcgcttgcctgccgaaccacgtgaccggtcgaggcatgttcggcaagattcgccgcctgcatccggaagccaacatcgtgtccatcgactacgatccgggcgcatccgaagcgaaccagctcaaccgcatcaaactgatgatcgcagccgccaagaaggctcacaaggctgcgtaacagggtgagacggtgcaaagcgaaaaagccgcctgatcataggcggataaatcaataagcactgactggaattgactaaaataccgacgctgacaacatcttcagcgtcggtatttttatttgatttatacaaacaattcttcaaataacggtaattgcttctgactttattaatagctgttaattattattggtcggctttgcagagcatgtctgttgtaaccgaaaatgtgtattcgattcgatatacgcaagagttggctatcagtttttcgtatagcaatcacgccgtgctcatcaacgagtttcgataggattgccacatgacaacgccacgaatttcttatgcgcacctgcttaccgagccgaatccgaagcatgtggaaagtctggtcaaattcttcgaatcaggctgccaagagcgtggaaccggtggtttcggtgtggaaatcgagcatctgccggtgcataacagcgatgataccgccgtgaactattacgaggagaacggtaccgaggcgttgctgaaccgcattcgcccatattacgacgaaagcaaggaatactgggagaacggcaggcttgttggtcttggccgcgaaggtatttccgtgtcacttgagccgggcggtcagctggaatgctcgctgggtatactgcacaagccggaagatctgtgcacgatttacggtgcgttccgccgcgaagtcgatcccgtgcttgacgatctcggcttccgcttggttaattacgggtatcagccgaagtccggctatgccgacattcccgtcaatccgaaggaccgttacaaggcgatgaccgcgtatttggggcgcgtcggccagttcggtccgtgcatgatgcgttgctccgcttcgacgcaggtcagcatcgactatgtttccgaacaggacgcgatttccaaactgcgtttgggtacggtggtcggcccgattctcgcatggttcttccgtaacaccccgtatttcgagggacaggagaatccgtatccgctgctgcgccaacgcatgtgggattatttggatttgcagcgcacgaacgttattccgggattgtttgatcctcgcttcggttgggaagattatgcggtcgacgtgttgagcacgccgatgatgttcgctgatctgacgcacactccggaagcgttagaaactcccggaactgatctgcatcatcctgcgttctatgagaatgcgaacgacgtgtatcccgatcgagaactcaacgcatacgaaatcaatcatgtgatttccacgcatttcaacgatgtccgtctgaagaacttcattgaattccgtcactgggattcgctgccggtagcgcgtgcggaacgactgacggaaatcatcggatcgctgttctatgatccgacgaaccgtgagcgtctcgaatcgtatttcgatggcatccgcgaggaggatgtgttcgaggcgaaggcgaacctgcaggcgcgcggccatcaggcagctccgtacggcaattcgctggaattctggcaggagttcctcgggctcgagggtgtcctcgccgacgaacctggcgatccgaaacaccctgacgtgttccagaagtaaaactgcttttcgaatattttggttggtcgaggctgactgaatgtgatctcgaagtggttttgaatgtaatttcgagctggtctgttgaagatcggctcgtttttgtgtggcgagtggaaatgcaacggtctgatacagattttgtctgtctaatgaacggtagatagtacactgttccttatgggtaatgaggggaagaaacgtgttcgtaaatcacctgaggaacgtaagaaggaaatcatcgctgcggcgagccgtcttatcggggaaaaggggtattacggaacgtcattgaaagacattgctgatgcgatcggcatgagccagcctggactgctgcattacatcggcaataaggaacggttgttgtcgctgctagtcaccgacaattatgatcaggaaggcactccggctgattttgcaaaatccggattgccgggcagcgatccggaaggcatgttgtttcccgcatacctgcgttttttggtacgttacaatgagagtcgacgtagcttgctgcagctatacatggtgctggaaaccgaatctttcagcgagggccatccgttgcacgactatttcgagaatcgtccgaaatacgtgtgggaacactattcccagtacacatggaaattgccgcctgaaatcggtggttgggagaatatgcgtgcgattgtgcgtcaaagcttggaagcgatggacggcattcaactgcgttggacgcgtaagccgcccatcgatttctacgatgaatggctcgccttcgaaaagatgatcttcccctcacctgtctgggacggctaccgctaagccatgtccaactctcttgcaggctgtgtttctatagcctttcgcgtcccaattcttccactcgctggaagaatcaggacttttggaaggttttgggcggggtgattcctccagtggctggatggatttgcctgctgggatagcattttgcgtggcgtgcggtgattggttggttttagttaaggggaaacgctgtatctaatggttgttaggtaagacacgccatgaaattttgcggttcttgacaactgaatctggaagatttatatttctcatatctaatggctgttagatatgagagttccgaggatgcatcccaaggatatatcccagagataccgcagaagaacagccttagacgcagaaacagtagcaatcagtaacaagtcaatgaagacgatggaggatccatggggcgttacgaggcagatcacattcttttcggtgccgcatattacgacgaatacctcatgatgaaaggcatcgaccgcgtcgatgaagacatgaggatgatgaaggagtcgggactgaacgttatccgtattgccgaatccacatggagcacctgcgaaccgcagccgggtgcgttcgacttcacctatgtggatcgtgctctcgacgcggcacagcgtgtcggtatcgacgtcatcgtcggcactccaacctacgcggtgccgagctggctcgtcaagatcgatccgagcgtgctcgcggtcaccccgaacggcgaaggcaagtacggcgcccgccagatcatggacatcgtcaacgccacctatcgtttctacggtgagcgcgtgatccgcaagctgatttcccacgttgccgaccatccggcggtgatcggctaccaggtcgataatgaaaccaagtactacgattccgtgtccaacgacatgcagcgtctgttcgtcaagtatctgcgcgagaagttccacggcgatctgaacgagctcaaccaccacttcggcctcgactactggtccaaccgcatcgactcctgggaggacttcccggacgtgaccgccaccatcaacgagtccctgggcggcgaattcgacaagttccgccgcgatcaggtgcgcgccttcctgcagtggcaggccgacatcgtgcgcgaatacgcgcatgacgaccagttcatcacccacaacttcgatttcgaatggcgcggatactcctacggcgtgcagccggccgtcgaccacttcaaggccgcgaccgcggtggacatcaccggcgtggacatctaccacccgaccgaagacgacctgaccggcaaggagatcgccttcggcggcgacatgacccgctccaccaagaacggccagaactacctggtgctcgaaaccgaggcccaaggccagcacggctgggtgccattccccggccagctgcgcctgcaggcctactcccatctcgcctccggcgccgacatggtggaatactggcactggcactccatccataattcctttgaaacatattggaagggcctgctgagccacgacctcgaaccgaaccccacgtaccgcgaagccggcgtattcggtcgcgagattgccaaaccggaagtgggggagcggctcgtccacctgaagaagcacaacaaggtagctatcatggtcagcaacgaatcgctgaccgcgctcgactggttcctcatcgaagccggcttcccattcggcggcaccctcaaatacaacgacgtggtgcgcaatgtctacgacgcgctgttcgagctcaacgtggaatgcgatttcatcccctccgacgctcccgccgagcgtttggcctcatacgagatgattgtgaccccggcgctgtactgtgctccgcaggaaacgaccgatcgcctgcgtgaattcgtctccaacggcggacacctcgtctccaccatgcgctccttcgtgaccgacgacgaggtgaccgtatggcacgaccgcgcgccgcacaatctcaccgacgtgttcggcatgacgtacaaccagttcacccgcccaaacggccacgtttccgtggaattcgcaggtgcgctcgccgaaaccgcgtccaccgatgctcagtcgctgatcgaactgttgaacgccgacgccgatactgaggtgctcgcatcttatggacactacgcttggaaggattacgccgcagtcacccgtcacgcattcggcaagggcgatgccgagtgggtcgccacactgcttgacgccgattccattcgtgcggttatgcgagaggctgtggagcatgccggcgtcgagggcgctggaaccgcgctcgcgggacaggtcgcggttcgccagggtgtgaatgccctcggcgagaacgtgacgtatttgctcaactattccgccgacgaagttactgttgcaagcccgattgcgggtgaagtagtggtcgctccggtcgtcatcgccaccgacggcagtattgatgaggttgcaaatactgaagtcgtgctgaaggaaggtgcagccgttaagcagggtgatccgttgacgattggccgctggaatgttgcggtgatcgccggctgaaatctgcgataagagaactcgagaagagaacgtttagggaatgagaaggtcgatcagggccttccattctccaacgaaatcgatatcgtgagatccgttgagccaccgcaattgcaagccttccatggcggatagcacctgcagtgcggtgcgttccggatcggcgacgccatctcgtttggctgcgaacgtgtattccttcagcagattgatttcgcgctgttcgaaatactcgtgcaccggatggtctttgcttagggcctcgctttcgagcagggtgtagaggcgaaccatttcgggtcggcctgcgttggtttccacggttcccgtggagatggccttgagtccgagatcgcaatggtatgcgatgccgtcttgcaagacttcgccggtcacgccttcgacgccaagatgctctgcaatggcgatttggttagtgcgatcggcgtatttgagtgtcgcttcaaggagttgttctttggatttgaagtagtaaaggagtcctgcttcggtgatgttctgagcttgtgccacgtcgcgaatggtaaatccccagaatccgaattgtgagatgaaagagaccgtggtttcgagaatcgctttcttgcggtcttctgcgctcattcgtttcttggttttgctttcgatgtggcgacgcatgcgttctcctctcttgtgcttactaagttacaagaagggggagaggaagtgtgttggaaacgttggggcacgccggaaaatgacagatacaagagattgtaatatgctttaactaagcagttactaagtaataaaaactgaagttgccgtatggggcgaatcgttgtggattgctatttgaaaacgctgccgtcggaaaaattcgcgtctgacttgcgttctttcgaaaaggcatctatgatgaaaaccggctagttaccaaatggtagttagctggctgggcagagaagccctatcggaaaacaggaatatcacagaaaacactactgaaacatgaatcgaaggagagagtttcatgagtgaagcaatcgcaagcaaagaggagcgtttggtgcgttataacgccaacatcgccgctgcagacaaggatccgcagctgtctcctgaaaccggcaagccactgagcaaggtcaacaccatccgtttcggtgcgggcttcctgctgttcggcgtgctgtggatgtcgggccttggcatcgtctccgccgtgctgctgccgatgcactacaagaccatcgaaggtgccgatccggacgctctcgttggcatcgtcaatgcgttcaccgcggtggcatccttggttgccaacctgatgttcggcaacttctccgatcgttcccgctccaggttcggtcgtcgtactccgtggatcgttttcggcgcggtgctcggtggcgtcaccctgttcctgaccggcaccacgcacaacgcggtgctgctcaccatcttctactgcgcctgcatgttcggcctcaactgcatgattgccccgctggtcgccgtgctgtctgaccgcgtgccgtctggcatccgcggcaccatgtccgccttctatggcgcaggctccaccatcggtactccgatcggcaccatgatcggcgcattcttcatcgaaaacctgactgccggcttcgctgtcgcaggcgtgctcatgttcctcggcggtatcgtcgccgtgatcatcctgccgaaggaacagtccgctgacttcctgccgaaggaagagggctccttcaaggacgtcctcgtatccttccgtccgccgaagttcgctggcgcccacgacttctacaaggctttcgccggccgtttctgcatgctcatgagctaccagatgatcaacgtctaccagctctacatcatccagaactacattggtcagtccgtcaaggaatccgctgtcaccgtgtctgtcgttgccatgctcatgatggtcatgtctctggtcggctccttcatctccggcccggtttccgatctcatcggccgtcgtaaggctccggttgtcgtggcttccgtgctcttcgctatcggtatcgccatgccgtggctgatcccgtccaccctgggcatgtacctgttcgctggcatcgctggcctcggctacgctgtctactccgcggtcgatcaggctctgctcgttgatgtgctgccgaacaaggaagaggctggcaaggatctgggcattctgaacatgggcaccacccttggtcagatgtgcggcccggtcatcatgtccaccatcgtggtgtccctcggctacaacttcgccttcccgaccgccatcgccttggccatcatcggctgcttcttcatcatggccatcaagaaggtcaagtaaccccatcccttccccctcccctcaatttcgaaagaggagaggaagagaggtaataggaagttttccaaaactgaacaacaatgcaaaactaaataacagtgcaaacgtaacgtcatagcgttacgagcaggatgccgcgataatctgtttaagaccgtaaagacttggctagagcggcctggagcgtgtcgtgaatagattatcgcggcatcctgcggtttttgcgcttactgaaatgaaattgcgttgccgataattcaatctcaataattcaatctcaaaaactaaatatcgataactaaatcccaataatcaaataaaaacaactcaaaaaaacgaataaatataaatccaaagaatcagcgacaatactaaggactttccatgactacttggatcgcgacaacgcaagacaacaagcttgccgacaaatcatccgaaattgaatccacgcatgccacttccgcttccgatctgcagcttgatggcaatgaatatcaggcattgcgtggcttcggcggctgcttcaacgagcttggctggcttcctctgcagacggttactgaagaggaacgtgatcagatcatcaaggaactgttcagcccggatgagatgaacttcaccttcaatcgtgcgccggtcggtgccaatgatttcgccgatcattggtatagctataacgagaccgacggcgattatgagatggagcatttctccgtcgagcatgatgagcagacgctgattccgtatattcatcgcgcgcaggaatggcagccgaacatgcaactgttctccagcccgtggagcccgccgacatggatgaagcgcccgaaggcctacaactacggacgtctcgtgcagaccccggagaacctcaaagcctacgccaagtacttcgtcaaatacattcaggcctacgccgagcatggcatcaccgtgaatcagctgcacgtgcagaacgaggtgttcgccgaccagaagttcccgagcgccctgtgggattccgaagcgctcaaggtgttcatccgcgattacctcgggccggcattcgacgaggccgggctcagcaccgacatttggctgggaacgctcaacgggccggaggacatggcctggacgggcggcggttacggcatgaagctgaataattacaaccgttttgtcgacaatattctgttcgacgatggcgctcgcaagtacatcaagggcatcgcttaccagtgggccggccagaactgtattgcgcgtacgcatgaatcctggcctgaaatcgagttgattcagtctgaatccgaatgcggtatgggcgataatacgtgggaatatgcggagtatattttccacttgatcaaccattatttgcgtaatggcgcgactgcttacacttattggaatatgattcttgacgatcaggattctacgtgggggtggtggcagaattcactgttcaccattactgcggatacgcatgaggttcgccgtaatccggaatattatgtgatgcgtcatttctcgcatttcgtcaagccgggtgcgcatgtgcttggcactacgggtcatttcaattcgatggctattgcgttccgtaatccggatggcaccattgtggtggtggcccagaacgctctcgaagaggagcgtccgtttgaatttgccgatccttgcaatgccgatcgcggtatcaaggtgacgcttgctccgcgttcgttcaacacgtttgtgctggactgacgggagctgcctggctgatgcgaatgtgtgcgtaacgcgtcggcttggttgtggcagcggtttgttgaatgccggatggcaggtttcccttctcttcctgccatcttcgcaagccggtgttgtgttgcggggcgtttgcctatggtgatcggttaccggtcgccgcaggcaaacgcctttttgcttttgcggtgtctttgcttgtttgcgctctgttcagcggtagccgtcccatgtgggggaggggaacaggatgcgttctgcgcgttcccatagttgcatcatggattcgttgggattggttaacgactggatttgcacgccgtccatggcaaagaacgcggtgacgatgaggtcatgcaggcgttctggatcgcggtattcttccggtagttcccagtccacgctggtcatgtcgatcaaaatcgaattgtgtctgttctggtagaactcgtgggctgggtgttctggatcggacgcttcgatggcgaggcgcatgaacagtgcgacaagttcgggacgtttggcgttgaagcgcacggtttcgtgcaatgtgccgggcagatgtcggcgttctttggttgctgaatctgtttggtcgcagtggctgatggctgcgcccaatgtcgtgtgggcattgccttcttcggagtcgtagaacgtttcgatgaccaatgagagtaattcttctcggtttttgacgtaatggttgagtccgggcagggtcatgccaactgcatcggctaatgcttgcattgggaagccgtatgacccgtattgcgtgattagggttaccgcttcttgtgtgatttgttttcgtcgctgcgctggggagagtcgttttctttggttgattggacggctcttgatgctgtttgctgatgtgttttcctgtgattccatactgatttgaagaatactattgccgctgtccacatgcgttttcatgtggtttcgatattgcggttatgcggttgattgctgtgcttgaaagtaggtcgttgttcgacacgccgatttgttatcttatatctttaagatataagataactgacgaagccgatgagagttgacttcaacacaacgcctctcttgcctgttgtttgcatgatcattgaagattcggcaaaaaaacgtagagggctgactttgaaaaagaaagataaggagacaagcatgactgacgtacggcctgcggagcatgccaacgagctttccaaaatcgacaaaacgcgtttctgcgtagcgttcttcgtgttctcgttcgcatggatgctggcgttacagatcgttgctgcagtgctgctgccgcagcgtttgactgatatcgcgcccgacagcaaagacgccattttcggcgtgctgaattcggccacggcattggcttcgctgatttccaacctcgtggttggcaacatgtctgaccgtacgcgctcgatcttcggacgtcgtacgccatggatcgcatcgggcggcattgttgcgggcatttcgctgttcctcatcggcattctgccggacggtgtgagcattggcatcagctactgcatttccatggttggtctgaacatgatgatcgcaccggtcatcgcatctctgtctgaccgtattcctgaagatatgcgcggcaccatgtccgcatttatctctgcaggtacgttgttcggttctgctcttggtcagattgttggtgcgcagttcatcaccctgcagctcccgggcttcatcgtgtccggtgtggctatgggtctttccggtgtgcttgccgtggtcttctggccgaaggaaaagtccagcaaggatatgcctaaggaaaaggttgatttcaagggtattatcatgagcttccgtccgccgaccaaaggcgctcgcgacttctggctggcatttatcggccgttccctgctgctgttcagctactacatgattctcaactaccagctgtatattctgcaggactacattggtcaaagtgttgaagattccgcggccaccatttctaccatgagcttggtgctgatggttgtctccctgatttccgcgctttccgcaggtccgatttccgacaaaatcggtcgccgtaagattccggttgtggccgcaagcgtgctgctcgccatcggttatgctctgccatggctcatgcacaacgcgttgggcatgattctcttctccgccatcggtggcttcggctacggcatgtacggttccgtcgatcaggcgctcaatgttgacgttctgccgaatgaagaagaggccgggaaggatctgggcattttgaacattgccactactctcggtcagatggtcggcccgattgtcacctccgccattgtggtagctaccggctcgtacggactggtgttcccgacggcaatcattatggtggcgctcgcctgcatcttcattctgatgattaaaaaggtgaagtagcgtcggcgcttttcgaaataacttggccggagattctttcattatctctcctggaatcttcggccatttcgcatatattgtgcggcacaataactacaagaaccatacgaattacgaacgttgcagatgtgagcactacggcaaaaggagcaaaccatggttgtctgcattgacccgaacagtacgattggtcgtatcgatccgaaactgcatggccaattcattgaattccttggcgaatgcattgatgaaggtctatgggtgggagaggattccccgatcgaaaacgagcgtggctaccgcaaggccacattggatgctttgcgtgcattgcagccgccggttattcgctggccgggcggatgctatgcggatacctaccattggcgtgacggtgtgggcccgcaaagcgaacgtaaaaccactttcaacgagaatttcgccacctatgagctggacgatcacagcttcggcaccgacgaattcctgcgtttgtgtgaaatgctcggcgctgaaccgtggatcaatatcaacatgctttccggcacagtcgccgaaatgaaggattggatggagtactgcaatcgtgcgcagcccactgatcttgccaaggaacgtgaggctaacggccataaggcaccttacggggtgaaatattgggggatcggcaacgaagtgtgggctggcggcggtaccatgactccgcggacctacctcaatgaataccgcaggttcgcatccgccatgccgagcttcaccaccgatgtgttcgcgccgaccccaatgtatgctattgcgagtggtcctgacggcaacaagccgcgcgaacgcgtgcagtggacccaggatttcttccgtggtcttgccgaatatcgtcagccgaatatcgacggctatgatctgcacttctacaattggaatgtggacaacgatgccgacactcccacccggttcgatgaagacggctggaatgcggtgattgagggatgcctcgaacttgaagatattctgcgtgatcagtggcgtttgatgaatgacggcctggcgcttattcatgagccggaggtggctatggattccaagctcgcgcatgtcgatctaatcatcggcgaatggggcaattggcacaagaccgcattcttcgcacgccctgcgctcaagcagcaggtgaccatgcgtgacgccatcaccaccgcgcttacgttggatctgctgcagcgtaattgcgacaaggtgaccatggcgtgtaacgcgcagaccatcaatgtgcttaactcactgatcttgactgaaggcgatcggaccatccttacgcctaactacgatgtgttcatgatgtataaggcgcatcgtggcatgaccgcacttgatgtggcgcgtaacgattccgaggattctgccgtgtatacgtttgcgtcacgtaatgaggatggcacgcagctgctgattaatctcaccaatgcgcatatgaacgatggtgccgaagtgcggctgcatttgccgtgcggcgctcaggttgattcgatggaaacgcttgcttccgaagatccgcatgattgcaacacagtggagcattcggatctggtgcgcactcatgccgtggacgtggatagtgccgtgagcgtgcacgaatctgccggcggtgccgagctgacggtaacgttgcccgctgcctcggtgagtgccttgcacgtaacgattcgccagcgataagcagtaatcgtctctccggctgcaggttgcctctttcttcccgcaagaaagaggctttttcttatgattaatcgcatgattctgtgaaattgctgcacgattttgattgtcggtcccacgattttcgcaaagggtgctttatgcgaaatagtgcgacagcggttcggagagatgtccgagacgagttgcggggaggagaaaaatgtactatcatctaacttagtaattactaagtaataaaaaatatgattgaaagcgtacgaaggagtgcatatggaccttaattacatcaagggcgtgaacctgggtaactggctggttctggaaaagtggatgaacccggcattattcgatggaaccactgccgatgacgaatactatctgccgacgcaacttgatccggccgtctacgaggcccgtatcaggacccaccgcgccgaatacatcaacgagcgcgacttcgccaccatcaaatcgtggggactgaactccgtgcgcatccccgtgccgtacttcatcttcggcgaccgcgcgccgttcatcggctgcatcgacgaactcgacaaggccttcaactgggccgagaaatacggcctgaccatccttatcgatctgcacaccgcaccgatgagccaaaacggcttcgacaacggcggcatctccggcgtgtgcaagtgggcgcagctgcccgacgaagtcgaattcgtgctgtccgtgctcgaacgcctctccaagcggtacggccatcgtcgggcgctgatgggcatcgaaatcatcaacgagccgaacaccaccacctgctggccgatggcgaacgtgaccgaacgctacaaggcggtcgatccggaactcgccgaaggcaccggcccgatcgcattcgactggctcaagaacttctacatcaccgcctaccaccgtctgcgcgacgctgacaagggcgcgttgccgaccgacaaagtcgtggtgttccacgacggtttcgacatcgaacagtggaaggacttcatgcgcggccccgacggcaagctcgcgcccgagtttaagaacgtggtcctcgatacccaccaatacctcatgaccgccgaaacgatgggttgcccgcagacagcggagggctacgacgacttcgtgaggaatacctatgcgccgatgatcgccgagatgagcgaatacttcccggtgattgtgggggagtggtgcctgttcaactccgtcggctgcggtgtggacacccacggcggccaaagcgtgctcaacggcgaggaaggggctcaggtcgaaaccctgaccgccgaacagaagcgctcgctgtaccggggcctagccgaatcccagctcgccgcatggagcaagggcagcggcttctactactggaactacaagctgctcactgacactgtcaacactcccggctggatcggctgggacgcatgggaccttggacgctgcatcgcccaaaactggttccccgtccaaaagtgattccgtcggacgcaagaatcgtacaaagcaacgcgtgatatcaagaacattaaggaacgacaatgctgcataatccgatcttcaaaggcttcaatcctgatccggccatctgccgtaaaggcgacgactactatgttgctgtctctacattcgaatggttcccgggtattccgatttaccattcgaaggatatgaagcattgggagctgctcacccacgtgcttactgatgatacgaagccgaacctcaccaagctgccgagcgctaagggcatttgggctccatgtctcacgtattgtgaggaagaggacatgttttacgtgatttacggcgttatgaactccatgaatgcacgctatttcgacgtgaataattatctgattaagtcaaagagcattgaaggtccgtggagcgagccggtatatctgacatcttctggtttcgacgcgtccattttacatgatgacaatggcaagaagtacatcgtcagcttggagtgggagacccgtgaaggctatgagaagccgggcgtgatctgctgtgtggaatatgatccggaaaccaagcatgtggttggctatccgaagcgtatatggcgtggcgctactgatcgtggctgcattgaggctccgcatctgaccaagcgtgacggctggtattacattatgtgcgccgagggtggcactggctacaaccatgccgtgaccatgggccgttcccgcaatgtgtggggtccgtatgagccggatccgaatggtccgctcgtcacttcgcagccgaaggagtcaaacgagcgtgctgatgacgatcatttgaagccgcgctatttcaacccggattccgtgctgcagaagtccgggcacggctcctacgtggatctgccgaacggcgagacatatcttgtgcacctgaccagccgtccgtttgtgccggaattacgttgtacgcttggccgtgaaaccgccattcagaagatgacatggacgaatgacggctggctgcgcatggcggacggctccaatctggccaaactcgaagtcgaagagccggatctgccggatgcgccgatgccggagattcccgggcacgacgacttcgacggcggcgcgatcggcaactggtattattcgccgcggcagatgccgaccaccttcgccaacgtgacggaacgccccggttggctgcgcatccgcggcgaggaatcgttggcatcgctcaaccgcacgagcctgatcgcacgcaaactcaccagcgtgtacgccaccgtcaccacgaagatggagttcgagccggaagtctaccagcacagcgctggcttgaccatctactacgacaacatgaataatattttcctgcgcaagtattattcacagacgcttggcggcagcgcgatttcgattgtgcgtctcgaaaacggtgaaaagacggaaatgcttgacactcgcgttgctgtggaagacaagccgatctatttccgtttgaatatcgaaggtcgtcgtacttggttcgagtggggttatgatggcgagaactggaccaagattggcccggatttcgacactaccaccttctctgacgaatactgcaagtacggcgaattcaccggcactatggtcggcatcgccgtcaccgacgccgctctgcacgagaagaccgccgacttcgacttcttcgactacgaggcggacgagacgaagcccgtcgactgatcccgcccggccggccaccacgatcattcaacgaccctgatccggctgtgatccgattccgagcggccgcgtggccgctcgcggggcgcatacaatggaccaaggaacgttgcgaatgacgcgcggttccttggcccattgggccgaatgggttttgccatgggttgtgatgggcggaaacgaaaagtcgggcaacccccgaacgtaagggcggtgagacgcatggtgctaggcatcgacgagcgaatcgacggcgtgaacctcggcaactggctggtgctggagaaatggatggatccgaaaccgttcacccgcagcgccgaagacgatgaaatctggatgcaccgcacgcacgtatccctctggtccgaacggaatctagccgaggaactgcgccggcaccgcgaaacctacatcaccttggaggattttcgtatcatcgccgaccacggaatcaacctcgtacgcattcccataccgtatttcatcttcggcgactggcccgggcatccgggctgcatcacgtacctcgaccgcgcgttccgttgggcgcgggagacgggactgaagatcatgatcgacctgcataccgtgcccggctcgcagaatggtttcgacaacggcggtctgacgggtgtgtgcaaatgggcgcagaatacggacttggtggagtacacgctgaacgtgctggagcgattggctcgccgataccgcgacgaaccggccctgcacggcatcgaagtactcaacgaaccagtgagctggtcagtgttccatagcacgtcgaacacggcgaaagactctcatgaggcttccggtagcacgtatgtctcactgcgttttctgaagcgcttctaccgcgacgcttacgcccggttgcgcgccgtgctacgtccggaaaccgtgatcgtattccatgacggtttccgactgctccgctggggtggttggttccgtcgtgctggcatgcgcaatgtcatgctcgacacccatcagtatctcatcgcgatggaggatccgctgttttcgggaccggcacgccggctgtacctgcgatcgcgacgactgccatggctgtaccggatgctggtgggcgcgagtagcatcgccatccgttcggcggctcgtcgtattcccgtgctggtgggcgagtggtgcgtggagaatcagtgggccctacacagccaaaaccgatcggctgcataccgccaagtgtcacgattgcaacgcgcggcatgggacgtgtcggcggggcagatctattggagctaccagcttgcgcgctccgcgaaaccgggtagtggcgaagggaaaccgccgcgggatcctcgcaacggcggcaatcttgaggcgtgggatctgactcgcgtatggcgtcatggatggattcgggcggatacctctcacgatgacgtgccataggcagtcaatcaatggcaatcgacgcaaggtgcattagactcggaatcatggcagaggaagagacttcgaaacgtatccgaaaatcaccgcaggagcggcgtgaggaagtgctggatgcggctgttcagctgatcagtgagcgtggattcaatggcatttccatccaagacgtggccgacagggtcggcatctccaaacaaggcgtgttgcgatacgtcgacaacaaagacaaaatgctggcgctggtatatgacgaatactacgggcagaccggcacgccggaggacttcttctcttcgggcatgccgggcagcgacccgtccgcgccgcattttcccgcgtatctgcgctacctggtgaaacacaactcgcgccgccgcatgatggtgcagctgttcaccgtgctgtcggtggaatccctgaacccggatcacccattgcatgacgaattcatgggacgcatggaggacatctgggaacactactcgaaatacccgtgggtggttccgccgcaattgggcgcatgggccggcagcatgcggccagtggtgcgcaaagccatggaaatcatggatggcattcagctgtggtggctgcgcgaaccggaagtggacttgtgtgaggaatggtccgaaatggagaatctgctgtttcccgcgcccctctgggatgcatgccgctgattttatgtgtgttccgcatacgttcgggggtgacctgacggccaccctcattttgcttatcttctattgtggtagtgcctgaaaagtttgctgaaagagacatgctggtttcttgagatgtcgaccattttgatgcagtcagactacctgctgcgcttcccgtatagacgccaatgctggctcccaacatccctagcgatactagtatcattattttacggaagagtctagattcagtagaattaccaattctacataataattcgtcatatatagaacctgctgcagaattagttacaattgtccctctgtaaaaagttaattttactcattatattgactatttataagataattagaacgttgaataatctcagattcattcttgccggaaataagaaatttcctgtcagaatcaacagagttatgagcgataccttttttctcgcccacagattccaaaaccgcccaatccgggatttctttttcctttggccagttcaatccggcggtttccagcagtatgccatactgagatgatcgcgtaatattcgcatccgcatcgacaagaccaagttccaataggaagttggccttgctttggtctatgccataggcggctgccagctcctgcttgatgagaccgcctcctctgcgtgccgccatttccccgaatacgaaatcaccggtttcattcttatagaattcgatatgcatcacattcggaatcgtctgatcgttgaaagatgcaattaattgctttgtcagtcggagcagctcggaatagtcggcaccgttctcatccaacatcacggaaccggtgttttgtttctcgaaatccagtggcgggacaaggtaccgtgatggtgagatcagaatcgaaccggaattgatatagactacatccacatggtagacggaaccggaacaatattcctctaagtaatactggtttgaatgcacgtttcgtatgaattccggcttggtagctaaagcgggcaggtcatctttcgaatgcaatatcgtaatgcctgcagaccctgcgccccatcgaggtttgagaacaaccgtctcccaacgatcgaacgccgaaataatatctccaaagccttggcaggtggtatagggaataatctttaatccggcatcaagggccgattgtttcatcgtgactttatctcgacagcttaacgccagttcatgctgtaaaccgggaattccaaataaacttctcgcctctgcaaccctcagtacgtcttcctctgagctggaaactatcctatctggtttaaatttcctgacaatatcaaagaattttgcggtagcgctatcagaggaataatcggaaacctcgatttccttgatgacggagctcggccaactatggtgtgcggctcgatcgttcgaggtgaagaccataacttctaaacaatcgaaacgttcttggatttcctcaatccatttaggataatttgagaaagatttgggctgttgcagcaataatactttcatgtcattccccttccggtgtactcaccaagactttttctttcaatgacgaatgattctttgtccacgttttctaatttgattagtgacgactgcaggcattattcccactaacgccagtgcacaccaataccaagccgtcaatcctgcaggacgtagtgccggaacgatccaaccgccaaggaatgagcctgccgattcaccaatggctgcaattatcagccgatagttcagaatgtccaccaaaggcttatctggctgtgcctctaccagagcaatattgattaatggcgcatagatgcattctgcaatggagaacacaaccaaggaaatgatgcatatccaccagtacgacgagactccgcaggcgaatagtgcgaaggaaattccataaatccccaggcttttgactatgaatgaggtggcattatgttctttggtcatattgcgcgagatgatcttacttaccggcatttgcagtgctatgaccgatatggcatcaatggaatagaacaatcctcttatgactggactatcggataacgagtggaattccaatgccattccggcaaaaagctgaccattcattatactgcccacgaacaccgccaggatggcaagaaccgtaccgggacttttcagcgagtctgtaatggtcttcacgatggaggaagtgttttcctcgccgcttttctcattgcgtatgaagacatgatgagtcagcgctattggagctagtaaagcagaaaaagcatagagtccgacgatgattgcaataaagagcgtttgtccgaaagctttatatatgtaattcgagcccagaggtccaatcgcggatccaagattggctgccatagtcactaaagcaaacaaagaagcctgaatttttttatcctttactgtagcgatgatatgccctcgtagggcaaaattaaccaatgaaagaccgagtcccagcaaagccaaatccgcaaaaaggaagccgataaaaccacccattgccggttgtagcagcaaaagtgaaaaaaccatgaatccgaaaccggcctcggtgagggataccgttgagaaacgctcaatcaggctacctataaaaacagtactgcctctagaaaaaagagataaaattccgagcgccagtccaacatatagcgatgacgccgcagaaacttggccggtgagaataaccgaaagaagggagaagagaccgctgtacgcagcagtattcaaaaagtaattcactgatatggagtctcttttaatatcgttcggcttctccatttgaatggaccttcttttatgctttacaaataatgtctccccatgctagttgtcataggggaattgttcattgctgcgtccacatatagtgacgcttggttttggcatacttgggggtgtctgtttcaaagtttaccgtgctttctgtggaatcgttgaatcctgaacatccgttgcatgatgaattcactgctcgtatggacgatatttgggagaactattcgcaatatccttggctgattcctccgcaattgggttcatggaagtcgagcatgcgaccggtggtgcgtaaggccatggaaatcatggatggtgtgcaattatggtggttgcgcgagcctgaagttgatttatgcaaagagtgggctcagatggaaaacatgctgtttccatccccgttgtgggatgcatatcgttgattttgaatacttgttgagattggcattgcatgcgcgtgcgaaagggtgaggtctgatggtccctcgccttttgcgttgacgggtttatgtcgagttgcggatgtgcatatgatatactaaactaccaattggtaattaaagaaaatcgcttcaatgaggaaagtgagcaatccatgaccgaaaccactgaaaatactgtaaatctgccttataggaatccggaacttcctactgaggaacgcatcgccgatctgcttggtcgaatgacccttgaggaaaaagtcggacagatgatgcagcttgacgcgcgaagcggcgatttggacgatctgatcgtcgacaagcacgttggttccattctgcacacctcgccttccgatctgccgaaagccgtggaaacggtgaacgccaaaacccgtctcggcattccgctggtgatcggcgacgactgcattcacggctattccttctggccgggagccaccattttcccggaacagctaggcatggcaaccacgtgggattctgaaaaggtacaggccgcgggccgtgccaccgccgaggaagtgtcagccaccggcgtgcattggacgttctccccggtgctgtgcatcgcgcgagacacccgttggggccgcgtgggcgaaacctttggcgaagatccgtacctgattggcgaaatggcatcgtccattgtcaagggctatcaaggtggagctaaggcgggcgagccgctcgccaaagacgcgatcctcgcatgcgccaagcatttcgcaggctattccgaaacacagggagggcgtgacgcttccgaagccgacctgagccaccgcaagctggaatcctggttcctgccgccgtttgaacgcgtggccaaggaaggctgcggcaccttcatgctcggctacgaatccatcgaaggtgtgccggtcaccttcaacaagtggctgctttccgacaaactgcgtggcgcttggaactatcagggcacgctcatcaccgactgggacaacgtcggccgttccgtgtgggagcagaaggtcaagcctgactatgtgcaggctgctgccgatgcggtcaagtccggcaatgacttggtgatgaccacgccaaagttctacgagggtgcgatcgaagccgtgaagaccggtctgcttgacgaatcgttgatcgatgccgccgtggctcgtatcctcgcactgaagttccgtcttggactgttcgaagatccacgcttgcccgaccagaagcgtatcgatgcagtgatcggttctgaagagcatcagcagctcaaccttgaagtggctcgcgaagccgtggcattgctgaagaacgacggttcactgccgttcaacgtggccggtgcgaagcgtatcgcggtcgttggtccgctcgccgatgacgcccagacccagctgggcgactgggcaggcagctccggccagatcaactggatgcctgacggccacccgcgtgaaatgatcaccaccgtgcttgatggtttcaagcagctcgctccggaaggttgcgaggtcgtgtactctcgcggtgccaacatcgtggatttggtgcctgatccggaaggcgagttctacccggatggacagcctcgcccgaagatcggcgtttccgccaagattgatcgcgcactgcttggcgaagccgtggaaaacgcacgcaaaagcgacctgatcgtggccgtggtgggcgatgtgatccaggccattggcgaaggctgctccaccgccacgcttgaactgctcggcggacagaatgcactgatcgatgcactgtcgaacgtggctcgcgaaaccggcaagccgttcgtggtggtgctcgtcagttccaagccgcaagtgctgccggcatccgtgatcggcaccaacggcgtgattgtcgacgaaactccagccgaaggcacttcggctctgctgtgggctccaagcccgggcatgaagggcggccaggccatcgccgaaatcattctcggcgaaaccgaaccgagcggacgcctgccgatcaccttcccgcgtcacgcaggacagctgccggtctactacaaccagattcgaggccagcacggcaaccgttacgccgacctcacgcagaatccggcattcgcattcggcgagggtctgagctacaccacgttcgaatacggagatccgatcatcaccaacgttccggaatccggcatattcgccgaaaccgacaccgtgcatgccgaaatcaccctcaccaatacgggcgatcgcaagggcacggaagtagtgcagctctacatcggcgacatcgtgacctcctacagctggactgatcgtgaactcaaagcattccagcgcgtggaactcgaaccaggcaaaagcaagaccgttgccttcgacattccggtttccgattgcaccatcgtcgattcggaagctaaccgaatcgtcgaaccgggcgaattcgaagtgcttatcggccattccagccgtcgcgaacacttgaagcgcaccaccttcaccgtcgcgtaaaagcgaaacgaaataagccgtgtcgcagaacccaataatcgacacgctagtctgatatgagccgcctacgaaatgccgatcgtgggcggctcgcatgaatggaccattgccgtgacatacgcgttgtttatggctgcttccggattcgtactggtgtctgatcagacgcatgcgttgaaccagttgccatcgtcaatgaacgccgactgttccgcggtgatgaacgccatacagcagcttgccggcgcgattgtgcttgccactggcggttatacggctttgttcccgatcgctgtggttgcggtgctactgggcacggtgttcatcatgctgattcgcaaggtgaagtagctgcaggtactgcagtagccgaagcaacgcgcagtgtgccggcgattgtggcacacgtgatctcgacattgcgttccgtgttggcgatcagcgtcgcaagatcagccggcccgggcgcaatgccgaacgttgcgacgatgccggtctcgttcaacgcttcgatggtgtgtggatcgcgggttaccgttccgccaatggcgatagttggttttccttgcgattgcgctagtttcgcaatgccactcggcactttgccgtacggtgtctgactgtcgatggaaccttcgccggtgatgatgacgtcggcccatgcgcatgcttctcgaccatgcgtaagatcgagcacaagttcgattcccggccgtactgttgtattgaacaggccgagcatcccgccgccggtaccgcctgcggcgcctgtaccgggaatgcgctcaatatcgcggccattgtattgcatgatcgcgtgtgcgagattcgcgagtccctgatcgaggagttcgacctgtgctgtgttcgcgcctttttgcggagcgaacacatgcgcagcaccttccggtccggtcaaaggattggtgacatcgcaggcgagaacaatcggaacattttttacaaaatcgggaacttccgaatcgtcaatcctctccaaatcaacaagagaaccgccaccaagcggaatatcatgacctgccgtatcaagaaaacgaaatccaagcgcgcgagccaatcctgtgccaccatccgtagtggcactgccgcccaaaccaagcacaatacgattcgcgccagcgtcaatcgcagcacgaatcagcaagccggtgccgaacgtggaagaagacaacgcattgcggtcggcgggggagatccgttcaagtccgcttgccgaagccaactcgaccacggcggtgtggagaatacaagaagcatgattattgccaagaaagccaaactgagcggtaatcgggcgaccgaccgcatcaaccgtctcaacatcatgcaacgtgccgccggtggcatgaaccaaggcgtgcgtcaatccttcgccgccatcggaaagaggcataagccagcattccgcctgcggattgccacgcttaatgccgcgagccatcgcctgtgcgattgcttcagccgaagcggcctccttgaacgagtccggtgccagcaaaatccgcatacatgcctccttctacgtctgcatccatacagtaatgcagtgccggggcagaggcttagcggtagccctcccacatgggcagggggaacagggtgtcttcgcattccgcccacatggcgttcagatcttggccgggcgtgcgcagccaacgcagctgcacgccatccatcatggcgaatcccgcattaagcagccgacgcgtatcaacgccttcgggcgtgcaccaacggatattgagcgcggtatcggcattatgcagctcacgattggcgaagtactcgtgtgcagggtggttcgggtcgatcgcttcggcactcaacgtggaaaacatgtgcacctgaagcggtctgcgtgcgttcaccgccacgattctacgccacatgtcggcgatcaacggtcgtggctcacgtaccatgtcggtaagaatgtcttccgtttcggaatcgtagacttcgtccagcgctgctgtgagcagtccttccttactgccgacataatgcagtacgccagccttggtgagtcctacgcgatcggcgattttctgcagggaagtgccgtaatagccgagcgtcccaaacagttcgacggccgcattgagaatctccgcccttcggtcgacttcttcgttggccatgatgattccctctcttgcccttcattgatggcgattcatgtgcgctgcaatgcttatgaatcgtcatttctctcaagttgtaaatactgcagttactttacggtcggttaattgatttttcaaagaagattggcgtgttgcggtgttggttttgataaagtacctaccaaccggttagtagagatttcggggttgaggtctcatgcagatcggttaaccgatacgaactcaagaaaacgatgcgaaagaggaacgtatgagcgaaaaaacctatccttccatcaatgatctgacgcttgaagagaaggcatccctgacttccggcggcgacgcttggcatctgcagggtgttgaagccaagggcattcccggctatatgatcaccgatggcccccacggcctgcgcaagtccaactcggccaccaccggcgaagtcgacctgaacaactgcgtgcctgccacctgcttcccgccggcggctggtctgtccagctcctggaatccggaactcatccaccaggttggcgaagccatggccgaagagtgcattcaggagaaggtcgccgtaatcctcggcccgggcgtgaatatcaagcgcaacccgcttggcggccgttgcttcgaatactggtccgaagacccgtacctggcgggtcatgaagccatcggcatcgtcgccggcgtgcaatccaagggcgtgggcacttcgctcaagcacttcgccgccaacaaccaggaaaccgaccgtctgcgcatcagcgccaacatctcccagcgtgcgctgcgcgaaatctacttcccggcattcgagcacatcgtcaaggaggcccagccgtggaccatcatgtgcgcatacaactgcatcaacggcgtgcatgccgcccaggatcactggctgctcaccgacgtgctgcgcgacgaatggggtttcgaaggcatcgttatgagtgactggggtgccgaccatgatcgcgtggcctccctcaacgcgggcctcaacctcgaaatgccgccaagctacaccgacgaccagatcgtctacgcggcacgcgacggtcgcatccagccggcacagctcgaccgcatggcacaaggcatgatcgacctggtcaacaagacccgcgcggccatgagcatcgaaggctatcgtttcgacatcgaagcccacgacgaagtcgcccaccgggccgccatcgaatccatggtgctgctcaagaacgacgacgccatcctgccggtcgcaaacgatgccaaggtcacggtcatcggcgaattcgcacgcactccgcgctaccagggcggcggctcctcgcacatcaccccaaccaagatgaccagcttcctcgacaccctcaccgaacgcggcgtggatgccaagttcgccccaggcttcaccctcgatctcgaaccggccgatccggcactcgaagccgaagccgtcgacgctgccaggggcgccgacgtggtgctcatgttcctggggctccccgaagcagccgaatccgaaggcttcgaccgtgagaccctcgacatgccggccaagcagatcgcactgctcgaagccgtcgcagccgaaaacaagaacgttgtggtcgtgctctccaacggctccgtcgtcaccgtggcgccatgggccaagaacgccaagggcatcctcgaatcctggctgctcggccagtccggcggtccggcgctcgctgacgtgctgttcggcaaggtgagcccgtccggcaagctcgcgcagaccattccgttcgacatcaacgacgatccgagcaccatcaactggccgggcgaagaggggcatgtcgactacggcgaaggcgtgttcgtgggctaccgctattacgacacctacaacaaggccgtcgactacccgttcggattcggcctgagctacgccacgttcgaagtgagcgacgtgaaggctgtcaagaccggtgcctgtaccgcatccgtcagcgcagtggtcaagaacacctcgaacgttgacgccgccgaaaccgtgcaggtgtacgtggctcctggcaaggccgacgtagttcgcccgaaacacgagcttaagggcttcaagaaggtattcctcaaggctggcgaatccgcagaagtctccttcgagctcgacgatcgcgcctttgcctactggtctgagaggttcaatgactggcacgtggagagcggcgaatacaccatcgaggtcggcacgtccagccgtgacatcgccggttccgcggtggtggagctcgacggcgacggcaaggcccagccgctcaccgaatggtccaacttcatggaatggcgtaaggatccgctcggttccaaggtgcttgaaatcctgcgtgccgagggcgaagccggccgcatgccggtggtgcccgacaacgacatgacccgcctgttcctcgattccatgccgatcaacagtatgtcggtgctgatgggcgccgatggcaagcagatcttcgaatacatgcttgagaagtacgctgaactcaccaagtagtttcgtaggattcaaggcttaaggccgagggattcgatccgttaacgctgaaccggtgcggatctgattcctcggccttttttgtcgcggacgatgagatgcgcgacacgctgatcgttgcatgtacaacagttgtatatgcaacggtttagcatgtgtggtgtgacagaagtgacgaatgaacaatacaaggaaccgtcaggttcacgacttgccgaagtctgggaaagtggcctgaccaagcctcccagcgtggccattcgctcgctgcacaacgtggtcaaccggtatttgcgcgtcacccgtcccgaagaggcggaagacgtcagcaacggcaacgttgacatcatcgtgtacttggcaagacatgataacgaggagatcttccctcaagacatcgagcaacgtttcggcgtgacccgatccacatcatgccgagtgttgggactgatggagcagaaggggctgatcgcccgcgagtcggtgaagcgtgacgcacgtctgaaaaagatcgtattgacggacaaatcgaggcatattgccgaagtactgcacgacaatgcgaaaaacatggaacgaatcctgttggaaggtcttgatgacgaccagatccgccaattcatgcacatgcttgacgtcatgcagacgaatctggtgaaaacaggtttgatcggagacgaaagccgatattcaagcttggaaatacaggaacaggattttggcgaatcgcaggtttcgcaaaagccgcaggtttcgcaagaatcgcaagaatcatgcgatggacggaatccgcataatcgcgattctcatgatgaatacgtttcgcgcatactgcgaatgtcgcaggaaatggcgatcgcaaacaacctcaggtaacacacgcaagcaagtaagtacgaaaaagaaaggacaaggagtgacagcggcaaacgcaacgacgtccacaacgtcaaaaccaaagcaacacgtcattcgcacactgggcaaatccctgcgcgaatacaaaaaagccagcctgctctccccggtattcgtagccgtggaaagcgtgctggaaatccttattccgaccgtcatggcatcgctgattgatgagggcatcagcggtggcagcatgccggcgattttgaaattcggcttgattctgctgatttgttcggcggtttcgctgacatccggctttttggccggaaagttctcggccattgcgggcgcaggattcgccaaaaacctgcgtcacgaccagtttgagaaggtgcagggctacagcttcaccaatatcgaccgtttctccaccggttcgatcatcacgcgactgaccactgatgtgaccaacctgcagaacgcatattcaatgatcatccgcatgggtgtgcgcgctccgatcatggtgattgtggcgtggatcttctccttccgcatcagcccatccatttcgctggtgttcctcgcctgcattccggtgctcgccatcggcctgtgcggtctggcagtactggtgcatccggtgttcgagcgcgtgttccacacgtacgacaagctcaacaacgtggtagacgagaacctgcagggcatccgcgtggtcaagtcttacaatcgcgaaaaccacgaaaccgaaaagttcaaccgcatttcgcagcgcattttcaaggacttcaccaaggccgaacgcattatgagcttcaacaatccgctcatgatgctgtgcgtgtacgtgtccatgctgcttatcgcctggatgggtgcccagcagatcgtggcatccggcaacaatgcggcccttggattgaccgccggcgatctgaccgcattggtcacctatgccatgcagattctcatggccatgatgatgctgtccatgattttcgtgatgtgcattatttcgcaggcctccgccgaacgcatctgccaggtgctgaacgaggaaagcacggttacgaatccggaaaatccggttatggaagtgaagaatggtgagattgatttcaaccatgtcaccttccgttattccgccacttccgaaaagccggtgcttgacgatattgatttgaagatccgttccggtatgaccgtcggcatcgtcggcggcaccggttccgcaaagtccagtttggtgcagcttgtgccacgtttgtatgacgtgaccgaaggctcgctgaaggtcggcggcgtggatgtgcgcgattacgatttggaagtattgcgcgatcaggtcgccatggtattgcagaagaacgtgctgttctccggaaccattgccgaaaacctgcgttggggcaatccgaacgccactgatgaagagattcgtcacgcatgccagcttgcgcaggccgacggcttcattcaggaattccccgacaagtacgatacgtacatcgaacagggcggtaccaacgtttccggcggtcagcgccagcgtttgtgcattgcgcgtgcgctgctgaaaaagccgaagatccttattctcgacgattccacgtccgcggtcgacaccaaaaccgatcagctgattcgcgccgcattccatcatgagattcccgacaccacgaagatcatcatcgcccagcgtgtggcctccgtgcaggaatccgacatgattctcgtcatggaccacggccgcatcatggcggccggcacgcatgaacaactgctcgaaaactgcgacgaatatcgctccatctacgaatcgcaaaccaagaatcaggctcaacctgaggaactgcagtgaaaggaggcaacagatgactgaacaaacttccgcattgaaatccaaagacaacaacaacgcggccggcatgcagcaatcgcacggcaaaccgccgatgcagaaagccgcacccggcaccaccaagcgtatcttcggttacattttccaatacaagtggcgtgtggcacttgtggtagtgtgcattctcgtcggtgccgcggcccaggccggatcgtcgctgttcctacagtcgctggtcgatacgtacattctgcccatggtcggtgccaccaatcctgattggatgccgctgctgcgtgcgttgacgcttatggcatgcctgtatgcggccggcattttctgcagctggctgtggcagtgggtcatcgtcaccgtggaacagggcacgttgaagaagatccgcgacgacatgttcgcccaccagcagaccctgcccatccgctacttcgacaccaacgaacacggcgatatcatgagccgctacaccaacgacaccgatacgttgcgtcaggccatcagccaatcgttcccgcaaatgttctcgtccgcggtgtccgcaatcgccgcgctcgtgtcgatgctgtggctgtcggtgcccgtcaccattttcgtgctcgcattcaccatgatcctgtttgtggtggtacgcaaggtcgtttcccgctccggacgttacttcgtcaagcagcagatcgccatcggcgacgtgaacgcattcgtggaggaagcggtcaacggccagaaggtcatcaaggtcttcaaccatgaagacgccacccaaaccaccttcgacaagaagaacgaagaactgttcgaagcttccgccgaagcgaacacgtggggcaacgtgaccatgccaatcgtaggcaacatgggttacctgctgtacattctgctggctattttcggcggatccgcagcgatttccggacttggcaacttcggattgtccggtgctggcccgctcaccctgggtacgctgatctcgctgttgacgttgtctcgttcctttgtgaacccgcttggccaggtgtccatgcagttcaacatggtgatgatggcgcttgcaggcgcatcccgcatcttcgcgcttatggacgagcagccggaggacgacggcggttccgtgaccttggtgaacgtggaactcggcgaagatggacgcaccatgaccgaagttgaccatgaaaccggtcactgggcgtggaagcgcgaggaaggcgatgacggcacccgttcgctcaaggccgcgcaatccttgagcccgcgtgccgccgaagtggccatgaaagcccgtgaaaccgccattacctcaccggacggtcgcctcaccctcctgcagggcgatgtgcgcttcactgacgtgaacttcggctataaccccgacaaaccggtgctgcacgacatcacctggttcgccaagcccggacagaagatcgcattggtgggcgcaaccggtgctggcaaaaccaccgtcaccaatctgatcaaccgtttctacgacattcaggacggcatgatcctgtatgacggcatttccgtcaagggcatccgcaagccggatctgcgtcgttcgctgggtgtggtgctgcaggacgtgaacctgttcaccggtacggtgatggacaacatccgctacggtcgcctcgacgccaccgatgaggaatgcatcgccgccgcgaagctcacgaacgccgacggcttcatccgcatgctgcccaacggctaccagaccgtgctcgaaggcgacggctccggcctgtcccagggccagcgccagttgatttccatcgcacgtgctgccgtggccgatccgccggccatgatcctcgacgaggccacctcgtccatcgacacccgtaccgaagaggtggtgcaggccggcatggacaacctcatgaaggggcgtaccgtgttcgtgatcgcccaccgcctctccacggtgcgcaactccgacgtgatcatggtgctcgaccatggccgcatcatcgaacgcggctcgcatgacgagctcatcgcgcagaagggcgagtactatcagctctacacaggtgccgtagaactcgaataatctaaatagtctcctgaattggagcgatgcgagcacacgctagcgttctacactagccgcgcttcgatccctgtcggctgataccgcccttatggccggtggctttgaacggcacggatcctctggaaaatcccttgctttgaaattgcgattttgaagcaagggatttcttattgtctttgccatgcacggtattcggctgcggccagcccgccttccgtgaaggcggttccgtcatacgttcatgagactgctgcatgagcagcgattataattggcttgcgtaatcgttgcataaatctcgcttggtttgtcgttatgtcaataataggttatcctttcatgggtaaacgatttactaaattggagagcgagacatggcgacgattaaagagattgcgcaacgtaccgggttttctcaggctacggtgtctcgacttctgaacggtgatcccaccctatcggtgcgtgaagagactcgtcgcaagatcattcaggcgagcgaggacctcggctatagcgtgcagaccaagcgcatcgtcatccctcatgaggttgcattgcttgacaatgaaaagtccgacgaggcgttgcgggactcctatttcaccgatttgcgttcagcgctcgaacgcaatgcggaacagcaacgcatggaaatgacggtgttccacaatctcgacgatatgatcgctcgcagttccaaattcgacgggttcatggcgataggcgccgaccagatcagcgaggaagacttggagcggctgcatagggccatgccgtatggcgtgttcattgacgtgaatccggcgccgaatctgttcgattccgtgcagcctgatttgcagcagaccatgcatgatgcggtcgcggcctgtgctgccaagggcatgaagcgcgttggattcatcggaggcaagggctgcctgatgaacttttatgaggtcgatgaggagaatcgcgccacatatttccgtcgtgaggcaaggcgtttcggtattcaatccgacggattggtgtattccgacggcttgttcaccgtgagcaacggccgtgcgttgggggagcaattcgtgcgcgaccataatggcgtgctgcctgatgccgtgatcgtagctgccgatgtgattgcggttggcgtgctgcaggcgttcaatgcggttggcgtgctggtgccgcgcgatatcagcgtgatcagcattaacaatcaaacgatttcgcagttgacctcgccgccgttgagcacattctccatcgatcagaacgagcttgcgcgtgtggcgacgctgatgttgggtgatgccatttccggcaaacgcacgattcgtcagcatgcgtacctgtcgacgtcgctggtggtgcgcgatagttttgtgccggcaaaatagcggttatttctttacttctgtatagtaatcgggctatttccagattggcttggtttcgtttcgatgtggaagcttttgcatatcgtaaatatcgattttggtaaaagctgccacaagataatgcgacagtttgcctattttgttgtgtaaatggcgaaaaataacgtttttggctatctttcgaacagaagctcacaaaatatgacacgccgataggcgatatgttcagtgataaattttactaactttaggtaaggggatatactgatagttaggtcaaggaaggacctgtatctgacttctaaggagaagcaaagatgggaaatggcaacaacggttccaaaggcgggaacctcttgtctcgcgtggcgtactcgttcggtaacgtcggccagtccgcgttctacaacgcactgagcacctatttcatcgtctacgtgacgagctcgctgttctctggcgtcgataagagcgtcgccaccaagctgattggcatcatcaccggcctggtcgtggtgattcgtatcgcagaaatcttcattgacccgctgctgggcaacatcatcgacaacaccaacaccaagtggggtcgcttcaagccgtggcagctcatcggtggtaccgtttccgccatcctgctggtgctcgtctacactggtctgttcggtctggtgaacgtgaatactaccctgttcatcgtgctgttcgtcatcaccttcattgtgctcgacgtgttctactcgctgcgtgacatttcctactggggtatgatcccggcattgagctccgactcccacgagcgctccacctacaccgcactcggctccttcggcggctccatcggctacaacggtctgaccatcgtggtcatcccgatcgtcacctacttcagctgggtgttcaccggcaagtacgtcgaaagccagtccggctggacctgcttcgccatcatcgtggccatcctcggcatcctcaccgtgtgctccgtggcgttcggcaccaaggaaagcaccaccacgctgcgtgccaaggccgaagacaacggcggcccgctgcaggccttcaaggctctggcccagaacgatcagctgctgtgggttgccttgagctacctgctgtacgccatcgccaacgtggccaccaccggcgtgctcatgtacctgttcaagtacatcctcgacaacaccgccgcatactccatcgtgggcgtcatcccggtcatcaccggcttggttatggctccgctgtacccgatcctgaacaagcgcattccgcgccgctacctgtacttgggtggcatggtgctcatgatcgtcggctacctgctgttcgccgtcggctccagcaatctggcaatggtcatcgtcggtctggtcttcttctacctgccgcagactttcattcagatgaccgccatcctgtcgctgaccgactccatcgaatatggtcagctcaagaacggcaagcgtaacgaggccgtcaccctgtccgtccgcccgatgctcgacaagatcgcaggcgcatgctccaacggtatcgtcggcttcatcgccgtagccgcaggcatgatcggtgacgcaaccgccgcggatatgaccgccgcgaacatcggcatgttcaaggtctgcgcattctacgtgccgctgggcatcatcgtgctgagcctgctcgtgttcctcttcaaggtgaagatcaccgagaagatgcacgacgagattgtcgaagagctcgaagccaagcttgcttccggtgaaatctccgaatgatcgaacatagtatgttctaaaaatacatattgaaaatacgattacaatgccgatactgatgggctgtcagtatcggcatttctgttgtatgtaatcctacataagagctattgtgaatcgccatgaaacctattgtgaaatcgtccataatcatgcaaaacaagcgaaaatagttcgcgctgcatgctatagtgacaactgaaatgcgagcgatgatccgttatcagcggggagcttccggaagaacggtcgcgtgagcgacttattagacccggcgggaaggcccgaatagccgaacatacaagcggtcgcacgtatatttgaaagtgcggcaaacgaggtggtaccgcggtggcggcgtccagcagacgttacggccatcgtcctcgtaggagatagatagcaagaacctacgaggagatacggtgagcgaaaacagcgtgtatccgaaggcagctgcgggtgagcagagcgccaatgtagcgccgaaccccagtttcccgaagctggaagaatccgtccttgattattgggagaaggacgacactttccagaagtccattgaacgccgtccttccggcgatcacagccagaacgaattcgtgttcttcgacggtccgccgttcgccaacggcctgccgcattacggccacctgctgaccggttacgccaaggatgtgattccgcgttaccagaccatgaagggccgcaaggtcaatcgtgtgttcggctgggatacgcacggtctgccggccgagcttgaagcccagaaggaactgggcatcgattcggtcgatcaggtcaaggaaatgggcatcgacaagttcaacgacgcctgccgtgcctccgtgctcaagtacaccaacgagtggaaggactacgtgcaccgtcaggcacgttgggtcgatttcgagcatggctacaagacgctgaacattccatacatggaatccgtgatgtgggcgttcaagcagctgtacgacaagggcctcgcatatcagggctaccgcgtgctgccgtactgtccgaaggatcagacgccgctttccgcgcacgagctgcgcatggacgccgacgtgtatcaggatcgtcaggacaccaccgtgtccgtggccgtgaagctgcgcgacgaggaagacgcctatgcggtgttctggaccaccacgccgtggaccgttcccaccaacttcgccattgtggtcggcgcagacatcgactatgtggaagtgcgtccgaccgaaggcaagttcgcgggcaagaagttctacctgggcaagccactgctcggctcctacgccaaggaactcggcgacaactatgagatcgtgcgcgaactcaagggtgccgagatggaaggctggcgctactacccggtgttcccgtacttcgcaggcgacgagaacgccgtcgaaggcaaggttccgggtccggaaggctatcagatcttcaccgccgactatgtcgataccgttgaaggtaccggtctcgtgcaccaggctccgtacggcgaagacgatatgaacacgctcaacgccaagggcatcaagagcgttgacgtgctcgacgcgggctgcaagttcaccgcgctgtgcccggactatgagggcatgtacgtgttcgatgcgaacaagccgattctgcgtaacctgcgtgccggtgacggcccgctggagcgtattccggaagagcagcgtgcgatccttttccaggagaagagctacgtacactcctacccgcactgctggcgttgcgccacgccgctcatctacaagccggtgagctcgtggttcgtgtccgtcaccaagatcaaggatcgtctgctcgaactgaaccaggaaatcaactggattccgggcaatgtgaaggacggccagttcggcaagtggctggccaacgcccgtgactggtcgatctcccgcaaccgtttctggggttcgccgattccggtgtgggtttccgatgatccgaagtatccacgcgttgacgtgtacggttcgttggacgagctgaaggctgattttggcgattatccgcgcgaccatgagggcaatgtcaacatgcaccgcccgtacatcgacgagctgacccgagtcaacccggacgatccgaccggcaagagccacatgcaccgcatcaccgacgtgatggactgctggttcgaatccggttccatgagcttcgcccagtaccattacccgttcgaaaacaaggaaacgttcgaacagcatttcccgtgcgattacatcgtggaatacatcggccagacccgtggctggttctacgtgctgcacatcatggcgaccgcactgttcgacaagccggcgttcaagaacgtgatctgccatggcatcgtgctcggttccgatggtcagaagatgtcgaagcacttgcgcaactacccggatgtgaacggtgtgttcaacgatttcggatccgacgccatgcgttggttcctcatgagctcgccgatcctgcgcggcggtaacctgatcgtgaccgccgatggcattcgcgacaccgtgcgtcaggtcatgctgccagtgtggagctcgtactacttcttcaccctgtatgcgaacgccgccaataatggtgccggtttcgatgctcgtgcgttgcgtgccgatgaggtcgccgcactgccggaaatggaccgctacctgctggcacgtacccgccgtctgatcgaaaagacgcaaagctcgctggatgacttcctgatctccgacgcttgcgaagcagtgtctgatttcatcgacatgctcaccaactggtatatccgcaacaatcgtgaccgtttctggaatgaggatgcgaacgcgttcaacacgctgtacaccgtgcttgaagcattcatgcgcgtgatcgcaccgctcgctccgatggaagcggaagccgtgtggcgtggtctgaccggtggcgaatccgtgcatctggccgactggccgttccttgccgacgaacagaccggcgaagcgaccgaactgggccgtgtgctcgttgacgatccggctctggttgacgcgatggagaaggtgcgcgaggtcgtgtccggcaccctgtcgatgcgtaagacgaagcagatccgcgtgcgccagccactgcataagctgaccgtggtggtggaaaacactgatgccgtggccgcatacgacgagattctgaaatccgaactgaacgtgaagaacgttgaactgtgcacgcttgaggatgccgaagcccaaggcttgaagattatcaacgagctgcgcgtgaacgctcgcgtggcaggcaagcgcctgcgcaaggacgtacagttcgccatcaaggcctccaagtccggcgcatggcatgtgaacgccaacggtgctccggtatgcgagacgccgaacggcgagatcgtgcttgaggaaggcgaatacgagctgatcaacagcgtggaggagaagaacgccgaagaggccgccaactccgtttccgccgcgctgccgaccggtggcttcgtgatcctcgacaccgagctgaacgatgatctgatcgccgaaggctacgcccgcgacgtgatccgcgccgtgcaggacgcccgtaaggccgccggtctgcagatctccgaccgcatcgcactgaagctcgttgtgcccgccgaagacgtgtccaaggttgaacagttcaaggagctcgtctcctccgaaaccctcgccacctctttcgaagtgacggccggcgatgagctgaacgttgaggttgccaaagcctgagtgggctgacggctgctgatgactgatcgttgattcaggttgatgaacggcccgtcgtctaagccgtatctggatgacatccagctactactagacgggcgaacggtcgccaaccgtagcaggtctcgaatccaaaagagttcgggacctgttttagtagtgctgaacaatcaaccatgagatgttcaaacatgagactacagtaactacgtggctttcgagccttacagacttgatttgcattccgcaagtacgtgtcttgcgtcgacatgcggttacgcgagtgatcgcatcgtatgcgcagccgtacaagcgggatcagatcgtttcgcgaatggttctcagtaccatccatgtgagtcaagcacacatttgagaagcagtcgcacaccgggaatcgcgctcgcgtggttcccgtttttctaaaataacatacttgtctatattaagggaaaagctgaaaagcttgacactatctatagtagtgtgatattctgttcgcgtacataacgaaagtgcccgtcaggctggcgggcttgacgggcacttttcgagcagaaaggagacggaatcgataaattgtccgatacctgtagactgcgttatttctagtccgtagaaacagcgccagtatagcaggttaacttgatcttgtactgaagtcttggtgtgaggcctgctactgcattgagggttgtctattttgagggaaaagcatcctaaacactggctttctctgtatttcagagacttctctacatctcctgtcatgtgaatgccacgaatgcgcatatggcaggggtattattcgaactaattagggtgcacgggtgcgccctacagtacgcatggaaaggatttagctatgcgcaatatatctatcgatgacatcaatgctgcgatcctcaatggtggggcgggaagcttattggtccgagtggaattagaacccgcttcggggttggacggcattattgctccggcaaagtatgctggcgctaataacgccacttatgtttatgagaagcggtatctcggagaggaaaaacctcagaaagtcgttctcattgactcaaaaggatcgtttgccaacagggttgaggaaacaattaccgaagcaagaaggactggtgaggggctcttggcgtccatgccacatatcgttgtcaagtatgatgacgaatctggtagcaagacttattgcgacagccaacttcctcatcgtggtttcgatggtcacattcgcgtaggtgtccatgatggaaaatccacatcggaggcgaaggagtacattgatgctcgcaattcgactttggaaaatcttttgcctctgtttgagctgtctccagtcacggtgctgtttggcgggtgggattccactaggagcaagaatcagttgcgaatcccatcggtattgactggtgaaatgtatggcgtgcttgcggatcaaagcgatgatgatcccgccattcatcgtgccggagcgcgaattgatccggttggtgccagcgtgagcgtggctaagaaggctgatcgagaaaaaatagtcggagatagcatcgatcttagtgaaaacacaaaaaacaaatttattggcagcggtaagggttccattattggtctaggagccattccgccgagtgcagataaaggggctcttgatggcgtttcggtacgtggcatcgtttcaagtcgtgtactgagctttacgatgcttcgcaccttccactttggtaagggcgttgaaggcgacgccgccattcgtgctttgattgctgctgcgctgcttcgcgctatggctggatatgatgagaatccagtagtcagggctaattgcgcgttgactgagaccggcaagccatcggttgtacttaacaagcgttacggcgaaaaggaagaattcgagcctctcactgcagaatctactgagaaactgctggaagaggcttatatgcaggctcgggaaaaggccggcattgtctggaatggccaagagtttttggtacagggaaatcctgcggtttttgacaatgcttctgccgaggaatagatcaaggacgtctcatggcttttgctattacagcgaactttctgctggggacgtatcagggaagcgattctggcggtagaccggaaccttacccttctccagacagactctataaggcatgcgttgctgccgcatacaacacgtttgatttcgaaaggcaaacggatgatcgtgttctgacggacgagcagattaaaaatgctttggcatggctggaggataatcctccgcatagtattctgttgccccgcgttattccaccaactagcgatgctatttcataccgagacaagggatatttagaaaaagggaaagtaaagaagagcccggataaagcctctaaagcgatgtcgtattgccagaatgcggtggaatccctgttattgacatggcagtgggacgagaatcctaaccaagaggtcatcaacactcttaacctgctttgtggcgaggtcccttacctgggcgaggcatgttctgttgtggaactaaaggtcatagctggtgggggtataccggaggtccaacgcgacaagacatggacgctggagaaaggcccgatgctgtccggaatttccagacataatcgtgtgtttgccgtgccgggaacaggaaggctggaagagctgaaacgtgcctatatggccgcgaatcccgagggaaaaggcaaaggaaagaatgctgccaagtcgaagataagggcaaaggaggccgagcagaactttcttaatgactatgttccaaaggagactgagggcttggccggctaccggcctccttttgtccattcggagcgagcccttgaagccccgtggacaagagtgattgtcatgagcgtgactgttgatgaaggtcatcagggtgaaaagtcggagtggaaaccttccgaatcggagtacgtcggttgggcagttgcgttgcatcgtttcttggtgaagcaatggggtgttgatcccgctccatctctggttggcaaatatgttagtgggataaagcgtccggcgaacaatgttgctattcagattctcgattcagaattgaaatcgagctatggaattcaattgcgtgacgatgttgcgagaaaacttccgggattccttatcatgcttcccaaagacatgccgcaacatgacatgcagaaactgtacgatgtctgtaagcgttcgaaggggaaaactctgtacttttctcaagctgttccaaagctgcgattaggggagtctgccttgatcgatgcggaacatctatggaaaccagtaagcgtcgatttcgtgcgctactggatgcctcgtcctcttgccattgcggagactcgaccgataccggatcccaagaaaaagcgtcattggcgagctgccgaatcaatgtatttggcactgggccatgtatggcgtgataagtatgttcccaatgatattcagggtacgcgggaatcgcggtattgggagacggtggatgcagttgctgatcagtcttctaatatcagaatattcgattgccgacgggtgagtcgcgtgaacatgattgattatgcgcatcataccaatagttccaatgtgttacgtgccatgagtgctttaatcgccatttctgatggtgaagggtcgcttgattgtgccgctttagctgttgggcagagtcgacatttgggaggtggattcctcgtgcctcttgattttcccaaaaacatgattgtgcctgacggacactttgaaaagggggttccttcatggttgaagtgactcaggctttagcttttatggaacagcagtatgctcagtttgttgccttggctcatgatggtcgcactccataccgctggcagttccgtttgatgcggtatgtcgcgcaagaaggacgctggcctgatcgtatttcagtgccaacggcatctggcaaaaccagcgttattgatatccatgcattccttaatgcgatggtcggattggctgaaggcgaaagccgaaaagaacatgagatcttgtcttgccttccgttgcggcgcatccctcggcgcttggcattaacggtgaatcgtcgctctcttgtcgatgaccaatttgatgaggctgacgagctttgcggcaaaatccacacgagtgactccatgattcactataaggaaggcctcaagctcagagctggtgtgcatgatggtttgcctcatactgataagccttccgttatgaatgttgtcgaattgcgtggaggtatagcttctcagagagactggcggtattatccgcagacctgtgctgtcatctgcgctacacctgacatgtttggcagtcgtttgctgtttcgtggttatggtaccagccgtactatgcgctccatggaagccggattgcttgcctatgatactgtgctggtggccgatgaagcgcatctaagccggcagctgcttgaaacagcgcaacaggtggatcgcattgaaagtatggctgactatcctctcagtgaatacgtttctccactgcaggtagtggaaaccacggcgactccagctagcgaggatgcaaaacggaccagcgtggaaatcgagcaagaggatttgacggttgagacatcgcttgctgatcgactgtgcaagccgaagccggttgttctggattgcaccagcgctacggaaaaggaagagatccaaaagatcgttgatacctgcgttggaatgatccagaatcaagaatctggtgaatatggcgagactggcaatggcgtagtcgggtgtattgtcaatacggttaaaaaagccaagcaagtggcgaaagaactgtcggctcagctgaagaaagctggtatcagacgcccagtagcgagctacataggtccaatgcgcgcctacgataagaaaaaaatccttacggcaatgcgcgatgctatgtcactagatgcttcgcccgaatctccatgttgcatcattggcacgcagacgttggaagtaggcgtggacgttgatttcacgacccttattacggaattagctccggcatctgcgttggtgcagcgcgctggccgtgtcaatcgtcgtgggctgaacccccaaggcgatatgtatgtctttggcgtcgaggggaaacggctaactgctaaaacagcggctccatacgatgagcgggatcttgataaagctttggcttggttggagaaacttcctcggactgattcggaattaccgaacatgagtgcgtggtcagttcggcaatcgattctgcaagggaattatgttcctgcagagaagcctcgtcgtctgctgttccaacgtttggagccgtgggatgctgagaacctttcatccacggatgaacagttgtctgctgatttgcggttgccggggctccaacaggggagtgcggatctcaatctgtggttgcgtgatgatctggcggacgattccccggacatcggtgttgtggtcagggatctgccgcaggacacgaatgttgccatcgcattgcttgaggaaactgaacctgagaatgaggaattgttcccgttgcgtaatcaggaccaagcggcaaagctgaaggcgagtcttgaaggtggtgctataagggctttcctgtatcgagcttcaaacgaggaaggacaacgcgtcttgcctctaggtgctgcggatgcgaatcgacctgattcatatgatgggcgcattaaaaccggtgatgtcatcgtcttggacgcttccgtgaaaatgttcactgagctttcttcggagggggaagtggtaatgctcgaccttgatgggaagagcatggctaaagatgtatacaatgcatgcgccctcgggaaaatggtacgttactataaggaagctgacggtcacgatggaatcaagactgcttttacgcaggcctatgcgttggtgaataacgtaggcgattttactgctgagcagcaagagcagatgaatcgcgatttgcaattgatttgtacaccagcatcggaaatgtcttcagattcttttgccgatgcaaatactcttgtgctcaaccgtatcatgtatgaagaagatgaaactgggtgcaaaacctggtgggtggttgtcagtttgcatgccagtgattcgggatcggaatccgatcaggagatattgagcgccaaagctaaagaatatgaattattgcttggtggtcctcatcgacaagaggaaggccaccaagatcatgttgcggcacgagctgaggccttggcacgtatggtaggttttgatgatgacatggtcgagaatcttcgtattgctggcgaataccatgacgaaggcaaaatcgatgcacgcttccagactttgctttatcagggacgaaagccgcaggggcagcgaaagtttcgtgccaaaagtcgatttagctctcgtgcgtgggaacagcagttcaggaaccaatgtcagctgagagggtggcgtcatgagcagcgatccgtggctgaatttgtgttggcatgtgaaaccgaaacggaacttcgtcaattgccggaatatcgcagacagctgatcgaacgactcattggaacttcgcatggtcatggacggtcgaccttcgaacacgggacggactatctgttgccggagagcggaggagcatctagagcgcaagcgccggcgctgaacaatatcgctgatgatttgtttgaatctggagggtgggaagcccttattgatcgcaccaatcaacgatatggtttctggggagtctcctatatggaagcactcttaagagcggctgacatcacctgttcgaaggagggattgtaatggctattcggataccagcggatattactgacgccttttcccacctcatgatggtcggacttgcttcaattctggaagatgatgatagtggccgacattgcatgatccggtgggtcgattttcgtcatgcggaactgacgataagtgatgatttggatatggaagcagtatccgtcatagtcagtaatcatgcagaacgatggtcttccatgaaggcattgcaatctcgcggagactatacggtttccggtgcgagagatgcagggaagagctcttccatgcatgccactatgtcaccaagattgagtgctttgggtgtgccgggtggctgggagaaactgtctcaagatcgcgaagcggcgattgacgacttgcgaacttggggcgattaccggtatttcggggcattgggccaaccttcgtactggtcaggtgaacggagtaaaaagttatggtctgacgcaggtgcctcgcgttgggaaatggttacacgcaaccaaggccaggaattcgttcaaggtcgattgcttccattggctcaaaaggtagctgagcgttccgttcaagctgtacaagatgggttgatggggaaggatattgttgacgaagcgggcaaaaatagtgcgacgagtcgcactgcgactggactgcatgcgccgtcaaaaaccgataacgctcgcgcttggtgtgcattgatgggcgtgtctgctttccctacgtgggtttgcaccagtgctgggaacgatgatcgtgatccgagtacggctctgtttcagttgaaaggacctatccgtttcgctgtgcttcccataacagacaagccttggacggttgcgaaatatcgatcggtagttcgtagtagcgcgctcgccgaattcggcatacaacagaagaccacgacgaccgacatgacaacaattagctctgctgctgattggttgcgcgaaaaaggcgtgtgtgcctgcgtactgttcaaccagtttgtttccgacaacgctagcgcgccggaacgttggcttgagccgggagaaataattcctctgtaaatgcgaagaatcggagaaaaacatggacgatgaccccatcccgattagcttggttgccaactacatgttctgcccacgcagagcatggttggaagctgtcggagaaaaagtcgaatcggcacagattgcgcaaggcacgtatgatcatcgaaaagttgatcgttacggtggcgctccggacgccgattcatttcaagcggtaaatatcaggcatgagggatggggcgtttccgggcgccttgatgcagcgtgcatgacggatgatggaatcatcatccgcgaatataaggccaccccggtaaaacgtgcgatgcaagtcactgaagcaatgcgaacacagttagctttgcaggcggcttgtttggaagatatggggttctccgttgcgggcactgaaattttcttcaccacgcaccatcgtcgtgtggaagttgagcttgaccaagaggattatgaccaagcgcacaaagcggtagaggaaaccagagcgttgattaatgctggtcatgctcccgagcctctagaagatagcgccagatgcatgcgttgctctcatgctgggatatgtcttcctgaggaacgtcagctatgcgaagtcacgcatagaatcatggtgtcgtctccagacaaccaagtaacgcatttggcaaccccgggagccaaagcatttacacgatcaggtcgaatgatagtacagaagaatggtgaagaactcgcatccgtgccattggacaccattcaaggtctgcagatatacggaaacactgatctgtctagcggcctcattcgtgagctgatgtggcgcgatattccaatcgtatggtgtagcggaacgggaaggatgtatgggtgggcgacatcatcctatggtccgaacggtgaacatcgagtggatcagcacgttgcctctcatgaaggcagactcggactcgcgagagaatttatcatcgctaaaatacataatcagtccgtactgctcagacgttcagaatcagacaatctggtgctacctcagctgcgacaaatcgaaaaacaggtagctaacgcgaacaggtggcaggacgttttgggattagaaggcgaagctgcatcgctctatttttcgcagtttggacatctcgttaagactgaaaaaagagtcgattggccttgggtcgcaaggatgcgtcgtcccgctcccgatgagcttaactcattgctagacttcacttacactctgctgctttcagactgcgtgagagcattgatttcctgcgggcttgatccgcatgcgggctttctgcatagcagtaaacgaaacaagccagcactggcgttggatcttatggaggagtttcgcgctcccattgcggattccgtggtgcaaacagtcattaataatggcgaaatcagtgtagacggattttcacatgtgcttgaatcagtacgtatgactgataagacgcgtaagactgtcatccaggcatacgagaggcgtatggagacggagattacgcatccgatatttaaatacaaggcatcatggagacggattatcgagattcaggctcgaatgattctggggtaccttgacggaacgcaacctgaatacagggggatacgaattcggtagaagcggcaacggtggaagcggtttcatatcgggaggcggatgatgagtgacgaaaaacgaagttatcttgtggcgtacgacatcaatgatgatagacgtcgtgatcacgtggcaaaaatattacggtgctatggcgagaggttgcagtatagcgtgttctttctgcggattcggcctgcaaaaatgctggttgtccagaatctaatagaagttgaaatcgatggttcaacggattcagttgttgtctgttttctcggaaaagaagagcaggcaagagagggaatgtcattcttgggacgacgggaatacagtgatttaaccattccgacggttatctgatttcactttaacctctctgattgtctttcacctatgtgattgtggcttgataattcaaaaggttttttatgaattttggaatacgagaggtgaatcattgctgcgacacgcgatgacctctcgcatgaggaaatataagggtttatgtctctttttctggtgataaactgactggagggagaggtatctgttccgctctcgcaaagtttttaattcgcttagtcattagagcggattagaatgagaccattcctgagctaatcagctcaggacttcattgaggaacgccgactcaccaccggctaccgactcggcaaaatattcctgagctaatcagctcaggacttcattgaggaaagatgttgcgcgtgccgtcgatcgggttcacgggggattcctgagctaatcagctcaggacttcattgaggaaggatcaccgtgacgatcagcaacaactccacctgattcctgagctaatcagctcaggacttcattgaggacggcacggaagacaggacggggcacgtcaggcgatcggattcctgagctaatcagctcaggacttcattgaggatcgtcctcatgcggatccatgagctggtggacgtgttattcctgagctaatcagctcaggacttcattgaggagataggcaatgtttccatcaaaattatatcatgcggcgattcctgagctaatcagctcaggacttcattgaggatccatgctcataccggtggccggcagcgtgtcgcgggattcctgagctaatcagctcaggacttcattgaggaccgaccagccgggaagccgtccagcagacgaatactgattcctgagctaatcagctcaggacttcattgaggacagccgcagctggccgcagccgtcaagggcgcgaccattcctgagctaatcagctcaggacttcattgagggctggtctgcacgaaggaactgtgcgacgagatcgtaattcctgagctaatcagctcaggacttcattgagggaggtggcctgagcggtaaccttcaacacttcggcggattcctgagctaatcagctcaggacttcattgagggggaaagctatccggtcgtttaatcgccgatcagagattcctgagctaatcagctcaggacttcattgaggactcgacggtgacaaggtcggcagcgtcgtcaacggatattcctgagctaatcagctcaggacttcattgaggagcgcgcggcggcaatccggagactgaagccaggttcattcctgagctaatcagctcaggacttcattgaggattgtcggagtacgtgatggtgaactggtggttggcgattcctgagctaatcagctcaggacttcattgagagtctattggctctgattgtcgttgtgcgccctggcttgtgaagccgctttctgaattaggaatagctgctatcagggagggcaagagaactatgtcaaatttgacgtagattgtggcattttctgtggccaagttcatccttgatgaaaggatttctacttgtaatgtagtattggtgcgtatgatgctgagaattgacgagcgcgatttgaggtcgaagctcaatgagcacaggagccttattggatatggttccaagggcgacggcatcgccaacattgttgcgggcctattctatattccaacagcatggacgtttgcggaattgccgatgcgggcacgatgcttatttgctgtgctgggtgttgtgataatcgcgttgggtgtcgcgagtatcgtatgcaagggactcacttccgaaaaactatataaggaaatcgaatcgatgaacagaagagctagctctctcattgcggtcaaggatggcatggacgcgctgtccaaccggtatctgacgtattacgacgagcagtggaattgttggtttcttccgaaccatcgttcatttgattcgtatgaggaagacaaaagaaagctttcgtcatatctttcgtcggaattcaagattccgtctgacgatttccaaatgagattcgttggaactgcgaccagtacaaagttgtctaccgcgcataatgaggagcgcacttacgattaccgattgtatcttgcgtcggtgatccggattcctgatgcttgggatgctgaaggtgagttcgcgattggatccaagaagtgcaagtggatgacggtcggtgaaatgctgaacgacaggaaaatctacgccatcaaccatgacgtaatccaaatgctcaaggatctcatctgacacatgttgagaagttcacttcgcgtataagtcttcccctttctgtccgtagaaagccattttaactcaagtagataagttatgtaagagacatgcgagaacgagaagatttcctgagtgtccaatagacgtccggattttccgccacaacgtcgcgtatacgtccggcattatcggcactcgtgcatccagctgtgtctgcggttgcctcccatggagggtgactggactgtgattttgatgtatgcctagatgctgctttgcaggctgtctgcacaattcgaaattgaagcaagagtttcgggttgcgcagccgcaattgacggacggtgcgtctttcgggtgcaaaatgccttgatcgaaggcccgtgtcaaacggagctctcacgttattgctgtcaagaattggggaaataggcatcaggtttgaggattgcctgttgttaaggccgaaaacgactcaaggaaatctcggtggtagagattgttaagtaggaatggtcaaaattgttaaatagaggttagtgaaggttgatatatgcgatcttgcagagttggtgtgatgtgctaggggtgagcaccctcgttgacgcccggtttggcgacatccagggtactcttttctctgggagatgttttcgctagaggatgttgctttggtttagccaggcacgtaggtcacgaatttcctgatcgcagatgccgtggaccattcccggatattcgaaatacgtgagattgccggtttgcgcaagtttgttgtgcgcgcactgttggtcggctaaaggaattgtgcggtcttcgctgccgtagcagagtgcgaatcgcgtgcgtccggtcgcgggcaaaggctcagcggtttcgcctttgaatgatgggctcatcagaatcgccctgtcgaacgcatcgggatgttccgcaaccatgcgatacgacaggtatccgccctgcgaaaacccgatcagtaccttgcggaaatgcgcgtatgcgggcgaatccagcaatcgtacgacggcgtcgcctacggcactgcactcacgtcgacgctcttctacggaacatccatctggataccagtagtagcttccgatgtaaggacgttcgtacgtgccttggaacgacagataattcggatgctgggcaggagcaatggagttgtccgttgaagatgcgtctcgcttcggaacatcataaatcgcatcaataatgcggatcatctcattttcatcattgctgaatccatgaaatcccaagaacagcagatcatcgccgactatttcgcaggcggccgtctcaatgctggtactcacgttcaaacgcatatcaacctcccatcgcatgtcgatagtatgcagatttccaacggcaccataacggtggacagcgaagtggggaagggcacgacgttcaccgttatgctgccgttggttgaggaaaacactgaatatgtggcgaagtttacagcaatccatccgcatgcaacgcgccatacatgcggtccaggcattcgaccagcagcggatacggcattgctatgttcacgcgcacgcatccggcaccggtctcgccgcatgaacgcccgtcggtcaacgccacttgcgccttctcaaggaagtatgaggccggatcgtcgatgccaagcggcgagaaatcaagccatgcgatatatgtgccctgcggtttgatatagccgacgccggcgaacctttcacgtatctgctcgtcgaacaacgccaaattcctgcgcacataggcaaacgcatcctggaaccacaggtcgccttcgttatatgcggtggtggtggcgattgcgccgatggtggcggtctgatgttcgctccactccgccttgaccgcccacatgtcacgatccgcaggattggtaagcagcacctgcgcgcacttcgtgcccggaatattgaacgatttcgacgcgctggtagcggtcatcgactgtaatgcggcctgctcgctgatggtggggaacggaatgtgcttgccctcaaacacgaacggcgcatgaatctcatcattgaaaatacgcacgtcatactgtgccgcaagatcgctcagacgcagctcctcctccaaggtgagcactttgccgatcgggttgtgcgggttgcagagcacgaacgcatggcatccggccgcaaacgcgcgttcgatggcgtcgaagtcgaacacccattgcgcctctccggtttcggcgtcgccgctttgcagcatttcgatttcgatcacgtcaacgtcgtacagtttcggaacgctcaaaaacggcatgtaggcaggcgtcggcacgatcacgctgttgcccgcaccgaccagttcacgcaggaaaagctcataagcttcgagtacgtcgggaaccacgcgaataatgctcggatcgacatcccatccgtaatgcgagcgttgccatcctgcgcatgctgctgccacgcgctgtttccagggttcgggaatgtagccgagtttgcaatggtcgcaggcgttgtcgatggctttctgaatgcagggagccaagccgtagtccatttcggcaatgaacgcgccaatgcagccggggtagcgtgtccacttgtcggagccgactgcggcaagatcggctgcggtggtgtggtcgatggcgtcggcgtcaaagccggaaccggtacgatgcttcatttccatgatttcttccatggttccagcatgacgtaccgatgcttgcacgaacagtgtgttcttgtactgaaagcaaagactgttatgaagttttcttatatcagatgcttttgctattcaattattaatctgattatgacgatatagcaaaatactggaaacaattgtttgctgcagtattccgcgattgcgaataagcacggatatcaaacgatgaatcaaatgttttccaaatactggtgtgacgccctttcgatctcgtctttgacgcgggccactgccggtcggtcgtccacttttcttgtgacgaaacagactgtgcggaatgcgttgttgtcggcgattggcagtgcggccaaatcgggttggattccagcggttgtggctaagcgagatatgatcgagacgcccattccaacttccaccagattctgcgtggcccaaaaatcgtcggtcgaatgtgtgatttccggtgtgaagccggcggcacgcgccaacgacaccagattcgcctggcaggtttcgcagccggcgatccactgttcgctgcgtgccgaaaccaattggaccggcaggtgcgagctttcgtactggcgcgcgatcgcattgttcgcgccgatcagcagcaccagcggatcgacgccgaaaggagcgacttccaaatcgtccggtccggccaaagcggggagtgaattgtattggaagatgatcgcgcaatcggcaagtccctgttccagcgcctccatggcctcaggcggctccatctgcatgaggctcacgcgaatgtcggacgttttgctgatatgcacgagcacgcgtgccacgaacgacgaacataccgatgggggagcgaccaaacgaatatgcgtcgatccgttgcgctggtactcttccacatctttgacggcttgggtgacgcgattgtcgataagctgcccgtgacgtgccagaatacggccgatcggagtcaattccacgccatgcgacgtgcgctgcacgagctttgcgtcaagttcacgttcgatcttgcggatctgctggctgatggccggttgcgaccatccggtttcacgcgcgaccgcggagaacgagcccaaacgctccacgttccacaaggtcaccagaatctgcgggttcagtgttttcgtgctgaatcccgtggcattcgtggtgatgctgatgtcggtgttcgtgttggcgttttcacgcgtgttgctatcggctggagtgttcatatgagggtagtgctcagctttttaggaatgcggggatggcctcggccgccgcatagcctgcgcggtacatgcgttccaatccttcgaacgacttgctcaacgtgttcaggccgtacaggctttccggtgcgaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccttcgaacgacttgctcaacgtgttcaggccgtacaggctttccggtgcgaggatgagcacgcggccgtcctgctcgtattccttggccagcgccacttcgtcgttgtacgtctggtagcggttgagcagtttttccgcggcttgtggatgcgtgcgcctcaaaatcctggcggggccgatgtccctcttctgttcgcgtacggtgtctttcggacgggtgagtatcaccacgatgcggtcgtggccgtcatcgatggccttctgcaccggaatcggatcggcgatgccgccatcgtaatagggaatgccatcgatcgcatacggttcgcaagctaccggcaccgctgatgacgccttcaggatgtcgaaattgtcgtagcccacgtcggatttgccgaaatacttcgtggagccgtcttcggcgttgcacgcaaccacggtgaaaccggtcgggttggcttcgaaagccgcgtagtcaaccggattttcaccatcatgattgctgagcgtgctatacacgtaatcgaggttggcgaaattatggttcttgacatagctgtcgaagctcgcgtattccttgcggaacgcgtactgcgtgtagaacgtgtggttgcgcccatgctgcttcgcgatgaacgaaaccatgttggcgctgccggcggaaacaccatagcagtggtcgacgctgatgccgtcctcaagcatgcggtccatcacgcccgcaccgtaaatcgcacggaaaccgccgccgacgtcgatcattgccgtcctgtgagccatatgcgtcccgtcctttcgccgttcgtcccttttgcgggtttcaatcgactttacgcggtctaattgacgtatttttgcgtgttcggtcatttcttatcgaaggacgacgtaagatatctgcgaataatcaacaaaaatggagtggagaagatatcaatgaacgaagctgcactgcctcagtcgacggtccacatcgcccaagctgatccggacgggattctgctggtgattcacgcgggtgccggcaatcgtggcaaaaaggatacgccggagcgtcgtgcccaggtggagcaggatttgaacagggctcttgaagctggctatgcgttgctggagcagggggctccggcggaggatgccgtgtgcgcggctatccgtgttatggaggatgctccggagttcaacgctggtcgtggtgctgcgctgacgagtgaaggcatcgtatccatggattcctgcctgatgactggtgtcgatggcgaggttggttccgcgtgcggtctgaccacgtctaagaatccgatcaacgtagcgcgtgccatcaaggaaaagaccaagcatgtcatgtttgccaagcctggtaatgatttgcttaaggagtggggaatcgaactgtgcgacagtgattatttcatcactccggcacgtcaggaatccttgcgcgaggcgcaatccaacggcgatgagtgggagaagcatggcaccatcggcgctgtcgcccgtgactcgtccggcaacatcgctgccggcacctccaccggtggcattaccaaccagatgccgggacgtgtcggcgattcgcctctgccgggctgtggtacctatgccaacaacgattccgtcgcgatctcctgcaccggcatcggtgaggcgttcgtcaaggaagtcgctgcgcatcaggtttccgatcgtgttctgtacgccaaggaggagccggtcgaggctgcgaaggcggcgctggatggtgtcgcccgtcatcatggcgatggcggtatgatcgtcgttccggctcatggtgaaggcgcaatggtgttcaatagcgagatgatgaactgcggttggaagtctccgaagggtagctacgtgcagagttgatgctgtagtggcaaaccggcaaacaagccacaaaagtacagtggggttcgaatccatgaaggattcgaaccccactgtacttgagctccctatatggccggcgaatcgttcgtccgccggccagaaacatcacttagtgatggtgttgtaggtaggcagattggtgtaatcgaacgacacgttcttcacgttcgtcgcggacgcggcggcgacgttgtcgttccacagcggaatcaccggaagatccttggccagcacttcctgcgccttggtgaagtcctcggtccgcttctttacgtcggtctgggcaagtgcggcattcaggagctcgtcgaattccgcactcttgtaatcaccatcgttcgaaccatgaccgtcagcggagctggaggcatatagcggattgagataatcttcagcggacgggtaatccagcatccagccggcacggaacgcggttttgatggtgcggttggtcacctggttacgcacgtcgctgaacgtggcgtacggctcgccagcggcgtcgatgtcgagtgtgttcttgatctggttgcacacggcatcgacccattccttatggccgccatcggcgttataggcgattcggaagttgccggaccacggcttgatggcattggctttcttccagagttccttggccttggaagcgttgtatttcaggttgctgccattctgttccagtttcttcacatattcggggacgagcggtgaagtgaaatcggtggtcggggtcttcgtgttgttgtaaaccttcttgacgatctggtcgcggtcgatggccatggaaatggcctgacgacgcaactggccttcttcgtcgttgccgaaatgctcaagacgttccggaatgacgaaggactggaacgaggatcctgcctgactgtaggcgatcacgctggaatcctgacggaaggtcttcaccgcagactgtggaatctgatccatcacgtcgaggttgccagacagcacgtcggagtaagcggaatcctcattcgtgtagacgcggtattcgatgcctttgttggacaccttgcggctgcccttataatccttgtttggtacgacgatgatgttcttgtcgtgggaccaggacttgaacttgtacggaccattgccaatcggagcctggccgaacttcttgatgtccttaaatgccacgcttggcagcgggaacatggattggtgcgcgagcttggtcgggaatacggaatcaggcttgttcagctcgacgaccagcgtgtagtcgtccggggtggaaagaccggaaagcgtggccttcggatcgacgttcggatcctgcagttcgtcatagcccttgatggtggagaatcggcttgcggtcttctgcgcgttcttcacgttggcggcgaaactccaggtgtcggcgaaggaatgggcggttaccgcctcgccgttggtgaacttccagcctttcttcaacttgattgtgtacttggtggcatcctcgttcggggtgatactctcggcgacttcgagatgttgcttgccctttgcgtcgaagctcaccagaccttcgaacaggtatcgaataactctgccgccgcccatttcgttggtgtcgcttggaattagaccgttctgcggttcgctgttgttcactgaaatcagcgaggtgctatcggagccgttggaggctgtgtcatcgttggaagacgatccgcatgcggcgatcgacgtcagcatggcacccgccgcggccatggccagcagacgccgaaatgtgttgttcttcatttcattctcctttaatgtcgacttttccgccgattatgtcgacgaaaaaacaataggacataatatgggagttttataaaattttcgtgtcatgtctcaatttgaaaacgaaccgctggcaggcgttggatatggacgttatcttcagctttctaggaatgcggggatggcctcggccgccgcatagcccgcgcggtacatgcgttccaaaccttcgaacgacttgctcaacgtgttcaggccgtacaggctttccggcgcgaggatgagcacgcggccgtcctgctcgtattccttggccagcgccacttcgtcgttgtacgtctgataacggttgagcagtttttgcgggtttcaatcgactttacgcggtctatcggaacattcgcgctcagcgatcaagcagcgattgcgctaattgcgcgatttgtgtggaagtgtcggaattggccagctcgataccaccgtccgcgtcttccggagagagtttgcccaacgattcgagcactacgccaagatggcgcacggtaccttcgttgccgtcgatgattgccgctgtgtcgggcagcagttcgcggaaatagtcgcggtaaaacacgaaatgcgtgcagccaagcactaccgaatcgatcgtcgacaaatcatactggtcgaaatactggtgcagcgtgtgcatcacaacatcgtgatcgtcgagttggccgtgctcaacgatctccaccaaaccggggcagggttccggaaagatcgtatggtctgttttgaaacgatccatcagcacggcgaacttgcgttcccgcaacgtcaggggagtagctgcgacgatgacacgctgacgattgccatggcctcgatcgcacgccaccttcagcgctggttccatgccaatgatcggaatgtcgtatttgtcgcgcaactcgttggctgcggcggaagtggcggtattgcaagcgatgacaaccgctttcactccctgctccacgaaacgtttcacaatggcgtcggacagcttgcgtacctgttcaggtgatttggttccgtaaggagcgttcgcggaatcgccaaaatacagcacgcgttcgttcggcatatcgcggcggatttcgcgcgccacggaaatcccgcccaaaccggaatcgaaaacgccgattggtgccgttgaagtcatacgtcctcccttgttccgcacgcaaacatactgcaacataatgcacacgtgttgcgtccaacttcttcaatagcctaccgcgtgtagagtgaatcggtatgagcattccaagcattgtttacaaagcacacgccaccggcaacgatttcgtggtgtatctggacgccgaaggcacgtacgagcctaccgccgatgaagtgcgattcctgtgcgaccgtcatttcggtatcggtggcgatggcttgatccgccttactcatccgcaggcggtgtccgatttgaacgacaagcagattgccgtttgtgctgccgacaatgcggattggttcatggactaccgcaacgcggatggttcgttggctgagatgtgcggcaacggcacgcgtgcgatcactctgttcgcgcaacggcagggtattgccggtcagccgggcggtgaaccgttccgtctcggcacccgtgccggtgtgaaggttctgacttcacttggcgatgtgccgactcttggcaaggacgtgttccaggttgagatgggttcatggaagcgtggcgatcttgatggatacgaagtgacgattcccggcacggccggttccgcacgcggcacgttcgtggacatgggcaatccgcatgtggtggccgtcatcgaagacgcgttctccagcctgccgacggtggaacagcttgatttggtgaccaagccggtggtcgcgccccgaatcgaaagcgaccagaatgttgagttcgtgcgcatcgacgagcaaagcgaaggcgacaacgagggcaacgccaccatgcgcgtcaacgaacgcggctgcggcgaaaccctgtcgtgcggaaccggcctgtgcgccaccgccatcacgttgcgtgccaaaaccggcatcgaccattggacgatcaccgtgcgtggcggcaccctgcgcgtcgacgtgaccgataacgacgtgaaactcaccggatcggccaccatcgtcggcaaaatcgaactgctgtaaggttttgcgcataacactgaaatttgcggatacgcaaaagaaagaagccggctgtttccagtcggcttctcttgtaggcgagtgaatccctactgctgattggacgttacttgacgtcaactgaacagcagggggccgtcttcgacgagaatgatcacaatcaatgtcacgatccataaggcatcgaccatcagatcgtaattaagacggtagtaggtgcgtacgccctcgcgcttggccggaatctcctgaaccaccgccgtggcatgagacaacgccatgaactgcacggtggtggagaacatcaggcacagacaccacgggcatagcgcgttgatcacaaacaacgactgcgaggtcagccaatacgaataagccagcgcggccaatccacccagccatgtgcacaacgcaaaccagcggggcacggcgaccttcgtcaaaccgatcaccgcgatcgttacgaacactgattccgcggcgatgccgaagaacgcattcgggaaactcaaaccggcgaacttcacaacctcagcctgccacgattccgcaaccgcggaacacgacatcacggcattcacatcacagctgagcttctgaccgggattgcgcgccaatttcagtgtctcggcggaaagcacgaacgatacgaccagcgctaccgccgaggcgatcagcatgatcagatacgtccatgtcgcggtatgccgccaaccgcgcggcttcgtataatcatcgtcgagagtggcttcggcaacctgttcgccggaaaaatcgctcatcgtgcatccttgaatcaaaatacaaacgttgtcatcgcctagtttacgcggtattgtgccgagtcgcgccaaaaacagcttacgatggatacatgattcgcgtaggcactgcggcaccgcccgctgaaggttgggacattcactgccataccgttttttccgacggtacggaaacgccgcgtgcgttgttgcaggaagcgagagcattgcgattgcatggtgttgcgattgccgatcatgacacgacctccggttggcaggatgcgttggctgcttcgcgggaggtcagattgccgttgttacgcggtacggaaatcactgccgtcgatgagagcgtatccgtgcacatgctcgcattccaatatgatccgctgaacgccgatatcagcgagatgttcgcgtccacccgcgaggcgcgactgcgtagaaccaagcgcatggtcgaactgatggcgcaggattttccgattacgtgggatgatgtgctcgcgcaggtgcgtgaaggcaaacgcaccacgataggccggccgcatatcgccgacgcattggtggctgccggcgtgtatgaaacacgatccgacgctttcgccgatgcggtgagcgcaacgtcgaaatattacattcccacgccatcaccgaccacgcacgacgtggtggccgcggtcaagggtgcgggcggggtggtggttatcgcccacgccggagacccccggcgcaatcggacattactgaccgaccggcaaatcgaatctctcatcaccgaaggcttggacggtttggaagtgtggcatcgcggcaatccatcagaacagcgtgaacgtctgctcaccattgcgcgccggcacgacctgctggtgactggcggatccgattggcatggtaaaggcaagccgaacgcgctgggggagaacctcaccagcgacgaaacagttcaggaaatcatcaatcgaggcgtccgcttgagcaaagaatcgtcgaaggcgaaaataaaaaaccaaaacgcaatcatcgacgcgtaattgagatatgaaaccagaaacgagttgatcgcccaaaatggaaaagccaggcgcgaacgtctagcttttcttgttacgtcgaaaacgtgtgtttcagttcgaagctgaaatctggtgatgcgaacgggtcagaggttgccgaaaccgacggcgtgcttggtttcggaaccgatgatggcgtagccgagcgagcctgccggcaccacgatgcgacgacccttgtcgtccgtcagattgatggtcttgccgttctccacggcgtcggcgatggccgcgttgacctcatcggcgctctgttcggtgctgaaggtgacggtgcgggccacattctgaatgccgagttcaatatccatggatgctccttcgtgataatgcgcaatgcatgcgcacgtgtatgtacgggttatgtgcgcctattctacgcgtagcttctcatcggtggcgtcttccgcctcccactgattgatctgcgcctgcgctttctgcatggtcgcctcatctcgctccaacagtggaatgagtactgtcgcggcctcgctgtgcgatgcgggaatcgattcctcgttcgtatcgtcgttgtcgtcggccgtttccagcctgctgattaccatggtggaacttgacggcatggattcgtgccgttcttttgcggaatgttccggaatgaaagtgctgaccgaggtcgcctcatgttcattcgtattgccggacggtgcttgtgatggctgggctccggccggtacgaacgcttccgtcgcgtcgttgacgatttccttcgtcttgcggaccggctgggagccggtcacgtcgaaatcgccggtcgcgtcgaaatctccagtggaatcatccatatccacagcgtcaacatgacgttcgccggtcgtgtcggaatcattctgctgtgcggccgcgttacggcgacgctccgattcgttcagcaacgtgcctacggtgattgtgctcggcgggcgctgggggcgatccttggactcctgcttcgtttcagtttgcacgcgattcttcgctgtggcgacacccaactggtgggccaggcgttccacctgcgccttgaattgcataatcttggcgttgtctgccttgttcaaagcggaaataaaatcgccgacctgctccatctgcagccacagattggcccgcagcataatcagatcatccaaacgattgcccaacatgcgaccgtatgcggaaagcaaggcattgcggtggttctcgtcaagcttggcgaaaatccaagccaaatcgcgggcaggatcgttgacctgcatatcctgccaattcgtgaccgcggtgatggacgaaccggaaaaaagcacatcgccgtcacgcaacccgccatgcaccgggcaagtggagaacgaccataggccgtcggtttcaagaatattcgcccaactagtggtgatctcctgcggaacatgaccagcctgacgcaggcgcttgatccaagcggtcagctgagcgcgaatctggccggtgacaaacgtcggatagcccgcttcctgcaggaagtcgggacgaaggcgatgaatcgcgcccaaagcggtgcctacgctggaacaatcatccaaagtcagcagctccaacggccgcgcctgacccacatggtgggtggccaccagcacggacgtatctccagtggcggaatgcttcaaatcgccgtttgaaaaagctactatgctatcgacggcaaaacccaatccgcctaattcgcgggcttgcgagagcgtctgcgcagcgcgcacgcgaccggcaagacgcttacggccttcaggcgtgttggatgcgaacacgtcatacagcttgcccgctgcatcctgaaccacggcatggtcgacgccgtacccctcgtcggtcgggttggtctgttcgctggcacgcgcgcccgcaatggcggcgttcggcatcgccgcactcgtcagggcagctatcataaatttgcttcgttcggtcacaattccaaccttaatacacaataggggcgaagcgttgccgacttgccagtaaaactgcaggtgaaccgcgggcaaatcgtcacatggcgacggcaatctgccacaatggaacgtatgagtgcaacagcggaagagattcttgacggattggatgaggcgcaaagggcggccgcaacggccgtggacggtccagtgcgcatcatcgcgggcgcgggcgcgggcaagacgcgaaccgttgcccgcagaatcgcctatgcgtgcgccaccaaagcgtggaatccacgaagcacgatcgcagtcacattctccgtcaaagcggcggcggaaatgcgtagccgcctatcgaaactcgatgtcgcagccgacgtcaaagcagccaccttccactccgcggccctccatcagctacgccaagtgtggccggacgtatgcgaggggccgatgccgttcatttccagaaatccacgtgaactggtggagcgctcgctgcgccgcgtcaccaccttccaagtggatgacgacaccatacgtaacttgcaagcggaaatcaactggtgcaaaatctcactgatcgcaccggaagattacgcgcgggtttgcgcggcaacgcatcgacagccgccatcaggcctcgaaccaagccaattcgtagacgtatacaaagcgtatgaggcagaaaaaaccaaccgcaacgaaatcgatttcgacgatattctgctgatcgtttgtcatctgatggaaagcgacgaggaagtggcctcagctatccgctccaacatcagatggcttaccgtcgacgagtaccaggacgtttcgccattgcagcaccgtctgctcacccgatggctcggctcaaaccgcaatatttgcgtggtgggcgatccggcgcagaccatctactcgttcgcgggcgcaagtagctacagtctgctcaacttcgattcggaattcggtccgctcaccgctgacatcaatctgaacaacgactaccgttccacgccgcagatcgtcaactatgccaatcgtgtgcttgcggcatcgccgcagcgggccgattatctgaagctcagctctgaaaggaacaaaggacggagggtcgtggaaaccatatatggcagcgattgggaggaagcgcaaggtgtggcggcgcgcatccgcaaactggtggatgcgggggagtcgccggccgattgcgcgattctcaccagagtcaacgcgcagcagaaaatcctgtgcaaggcattggccgaacagcatttgagatatcgcgtgcgcagggatagcggatggcagaattccgcactttccgacgacacgcagaccagactggccatgttggaggcattgggcgtcggcgcggatctgagcggcgtgaccatttccactatccacgcgtccaaaggtttggaattcaagcacgtgttccttatcggctgctcggaaggactcataccgtatgggttgccgcaggatgacgacgtgcttgaggaggaacgccggctcatgtatgtggccgtgacgcgcgccgaagacacgcttgacgtctcatatgcgcgtacccgtgaaggcaatgagggtgaaagggcacgacgggtgtcgcgctttttccgctgatactgctaacggaatagcgcgattactcggcgtcggtatcgttgttgctgccggattctgcggaatcgtcagaatcgctgccattggtatcggattcgccgcccttgtgctcttcctcgtcaagcagcttgctgagttcggcatcccaatcgatggtcatgccatcggcgtcgccaaggggctgcgacgccatatcggtggcattggaagcggcgaacgtcgtattttccgtgttttccgacgatccgttgttctgcgactgtgaggtgttgtcatcgtcatcattcggcagttgcggcagtagatcgggatgtgaccatttcgcgtctcgtgcctgcgcgccttccgtagcgcagatgttatcccacaatgcggccgcttcacgcatgcgcttcgggcgtaattgcaagccgatcaggctttcgaaggtgcgttccgcaggacctccgatggcgcgctcgcggcggagcatctcacgaagctgttcgatatgcggaatatgagccatgccggcgcgccacactacggtgtctacccaaccctctaccaaggcgagcagattctccagcgatttcatggcctgctgttgttcaggcgtgtcagggaacgccaccttggtgatgttcaccgcgtcggccatggaatccgggtcgacggactgcgcatcgcggatctgctcctccatggcgtccaaatcgatgctggtgccacgggcatacttgcccaacagcgcctcgaagcgtggcatcagccacggcacggaagcgtacagacgcgaatgggcgagctcttgcagtgcaagatagctcattacttcgttcacgtcgatttccaaggatttcgcatattcgacgacattctgcacgatcaggcctccagccggattcttcagcaacgaaatgctttggtcgaaactgccgcgcacctcatgcgacaaatcgccggcggcacgtcccagctgcatggcgaacgacgtattgccgacgaaacgcatgagttttgccggatctttcatatcatcgggaatcggaatctgcaccggaccggcgaaaatgccggaaatttccgtatggaattcggaatcgccgaaacgctgtgacaaaatcgaagccagagcgtcgctcatcgactcggcaatcggggatgcaaactgcgcccaggaatcgatgcatccttccacccagcctgcgcgggtaagcacctgcgtttcgccttgcgcggggttgaattcgcaagcggtgtcaagccacagattcgcctcgctgatggctcgccgggccatctcgccgtactccgcgctcacactggtttccgatccttcgccattggcctgctgcaatgccaatgatttcgccagtttgacgttgattggaccttcctcggtgatgtgctggatgtctccgaaagtgttgagcccgcccgcagtgaacgcctgcatcatcgacctgacctcggccggcttgggaagcttgctcacatcctgactcatcaactggtcgcgcaactcttccggcatgttggaaaactggttccatgccatctcgccttgaattggtccgaaacaatcgataaaccattggcggatcgcgttctcgtccatgccggccctgccttttcctaagcgttttttcaagtttggttggttccatactatgttatgggaggtatgcccaagatgaaggaaacacgacgaattcacggcaaaaacacacgtagcggagctccgggacgtgtcaaacgatggctgataggcgcggaaggttggctgtccgcgcgttcatggcgttatcttgcaggaccgttggtggcggtactgtgcgtattggtgttgattatgcccagcgcgtatgtggtgcaggtgcccggcccgacacagaatgtgctcggggaggtttccggcaagcaggtcatcgccgtttccggtgcgaaaacgtataaggattcaggccaactgctgttggtcacggtcaatgcttcaggcgtgccagggtacccggtgtcgaacgcgcaggcattggtggcgtgggccgattcgaaatccacggtgatgcctcaggaagcggtggttcctgttgggcagaccgcagaggaatacaagcagtccagcgacaaggagatgacgtcatcgcaggattccgccaccgcagcggcgaaaaagttcctggaagagcatggttatgacgtgtccggcatgaaggtgtccatgcatgtggacgacatcggcgggccgtcggcgggcatgatgtacacgcttggtctgatcgacaaggtgaccggtgaaaaactttctgggggtaagatcatcgcgggaacgggcactatgaacgacaaaggtgaagtcggtgaaatcggaggcatccgtttgaagatgctcggagcgaaacgcgacggagcaacttggttccttgccccggaatccaattgttccagcgttgtggatcatattccggaaggtttgaacgtggtgaaggtgtccactttgcaggaggcgtacgatgcgctggttgccgtccgagacggcaagggtgcatccctgccgcaatgctccgcgggagagtgacgcattccgagatataagaaaaaacaatctcgcaaagtgagcaattccacggttcgtaacgtatatgttcgagcagtgttggtatattgacgaacgtgaatcaaacggcatctgataacgctgaagaattcggtttccacgccggcgacctggtacaggaatggctgtgggacgatgatgtggacgactcgatccgcgccaagatcgaggagctgaccggtgaagagctggtcgacgaggactatgattccgccgttgatggcgtgattatctggtggcgcgacggcgatgacgaagacgaactgtctgacaccatcgtcgatgcgtatgcggtcctcggcgacgatggtccattgtgggtgctcaccccgaagccggggcgcccgggcgcggcaagttcaagcaccgtgcagtccgccgcgaagaccgccggcatgaatgcagccacgccgctgaccgtcagcggtgactggaacggcatccgtctgcgcgcattcggcaaaggccgctgatcgtattcgttttacccgcctcgacacgcatggccaaggtcgggcgctcatataaaggcttggaatcacacgattccgagccttttttgcttgcggaagcagtcgaagaagatgtttccatgaaattgtctatattgacaaaagtcatgactttgctgacacgcacacgagatagttgggaatatcagaagagtcggaacggcttattttctgcggaaacaaaaggtgggcgatgagggactcgaacccccgacatccaccgtgtaaaggtggcgctctaaccaactgagctaatcgcccgcaaaactctactgtacagtattcgttgcctgcgacagcttcaacgtgtgtcgcgctgcccaataggggttccttccatagtaaatgcgtgaaaaatggtgtgatttgagtgtcgattcgctgaattttccacaagaaagccaaaagcgtcgaatcaatcacgtagagtaaggacgttgagtagtgcagtaggaggtcgatagccaatggcgcaggaacctgaatccgagaggaacgcatcggggatcgctcgtacttcaaagcgcaagtgggggtatgattccgaacaggtggacgcttttcttgagcgtgcgcacatgctgtacgaaggtgagggagcgcaactcacccagcatgatattcagaatgtttctttcgatttggtcaaaggcggctatgtgatcgcccaagtggacgcggcccttgctcgtttggagcgcgccgtggtggacaagcagaccacatgggagatttcgcagcacggtcgtgtggcgtggaaagcgcagaccgaaagtctgttccgccagcttgacgcccattccaaacgtgagcacggcgaacgtttcaagccaggagaaggcaaggaaccgagctatgaccgcaagcaagtggatcgcatcgtcgatcagtgcctgacgaaggccgctggcgagctcggcgttgaggaagtgtcggaagacgatgccaagaaacttgtcgatctgaactcccagaccgtggcgaatgtgatcttcacccagcgcaagggcaagcgtggctatgacgagcgtcaggtggattattacctgaacgaatgcgtgcagctgctgaccagactcgaatcctatgctcgtgtggccgacttcgtgggcgagccctccgaaagcgcgatgaccgcagccaatccgcccgcaaccagtctggcatcccaagagacgcaggtggtctcgccgttattcgccgttccagccgtttccgcagaacctattgcgcagcccgctcaggttcaaaacagcactgactccttcgacgctttgaataaggcggaacgtgagattttcaccacgcctgcaacgtccccggtgagcattccggccactcaaaccgctgcgccgacgtatgctcccgtggttccgcctgtgttccagccaaccatcagcaccccgtcggctccggtaactccggcagctcctgtaacgccggaacctcaggccgctccggttgctccagcggctccggaacagtcgttggcacacctgttcaaagcgtccaatgcggttgacgaggagccatcttccgcaggaacggaaaccgaagcgttcaatccgctttctgatgatggcgcgccgagctatgacgctccggccgcgcctgcggctcctgtgattccagacacttcggtcgcacatcagccggaagaatctcacggcatcaccatcgctcccgattcttcgttggctgccttggcgcagatggcccagaacatcgacgctcccgatccggtcgaagacacgttcaccccgcgcatgccaagcctgtcgacgccgaaccttccgcaggtcaataccgactcgattaatctcggaaccttgccgaccgtcccaccctccttcacgctggaaccagcaacctccgcagatcactcgacaacggcaactcccgttgaaccggcgaaaccggcagaggaagagaagaagaacgaaaccaagccggcaaccaatccgatgttcgaagcatccaacagcaatctggatgtcgatattcccgacctgtcgttcccctcttttgaataggcaatcgcactgaacaggctgacgtgaccgtcagcctgttttcgcgttcacacgaataatccaaaacaaatacggagcacacgcataacccatgcaaacctcaaccgtagtcattctgggatccaccggatccatcggcacccaaggacttgacgtcatctcccgccatctcgaccgtttcaacgtggtcggacttgcggcaggcggctcccacgtggaacttctggcccaacaggcggtccaatttcacgtttcgaaagtcgccatcttcaacacaaacgcggtccatgcgctccaagatgcgctaaaccaagccggcgcaagccatgtggaaatcatggccgggccggaagcggtaatcgccatggccggatccggtgccgacgtggtgttgaacggcattaccggatccatcggccttgaaccttcgattgcggcactgcaggcaggatcgcagctggcgctcgccaacaaggaatccgttgtggccggcggtcatctgctgttcgacgcacaggttcgtgcgcagcagatcaatccggttgattccgaacattccgccatctggcaatcgttgcgttcgggcacgcacggtgaagtgtcgaaactcgtggtcaccgcttccggaggtccgttccgcggttggaaacgcgagcagatgaccgacatcacgcctgaacaggcgttgaaccaccctacttggaatatgggtccggtggtgaccatcaactcgtccacgttgatgaacaaggggcttgaagtcatcgaagcgagccgtctgttcgacgtgcctccgagccgtatcgacgtgaccgtgcacccgcaatccatcgtgcattccatggtggaattccgcgatggcgccaccatcgcacaggcttcaccgcctgatatgcgtctgccgatcgcgcttggcctatcggctcccgaacgacttggcaacatcgcagcggcctgtgattggacgaaagccgccatgtggacgttcgaaccgcttgacgatgaggcattccccgcagtgagcttggctcgacattgcttggaagcttccgaaaagcatacggccgtgctgaatgctgccaacgaacaggccgttcacgccttcctcgaacatcgcttgccatatctcggcatcgtcgataccgtcaaggaagtgttggacgaaatggatgcggaactgcgcggcaatccgctattcgcttccgtggaggaaatgagccaactcgagctggaagcccgtcgtcgagccgacgacctgataaacaagtaacggaaaacgaaacaaaacaaacagacgaaacgtaagtgacgcaaggctccctaagtcgggagccttgttattgcaaggatttgacgtatgccagaaatcgaaaagccgttccgtaaaaccggtgaggcagccattagcgaaagcccgctgcatccgcgccgcaaatcgcaccgtattatggtcggtcccgttccagtcggcgggggagcgccaatctcggtgcaatccatgaccaatacgctgacagccaatgttcccgcgacattgcagcagatcgcggaactgaccgcagccggctgcgatatcgtgcgcgtggccgtaccaagccaggatgatgccgacgcattgccggaaatcgtaaggaaatcaccgattccggtcatcgccgatattcatttccaaagcaaatacgtgttccaggccattgacgcgggctgcgctgcggtgcgtgtgaaccccggcaacatccgcaaattcgacgaggttggcccttccatttgcaaagccgccacggacgcgggcatttcgttgcgcatcggcgtgaacgcgggctcgctcgataaggaactgtatgcgaaatatggcggtccgacgccggaggcactggttgcgtccgccatgaaggaagcgcgcatgttcgaagacgtcggcttccatgatttcaagatttccgtcaagcatcatgatgtgatcaccatggtggaaacgtatcgtctgctcgcttccaagggtgattggccgttgcatcttggcgtcaccgaagctggaccggcatggcagggcaccatcaaaagctgtttggcattcggtgcgctgctggctgaaggcattggagacacgattcgcgtttcgctgtcggcaccgcccgtcgaagaagtgaaagtcgggtgcaagctgctggaatacatgggattgcgtccgcgcaagttcgacattatctcctgcccgagctgcggtcgttcccaagttgatgtgattcagttggccaatgcggtgaccgaaggtttaaaggatgtgaccgcgccgattcgcgtggctgttatgggctgcatcgtcaacggtccgggcgaggcccgtgaagccgatttgggtgtggcatccggcaacggcaagggacagattttcatcaagggcaaagtcattcaaaccgtgccggaagaccagattgtggaaacgctgctggtcaaagcgcaggagatcgccgcgcagatggaagcggacggacaggtgtccgtcaacgccacaggaccggtggtggtgccggtggcgcaaggtaattgttgatttcgctgaccgcgggcggtcgattgcagattgtgatcggccgcccgctggttttgctggttgtcgattgccatttcagctggagtcggtacaatgaacggcgtgtcagatcaggaacgtcagtcagtcatgtccagcgcggagagccaatccagtcagtggacgaggggcagacggctgatggtcagtctgcctatcttcatcatcctgctgggcattctggtgtcggtatccaatttgacggcatcgtcatggaagtacgagccaaccggtcaaaccatcgaaacgttatcatccgacacggcagtgaccttcgataatccttccggcaaaacccttgccaaacgaggcgattacgaagtgacgcaacgatatgtcaccattgaggcgaaacagccgtcaaccggtgaaatacaacaggtcaaagtgttgattcgagagccgaaagacgcgggaaacaatcggcccggcgtggtgttcatgcatggtgccggatatggtacctgtgacaactcatttggagacatggccaccgatctctcatccgcaggcttcgtgacggccgtgctcgacaagccggtatggtccaccaacgatgcgacccgtgattacccgggctccgcggccatttacgatcaggtcatcaccatgttgcgtgatctcgacaacgttgacgcttcgaatgtcggcatttacgcgacttccgaaagcacttggatttcctcatatctgcttgatcaagaccccgacgtggcattccaggtgttgctgagcccaatggtgtattcgccacgacattcgttgggattccttgccgcacaggatttcgcgctggtcggagcgcatgatggataccagtccattgtgcgccgcgcgttcaacatcgatgcggaattgttcggcctggccaatctcgacctcgacacgttgaatccccaagcctattccattcccacgcttgtggcatacggcaccaaagacgtgatgaccgcgcaggtggaaggtacggagaaaatcatcgacatggcgcataaggcgggcaattgggacgtgaccgtgcgcacataccccatcgccaaccatgtgctccgactcggcgacgaatccaacagcggcactccgttcgccgacgcctacgtggatgatgtaatcagttgggctgtcggcatcacgcggggactgcagcagaccagcgagcgtgtggccggtaccaacttgtatcagtcgattgcggtgccgttggaattgcaggcgaacagcgggctgaccatttatctcgtggtgctgcatgccagcatggtgctgttgctgctggtgatcggcgtgctgtggctgattgtgctcgtacgtaagatttgggcgcatgcgcatcgacgccgatatgtgttggggctgagacctgtgttcaaaaatgcgttgattacgcttgccgttgccaccatggccacttttgtgctgtttggtgcaggattgggcgaagtggttatgggcgtggtcaagctagcgtggggtggcgctcccgccgaggatccgggcatgatgtattggagttggccggttattcaaatggtgtgtgttgttgtggtgtgggcgtggtcccgcgtgttcgtgcgtcttatcgaggaggcgacgaatcgtggtcttgcacaatggccaccgcgtaagggggctataggcgcgattgtgagtggccgccagccggtgctcgcgtcgacgaggttcggccgtgtgatgttttggatcacggcggtcaccatgctgtatgtgctgttggtgttcgcgttctggggattgtttatttactgatatcgcgggagagtgcggctggcgcgagaacgtgcggaaagtatagatagttcagttaagaaaacgagtcgaggcgaaggaggtgtgtgaatgccgttgtatcaggacgagggcgtggtcttgcgtaccgtcaaacttggcgaagctgatcgtatcgtcactttgctgacacgtgaccatggcaaaatccgcgccgtcgccaaaggtgtgcgtcgaaccaaatcgcgtttcggaggtcgtttggagcctttcatgcgcgtctcgttgcttattgcggaagggcgttcgcttgatgtgatttcccaagccgagtcggtgtcggcgtatgcgagaggcatctgcaccgatttcaaggcgtataccgcagcgaatgtgatttgcgaaaccgctgacaagctggtggtgacggagcaggagcgttccgtggcacagtatcggctggtgctgggagcgttgaatgccctttccaagcatgcgcatgaggctgctgcgattggcgattcctacgtgatgcgtgctcttgcgatcgctggctggacgccgcgtttgcgtgcctgcgtggtgtgcggggagccgatttctgctgatcgtccatggttcttttcgatttctgcgggtggcctgatgtgtttgaccgatcatattcgtgaatcgtttgatgtttcgtggaatgcgatctgccagttgcaggcgcttgtagacggcgattggggagagctggacggcacggcgttgcttccggaaacccgacaaatggtggaaaaatggggtgaatactatttggaacgtccgattcgttccatgcgcttgctagattagcgggtatggcttttgagaacgtggattacaagtcccttgacattccggcggcaccattttctgacccgtcgattattcctgattttccgaagaacaaggttccgcgccatatcggcgtgatcatggacggtaatggtcgttgggcgcagcagcgtgggctgattcgcaccgacgggcatcaggctgccgaaccggtggtgttcgacaccatcgcaggtgccatcgaagccggtgtgcgttacctgtcgctgtatacgttctccacggagaactggaagcgttccccgcaggaagtgcgcttcctgatgggcttctcgcgtgacatcatccaccgtcgtgtggagcagatgaacgcgtggggcgtgcgcgtgcgctggtccggccgacgtccgaaactatggaaatccgttatcgacgaattggaaaaagcacaggaacgtaccaaaaacaacacgaccatcgacgtggtgttctgcctgaattacggcggacgtgccgaaatcgcggatgcttgcgcggcaatcgcaaaggaagtgcgtgacggcaagatctccggcgatcgcgtaacggaaaaaatgatttccgaacacctgtacaatcctgatattcctgattgcgatttggtgattcgtacttccggcgaacagcgcacgtcgaacttcctgccgtgggaagcggcatatgccgaacttgatttcgtgccggaactgttccccgattgcggtcgagacgtgctatggcgttcgatcgaccactacattcaccgcgaccgtcgtttcggcggcgtcaaaaagtagtttttgctgagttgattaggttaactgcggggagaacataatgttctccccgttttgtttgctacaacgtgctgattcgggtggtgaaggtggggacgaaacgggaggagtcgacttggaaggctacgtggatgcggggtgcgttggagttgatcagtccggcgggatcgccgatggttcggcctcgggtgccgtggaaatcgccggtttcgagttcgactttcattggtaggtcgatacaggtcaccagcgacggatccacggcaacggcggcggccagcggatcatgcaatggcatgccctgtgaaaacagtcgcgcgtcggccttgagatttgcggcaatggaaaaatcagccatgtcggcgaggaatacgcgcacatcggaagcagatgggcttgcagccacactcgaggttcgagctgaagctgcatttgaactaccagctgaaccatcaagtgaatcagcgacttgggatgcggtcgagctggtaagtgtgtcagcattcgccgcttcgcgccaagcacgggtcgcatcggaacccatcaggcattgatgcgttacgtccaagccgaccatggtgatgtcggcatcggaatggaacacgcgatctgcggcttccggatcctgaatgatgttcgtttccgcagtcagatcccaacagttgccttcctgcgtcaacgtgccgcccatcatcaccagtttgagtttgccggcaatatccggtgcggccgtgatcgcagcatcaatatcggtcagcggaccggtcgcaaccacagtgacgtcgaaaccataagcgcgaacctgatcaataatgaactgcacgccttcggaaaccgagtcggcggaagaatcgtcagcatgaataaaagaagccgaatccgtagtaagcgacaattcaaacgaatcaaccgcaggattcgcatgaacatcatccaacgcatatccgccaacggaaatcagactacgataatcacgagaaaaaacagtatcagaaccggaattatccgaaaaaatatctgaaaaagcagtatccgaagacgaactatcgcaagccgggccgaatcctcccaatccgtccgtgccgtgaaactgcgcacaacctgcatccggaatgaaacaccgagcccatgaaggatgcgacgatccacgtatcaccggaatgtgccgaagccccaaccgttccagcacatacgaagtattgcgaaccgcagtgtcgacggaaacattgccgtacgtgccgatcacgccaagcacgtcaacagtgtcgaacgtcgcaaggtatgccaacgccagtgcatcgtcgataccggtgtccacatcaagaatcagtcgtgtcatatttttatttaatcaaactcgtgcaatgaagccaaatgcaacgcataatggtgcggcatcccacaaaccatgttcaacccgaactgagcaagcagtgttgggcatgaaataaaaatgcaggatgccgtattccaatatttcgattattcgcacataaacgagttacaaacctactcgttcaaacccgattatttcaggaactcgtcggtggcgagatccttggcctgcggagcgtcgtgcaccaccttgtcatgcgaatcggtgtaggcgtcttcctgagcgaggaagtcgaaatactgctgggcgccttcaacgtcgttcgtaccgaacgtgaacgaaccatccttgatcttggcgggatcgccccaatactggccgtccacaatggttttcatgcttttcttgacgaaatcaagcttgagattcgcgtcgggagcttccttcacaaggatcttcgccgcatcgtcaggattcgaatatgcgtactcgtagcccttcttggtggcttgtacgaacttcttcaccagttcgggattgttggaaatcgtcttgtcgctggtgatcacgccaatagtgtcggcattgccgggaacgccgtaatccggttcggtaaagcagttgagcttcggaccgtacatgtcggcctgcacaccctcccaagtggcatagaaaccaccgaaatcagccttgttgctggacagcgtttggaacgtggacgtgccgacggtcaccttgtcgaattcgcccttacctccgtccgactgaatcatgcgacggatcaccgcatcggattcgttggatccgaacgtggcgaaagtcttgccgtcgaaatccttcggggatttgatttcagtgttggaagcgagcgaacaccagatggcgcttggcttctgctgtacctgcagcacctgcttgatggttgcgcccttaacagcgtacgtgcttacgttggtgaggttcgacaatgcgaagtcggccacgccgttgttcacggcctgttcggcaccggcctgtgccacggccacgatatcaacgtcaagacctgcctctttgaaataacccttgtttttcgccacatatacgccgatatgattggtgtcgggcgcccaggacagcatgaaggtcactttggtcagatcgctgctgccagatgctgtgcttgttacggaatcgttgctttgtccgcatgcggtaacgctgaacaacatggcgattgcgctgaagagtgcgattattgtgcttgcgatgtgagtacgtgcggtggcgtcatgcctgctgaagatgctcataaagcgatttcccttgaatctgtattctctatcgttttctagggatatgctgcgagcggagttcgggcagaaaacgatacgaagggcctcaggcccccgctcgtccaatgcccccgacattccttacggtgcctagtgaaaggcgtggaatattgccggtttgccacacattggcttaacagcggattttattatacgtaggcagcgtgaccgacatgcaatgcggagtggcgaatgctgcgaatgctgcgtttgcagaaggccgatgatgtttggcgtgtttgacttactggtctgcatcgggatcggcgtcggcatcagctgggccgagcaggacgcgttcgctgaggttcaccaggcacatcagaacgccggtgatggcgatgatgaccagcgtggccgagaagatcagcggtgtgcggaacgagttgtatgctgcctgtagccaaatgccaagacccttgcgtgcacccaaatattctgcggtggcggcagtggcgaaaatgtatgcggcggaaacgcggatgccgccataaatctgacgagcggccacacgcagcttcacatgccacagtgtccacgatttcgtggcgccacaagtcagcgcaacatccgaataaaactgggggactgcttcaagaccgcgaatcgtctgcactgcaatcgggaataagccgaataccgttacaatcacgatttttccggaaatttcaaaaccgaaccagatcaaaaataggggagcgatggaaatcaacggcatggtctgcgcagctgaaagcaacgggagcaatgcggcgttcgcaatgcatgagcagtacagcagtatgccgatgagaatgccgaacagtacggcgaacaggaatccgacggtaccttcaagcaaagtgacttgcgtggcaggccataacgtcgaccatgtttcgacggtggcctgtgcgatttcgcttggcgcggcgatcatggtgctgggcacattgccgatgcggacccacgcctcccataccgccagcaacagcactactgcaataaccgtgggaatacggcgtttgcaaacgtgagcaaaggcggacaaagcttcgagaagttttgcgacaatgccgtcttttgaattcgtgttcgcagccatgcctgaacccatgtgcgaactcgtgtttgagggtatggatcctgttgccgaatccctgcgttgaacgtgcgaaaccgccatcgttcaccttgctttctgcgccatagtgggcgcgcacgtgaccggtggcgagaaatcagtaaggtgaggagcctgcccgcgttccggtcagaaaagttcattaccggggtgttagtataaagcactccctaaaccacgttccaaaccaaaacgaaaggcgggtttcgtatctcattcgacacgaaacccgccttactctttaccccttgctactgccctggatcagcttcactccagtccgatggacttcatggtgtggagcttcaaggacttgacctcaagcgtgccggattcggcaacaagtttgatggctcgtgggccttcggaagcgtagctgaaggagctcatggcctgacggccgtcgttcacatacacttccacgcagccgcgatccacgaacacgcgcagcttgagctcgccggaagccagttcctcggcggaaagcggcgcggtacggtagccacgatcaccctgggctgcggcctgacggtcgatcaccacacgaccgatctgatcgtcgaacgccacatacgtgtaagcgccatcttcggtcgcatgaatcttcagaccagcacgttccgcagtggaggcgttgagatcgatggtcatttcgatttccacggcttcggcatcgtcagcaatggtctgctcgccattgacgtccagcgagatcgcaccgaaatcggtggtgttttcgcgcaagccctccatttcgacaaccggagcggtgtgcagatcgccgtcggcgcccagggtgatctcacgcggaagggtcaggttgccgcaccagccgtcatcctgcatcggaatcggctcaacgaacgggctcatccagccgtatacgatctggcgctcgccatcgttgaaggactgcggagcgtaatagttgtggccgcaatcccacagacggaactcggtttccggctggaacgcctcgcccggggtccacgtgccgatcatgtagccggcgttggaaacgttgcggttcatgaaaccggaggcctttgcgcccatggcggagaagccgatgacccacttctcattgccctcggcgtccttgatcgggaagaagtccgggcattcaagcatgaagacgttcggatccgggtgttcgaacagcacacgctcgtaggtccaacgaaccatgtcatcggaggagaacagccacatctggccgcgcttttctgcggaggagacaccgaaggtcatgtaccacttgtctccggtcttccacaccttcgggtcacggtagtggtggtcgaccttatcgagcgggcaatcgatgatcatgccgcgcttggtggcgctggtcagctcgtcgttgtctggttcggcgatcatctgcacctgccagtcgccgccggtgttgtcgatgccgttggcccagcggtggccggtgtagtagaacttgagctcgccgtcatcgccgatcactgcggaaccggagaacacgccgtccttttcctcttcgagagtcggggcgaacatgatcggctcacgcttccagttgagcatgtcgttggaggagacgtgaccccagtgcatcggaccccactgggtgccgtacgggtgcagctggtagaacacgtgccaacggcccttgtagaagcacaggccgttcggatcgttgatccagccgccgttggatgcgatgtggaacttcggataccaacggttgttgcgttcggcggccatggctgcaacgcctgcttccgcctgtgccagggcttcgctgtggttcttgatttcgtgaaggacgggtgcgtccggggtgaagccagtcatcgttgaatagcctttcttgtgattgttgaattgctgcttattgagttttgagtaaaagttgtaagaatgctgcccgaagcggaaaaaggggaaacgcttcgagcagcacgattcagttatgttcttggctggacttgcgattgcgttcaggcattcgcttctgcagcggcctgggccttgagctgcttgtcggtgtagaacggatcaccgccgacttcctggtcgtccttcttgatcacgaagaagccgtagatcagggctgccagcacgatgccggagatggtgaagaaggtcgggcgatcgcccatggcgtcatgcagggcgcccatcggggtggagaagatcacctggccgatctgggaagcgatctggaagcccaccatgtacagggttgccgacagcttggtgtcgaagtgcagagtgaagtagcggaatgccggcaggcagaacagcggaacctcgatggagtggaacagcttgacgatggagacgctgaccggatcgtggaacacgccgcacaggccgatgcgcaggaacatcacggttgcaccgagcagcagggagttgcgcacgccgatcttcttcatgatgatcggaacaacacccatcatggcggactcgaggaacacctggaaggagttcagggtgccgtaggtggcgttgccgatttcagtggtggagaagagggaagcgtagtagttcgggaacatctgctgatcgaacacggtatagaaggtgttggtgaacagcatgaaaacgatgagcacccacagggtcggcatcttcagaacggaaatcatttccttgaaggacgggttggtcggagccgcgttcggatcagcttccttcttgagctcttccttctgctcggccggaacccagaaagcgtagatgcacagcatgccgaggccgcagatggagccgacccagaagttcagcagcgggttgatattgaacaggaagcctgcacacagcgccacgatggcgtagccgaatgagccccaagctcgggactggccgtattcgaagccgaacttgcgggagtagcgttcggtgagtgcctcgaacagggagcagccggccatgaaacctgcggacagcacgatggagccgatgagcacgccgatgaaacgggtggtgccgccggctgtcagcatcggggcatacacgaactgcacgaacgggccgacgagcgctgcgatggcggagacgaagatcacgagcttacgcttgatgcccagttggtcctggatggcgccgtaggcgaacatgatgaccagggttgccagggagttgatggagtagatctggccctgctcggcggaggtcatgcccagaccgtgggccgggtcggtaagccagcgggagaagaaggaccaccagatgccccacgagcagaagaacatgaagatgccgaaggagctctgcaggtaggaaggattcttccatgcagatcgagttgtacttgccatgttgttgtttctctgtttctctttgtttgtgccgctgccgcgcggcacctcggttgtgtgccgatgttgtgttatgccgtcattcacccagctgccgtgccaagtggatgaacatggttaaataatagtgcgtaaaacgattgacgtcaatcgattgacgtaagtaattccaacgcttttcggaagtgttggaattaagccgaaatgggggatgaaaaaagaaggcctctcggcgtgtcgtaacggacacgtcaacaggcctttcatgtggtcttagatcgcgaaacttagctgcgaaccgatcccttttctatcagcgcgcaatggatcttcgcaggaatcggcgaatccaacggcggcatgggagcggtggtattcggccaagacgaactgtcgacgggcttgcgttcgatcatcgaaataagcttgcatgcggcccaataacccatctcatagtggggcagttccaccgtggtcagctgcggttccagcgtttcggcgaacacgcggtggttgtcgacgccgacgatggaaacgtccttgccgacggtcagtccgcggcgtgccgcacattcgtacacataccatgcacgcgcatcattgaagcaaaagaaaccgtcgggattgcgttcgtcaaacagtttgtcgacggcacgcaacgcaggaccattattgagcacattgcataccagcgaaggatcataggcgaaaccggaatcctgcaatgccgcctgatacccggcaaaacggccatcctgcgcaatcatgttttccgagcatccgatgtaggcgatacgcttgcaatcggcctgaatcagccgtttcgtggcatcataggcgatttggaattcgtccggctcgatgctgggaatctggttgtcggcatcggtggcatccaccatcaccaccggataatcgccgagcgaggctggcacgctcgcaatgcgattcgacatcttcgaatagaagaaaccgtccacgccataccgtttcagcgtggcgatttcgttctcttcgctcgccctgccatcggtgctgaccgtgatgatcatgtacccgtaggtgcttgccgcgtcttgcgcgcccagaatgatgccgcctgcgtacggcgtggtggcaacttcctcgctgatgaagccgagaattcgcgtgcggcaagtgcgcaggctgcgcgccagaggattgaccgtgtagccgagttcgtctgccttctcgcgtacgagcgcggccaaaggggctttcacacgtccttcatccctgccgttaagcaccagggaaacagtggaaatggacacccctgtcgcttcggcaatttccttcatcgtagtcatattcgctacactatacccaaatcaataagaaaagcgcgccattccttataaatagcgcgcttttcgatttttctgacgatctaacagtttattgcctgatttattccgacaggatttcgtccacaagtgcctgcttggcgtggatctgaccttcgaaacccgggcgaatgtcgagacggatcaccacgtcggtgcgatagccctggccagccagcttcatggtggcgtcgcgaatcaccttgagcacgtcgtcgatgtcgccttcgatgttggtgaacatggcgttggtttcactcggcaatccggattgacggatcacgtcgaccgcctgcgccacgtacgtggacttttcagggcttgcgccggcgggggagatggcgactgcggcaagcgtgttgatatacggtttgccggtttccgggttgatcggcacttcctgcttttccgcattgcgatcaagggtcatgttcgttcctttcgttgcgttcctatcggcctgatacgacttggattggctggtgcggatttggctgtcagcgccatttccaagcgtgatccatcggtccggatccgtgaccgaggtcaagctgcgcctccaaggcgcccgtcagatacagttttgcactatcgacggcttccggcaatgtctcgccaagcgccagatgcgatgcgatcgccgaagacagcgtgcatccggtgccatgcgtgttcggattattgatacgacgcgcgcggaaccaagtgactttgccgctcggttcaacgagcacatcgctggcatcctgcgtgccatgaccgcctttgacgagcaccgcgcagccgaaatggccggcgagcatatggcctgccgtcaccatgtcgttctcactggagatgctttcgccattctcgtagtcgatcgcgtcggcaccctgttcgacggccagctcgcacagcgcctgggtctccggcatattcggcgtgatgacggtggccagcgggaacagcttggaagtcagtgccgcaatcgcgtcgccttcgataagcttcgcaccggacgttgccaccatcaccggatcaagcacaatattcgtggcatcatgcgcaatcagacggtcggcgatcacgttgatgagctccacgctcgacaccatgccgatcttcaccgcgaccggcggaatatcttcaaatactgcgtcgatttgcgcggcgagcatttccggaggagtgttcgtgaccatggtcacgcctgtggtgttctgcgcggtcagcgccgcgatggcggtcataccgaacacgccattggcaagcatggttttcaaatccgcctgaatgccggcaccaccggaggaatccgatcccgcgatgctcaataccggtgccaaagtgctggtcatgaatgactccttacttgcttttgcttgcttatgatgcgaagttctgaaatattcgtgatccgtgattgctatttgcgcagtacgtgcccatgctttgcatcaccgcgcactgccttccatcgcgaaaccatattgcgggtcgcctcttccggatcgcttgcgccggcaatggccgacaccacaaaccagccggccgccttcgaatgtgcgagcatctccatatcgtcggcggtcactccaccgccgaccacaaccggaaaatcactcgcatcgcagatcgcattgatctgcgcctcgtcgagcgtatgcccggaaccatcgttgccaccaacggaagcttccggcttggtggtggacacgtgcaacgggccggccccgatgtagtcgatgcagccggcaggcagctcgttgatcagcttcaccaggctttccgtttcggcagacaagcccacaatggcatcttccccaagcaacgcgcgggcttcctgcggttccaagtcggtttgcccaatatgcacgccgtcaactttgatgcccttgtgacgtgcctgccaaactacatccacgcgatcgtcgatcacaaacgccacggaatcggatttgccgttgttctcgataacctgcgcgatatcgcgtgccatgctggtgatgtctttcgcgtcggtgttcttggctcgcagctggatgaacgttgcacccccgcgcaacgcatcctcaatcacaccggtaatagtacggctcttgcaatcctgcgggccgaccacaaagtaggcgctcatatcgaatgtatcgcgcatcgatgcatatgaataattgttcatataatcaacccttctcggtaagtgattcagaaaacctacaatgtgaaccggcaatcgtccatattttccatatacgcaattgccgaaccccgcatgatatgccgaataccatgcagggttcggcaaagcctagtcgatgatgatttcggaagcggcgacttcctcggcggtgacgttccaaagcgcgtcaagcagcgccacttggaaagatccgggaccggacgatttcgcttcggcgatttcggaagccctgttatacagcaatgatgccgaaatcgcggcgacaagcggttcggccacggccagatacgttgcggtaacgccgccgagcgaacagccggcgccggtgatcttcgtcatcatcgcgctgccgccgggcaaacggaacacgcgctcgccgtcagtcaccagatcgactgctccggaaacggccaccgcgccggctccaacaggggagtatttcgcaagatgacgagccactcgtttggccgcgtcaacggcggaatcgacttcgtcgacggcttccacgcctgccgggcgagtgccgggaacggtggaatcatgctgtgccaaaccccacatcgcatcgagcgcgatgatttcgctcgcattgccgcgcacaatggtcggcgggtatgtgcggaacgattcgagaatggcggtacgggttttgccgatgcccgcggcgaccggatcaagtacccacgtcttgccgttcttgtgcagtttgtaggcgatttccggtagcgcgtccttgaagaacggcaggagtgtgcccacattgatgtagttcgatccggcgatttccgcggtgtcgatcacgtcgtcaggcaggaagctcatggctgcggtgccgccggcggccagctgcgcgttgaccacaagattcatcgttacgaaattggtgaacgactgtgccaaaggtgtggtttcgcgtacgtcgtttactgcctgcgcaatctgttcacgcaatgcagctgcatatgagtcatcgcccattgtctgctccctacgttggtcctaaccaacaggttcaaagggtcaggcatttgcctatctcagcttccgctttcgccggaagcccccctgcatgtacataacatatctaacctatacaaaggtgctgacagtggcacgttttgcataaacgaacaatcgacacgttccagttggatgccggtccacttgttatctgcgcgttgcgccgtcgggccagtcgattccaggatcgggcgaatgcaatacgttctcgtaaatgtcgttgcgcacgtaaatttcgcaggcgccttccgaccatgtgcttttccaaggtgtcttggtttcggcgattttgattttcgtgtaatggtttctgtcgtaaccaaggtcggagaagaaaaatggctgatacagagtgtcgtagaattcgggttcgccccacgatttccatgtttcgatgtctttctttcccgcataggggtcaacgcaccattcccacgacgaatagcttcgtcccttgtatgcattggcaagaagcgtatggtcgaagtaaggggctgaatcgataagggtgctgccgtaccaagaagtgtagtcgatgcagtcggtgccgccgcaatatccgcctttgtcgatgattttgttgatttctggattggaagcggtgtcgttcttgctgacgcgtgtccagcctgccatccaacggtattgctccaaatggttggttttgataaaagacgctaccgcccgggaagacgaatagtcgtaccgaatatcgcaaatactggcgcttgccgtccaatacacgctgacaagcatgaagataagaccgaggattttgaagaaacggagataccgttccgttttcttcggtccaagaagagtcataacacggttgttgagattacggatccactgaggccaatcgttggaattgattttttcgatatcgcaatcgatggcgagaatggcgatgaagaatcccaagatgattcccgcatgatgcatggaaagatgcgcggtgaacgcaacgcttatacccaagtatgtggtgagcagcaatgatgcggttttccggcgtaggcaaatctgaataagaaaacaccacatcaggcatgacattacgctcggcataaacagctcgcttggcgtgagagcgatgaactgcatattgccatccgacagggttgaagtgaacaacgtctcggaaggcattaccagccaggtgttgaatacggaaacccatgcgggtgatgttgttgcagtgccatgtatgtcaaagtcaccgtggtatgtgccgggtgcggggagtacgttgaggagcagtatgatggcgaataccagtagcagaacaagtcccgcgaaacgctgcttgttttttataagcgagcgttcgccgcagagaaattgaatcgtccaattcaaggcaagcatgccggcgattgccaatccgtaagagctcgtggcgcatagcagcatcatgctgagtatgactggccatggcttggtgttgcggttgttccaattgatggctatgagcagcattgcggcgatcataagcgcatatggtctggaagttacgccatactggtagcaaagaaaataggaaaatggcagtattacctttagtaattctggtagtttcgttttgaattccaaaagccagatcatcagcgcggcgcacataagattgagggatttcaatcctatttcgtaaggcatgccaagtttggcgggaatggcaagcagcatccaccaaagaggtgggtgtccttcgtaatgggtgcgtacggtaagcagttccttccatgagcaatcacgtgcgatcagccaggcttgcgcctcatcaaaccatggttcgtgaaaacacgacacggtgacggtcactgtcacgtaggcgatgaagacaatgcagtgcagccgttgttcggcgaaccaggtgaagagtctttttcgaaggttcgtcgcgcggttcgccgaaatgtcgggctggatgatggttggtgtttctgctgtgttgctcatgataggtgtaaagatggtgtatgggtacggcgaggttagaaggaggagcgggcgccgcagagtttttcgaattcctcgaggacctgcaccttggcaagagcgtcttcgaaggtgatgacgcccttgttgacgagtctcgccagatcttggtcaagcgtatgcatgccttccttttcgccggattgcagcacggtacgaatctgatgcgccttgcctccgcgaatcaacgcggccacggccggagtgttgatcatcacttcggtggcaggagcgcggccatgcccgctggcacgtgaaatcagggtttgcacgaccaccgcgcgcagagtggaggccacctgcacgcgaatctgctgctgctgattttccgggtacacgtcgatcagacggtccacggtcgaaccggcgtcctgcgtgtgcagggtggcgaacaccaagtggccggtttccacggcggtcaacgcggtggaaatggtttcgaggtctcgaagctcgcccacttcgataatgtcgggatcttcacgaagcgcgcgtttaagcgcttccgcgaaacttttggtgtcggtgcccacttcacgctggctcatcacgcaacgcttgtgttgatgcacgaattcgatcgggtcttcaatggtgatgatatggtcggcgcgttcggcattcgctctgtcgacaatcgcggcgagcgtggtggatttgccggagccggtcggaccgcatacgagcacgagtccacgcggcagtaacgccagatcggcgatatgcgggtcgagaccaagctcctgcgcggttttgatttccgtgggaatggttcgtaatgccgcgcacacgcccaaacggtcgcggtatacgttgacgcggaatcgcagcagatcgccgatggagaatgaaatatcaagttccaaatcgtctttgaaccgttccatctccagctcgttggtcatcactttgatggcttcatacgtgcggtccttgttccacacgctcagccctttggcggggcgcagcttgccatccacgcgcagcattggcggatcgttgaccaccagatgaagatcggacgcgttcaattccaccagctggcatatggcagccacgaattccggatccgcatcgggatgttcggcatgcaatgtttctttgacctggtgcgctttgattctgcgttgtccgggaacagcgtcctcgtcggaatcattggtttcgggcactatgaaatccacgattagcctgttgttcatattgggttgcggtctggcagcgggcgtaggctgcgcaatatggttgatggcggaaggctgcatggtctgcgcgttctcctcgtacgccgcatagtcgtccggctgttgcgcgaacggcgtgccgcctggaatgaatgatggcggatcgccgtcgatttgctggatcggtccatgatactcgaatgcaggggtgacttccgtcacgtcatcgtcgaattgcagattctgctgatccacggcttcgttttccggggtttccggaaaagcggtgtcgtaggagagttcctgttgttctgcaatgagcggtgtttccgcaggccgtgtcggagcgggctgcggttccgctacagattgtgatgcaacggcttgcggggcagctgactgttgcatagactgccgctgtgcgctctgttgaggctcggccgccggctgttgctcgaccgcggccttagacatggggtcgggaacggtaccggaaccatgccgcaacgcgggcatggcgtcaagcgacgcgaaaatactgcgcaaactgtcatcgtcagcctgaatcgcattgtcgggcgaccaatggcgtcccctacgcggatcctcgttgaatgaaggagcggtactgggaatggtcacacctttcaaaccagacaaatcggtgttcgcatcccaagtcggctgcgcatcgggatccgtcgcggtgttcatttcggttttcagctcgggttgctgttcaatatcggtcatcattgtcctttacatatgttgaaaacgcggtcacacgattacacaactacacggtcacgcgaagcacttcatccacggaagtaatgccttgcagaaccttctgccagccatcctcacgaagcgacgtcatgcctttcgacttggccgcctgctcgatttccagcgacgtggcgccacgcgcgatcaaatcctccatctgcgtgtccacgcccattacctgctgaatggccacacgcccgtgatatccggtgttggaacattcacggcaacccatcgcacggtacacggtcggcaacggagagccgggcgtatatggcacacccatcatcttcaactccacgggagtggccgtatcggctttccggcatttcttgcacaggcgcctcgccagacgctgcgccatcaccgcagccagcgacgagctcaccaaaaacggttccacgcccatttccgtcaaacgcgtcaccgcactcggagcatcattggtgtgcaacgtggacagcaccaaatggcccgtcagcgaagcctcgatcgcaatggtcgccgtctcctcgtctcgaatctcaccgatcagcaccacatcaggatcggcacgaagaatcgaacgcaacgcggcggcaaaggtcatacccgccttattgttcacctgcacctgattgatgccctccatgcggaattccacagggtcttcaaccgtgatgatgttgatttccgggcgggccacatcgcccaacgtcgcatacaacgtggtcgacttacccgaaccggtcggaccagtcaccaacaccatgccgtacgggcggttgtacgctttggaaaacacatcgaaattgcgttcgctgaaatttagatcctccactttgagattgcccgaaggcgtgctcaaaatacgcatgacgattttctcgccccacaccgtaggcaatgccgccacgcgaagatcaaccttctgaccgttgtgacgtacggtaatacggccatcctgcggcttgcggcgctcgccgatatccatttcggccatgaccttaatgcggctgatcacaccttgggtcatggcgcgtggcgctttttggaagatatgcaacacgccgtcgatgcggtagcgtacgagcagaccgtcttcctgcggttcgatatggatatcggagcagtggtcgtcgatggcctggttgatgagcagacttacgaagcgtgccacgggggaggcgtcttcgctgtcgtcttgttcaaggtcgacttcttttttcgcggtcgcggcgatctcgtgcgatagttcggtcaactccgcattggcgcgcaggaaccggttgatgcagtcgcgtacctgcgatggcatggcgaccatggcgatgacgggcatgccggttgttgcggaaacatcgtctaccgcggcgaagtttttcggattcgccatggctacggcgatgcgcccgttgacgatggaaagcggcagaagctggttgcgtcggcacagatcgtcgggaaccatgctgatgacttctttgtcgatctggtattcattgaggtccacgaacggcaggctcatgccttgcgccaacgccatggcatattggcgttcggtctgttcgtccatgccttcggtggacgttggcatggcgggaaaatctccggtggcgtcgcttgtcattgccgcatggcgtggtgtgctcggcgtgaacacctgatggatctcgccggttgtcggcgcgatcggatccatactttgcgggaaagcgttcggcgtgtcgctgtttttgtttcgcctgaggaaggggaaacggcctcccgaaccggcgtcgctcataatgacctcctgcaccgcatgcgcgcttatgcgcctgtcatacggcataacatgaaaccccaagcaaacggcagcatttgtggggaggctgatgttcagttgttcgaagtcatgtgagctacaacgattgcagtattgtgtactgctaaatcagcattgtagccgcaaaaacaggtaaaagctaatcggggcaaagttttttgagaaatatgttgctgtgaaaacgttggcagaatatcgtgatacagtaactcatgtttatggcaccgcgtttggttgcgtgccgaattcctgccgcttccaatgatggggtggcatcttgtgaaggagctgctcatggagtacagcttgcgcacagcgggagacgcccccgattcaggggttgcggcgagtcgcgtcaatcgattgccaaaacgtggcgagtccggcttcacgttggtggaagtgctggtggcgatcgtggtgttgagcattacgggacttgccgccgcacagttcgccattacggccattcgcacgtcatatgcgcagcagcagcggtccaccgccgtgtcgctgggcgacgacggcatggaaagaatgcgtgcgcagatcgccaatgtagacgccaaccaatatctcgatgaactcatcaaaggcatgggggaaacgtccgtcaccgccgcgcaaaagaatctttccgacgttggcgccatcgcgtcgcaattggcggatctgagctataccagttcgcctgatccagacaagagcaagtatattcagccggttcgtgccactgcgggcaaggacgccaagcataccgaatacacggtgaacacggtggtggagcgctgtttccgtgccagcggcgagatctcgtgcaagaccgcatctcagctgggcatttcccgtagttccgcaacgagctatacggccaatacctcaacaagcgctacggccgacattctggatccgggcaaaacggtatcgggcgcgttcacgttcggtgcgcacacgtatatgcccatgatccgcgtggtggtgggtgtcacctgggacgacaacatgcatcagggcaaaacctgcctgtacaccacgtcggaactgctggatattggtgtcgacaacaagctcatcatctagtgaggggttgcaatgagcggaacaacaagcggaaaactgcgtattcgcgccgtcgcgcaacgtatggcgcgcggtgaaagcggcgtcaccttggtggagatgatggtgtcgctgttcatcttcgccatcgtctccaccatgttcaccacggcgatcgtgcaatacctgcattccaccagcgcggatgcgatacgaagcaggtcttccacggaaatagccacgtcggtgcaaagcctcgaccggtatgtgcgctacgcggagggtgttgagtatgacgccacgaaccatacgatcaccatggtcactccgggggattctggtgcgaagcagtgcgtggtgatcacgtaccaggacgccacgtggaagaacggtacggtaagcgattacggtagcgtgaaggtaaaaacgaagccgtatgatgcgtccgtcacgtcatggagcacgcgcgcggtgttggggtcggtaatgaacaacgagtcgggaggcacgtctgatgattcgatgttcgcctcgcgattattcacggtggatggcaccaatcgggtggtgcgttattcgccggtgacggggtcgtatgtgagcggcaagccggtcacgtcgaatacgtccacgtcgttcaccgcacgcaatgtgaaatcgggtggaactgcaatcgatttcactccgtgtgtctgagtgttccgataggtcttgcggcagacggctggttccttacggagccagccgtttttgtcgccccgtcagcaccctgcgacacgcccgaaaagggtggttattccagttttttcaaaaaaacgtgactgcaaagatttgctgagcgattgtactgaaaaacaagctatttgtggtgttgtattttttgttgcacgattttggttttgtgttgtaccttttgtgtccgcttgaaaaagtgtgatttgcttgatggttgtgaagggggttgtggggtaaactaaagcgcttttgtgcggatgaaggatgaggggaaaatgaatcgaaaatgaaacgctcgtaaaacgattgacgccggaataatggttctgcaaacgatgtcaatgcggataaagttaggactgttggttatgtgagccagcagcccccataaggggacgatcgatagaagaacgccgcgaagctccatcgtgggatgcgagcggcgacctttcccgaaggaaagaaggattcaattatgaagagcgtgcgcaacgcactcaaccgccgcgccaagggcgaaaagggcttcaccctcgtcgagctgctcgtggtggtcatcatcatcggcatcctcgccgccatctccgtgccgatctacctgaaccagcgcaagtcggcctggaactcccagaccgagtccgacgtcaagaacgccagccttgtggttgaaactgcgtccactgccaacaatggcaagcttccgtctgagattaatggtgcaacggccacgtgcagtaagagccagaatacgggctgcacgcttggaggcaatacgattaccgtaactgagggtgttaccctgaagattaccggtaaagcagataactcctacactatcgagggcgagaacgagaactctggtacagcgattttcctgtatgactcggccaacggtgtcgtctctaagactggtactaaataataaaaggcatagcgaataattcgcgtgggactaaaggtatcggagcgtatgaggtatcgctccgataccttgttccgtatccatattcgttccattgttcgtcaatcattccatgggggagtaatggccagggaacaggcgcaagtggcatttcaaaacggcaccaagaagtggcgttacaagggtgtttccgctgacggccgcaccaagcagaagggcgttatcgaagcgcagacgcgagatcaggccatcgatcgcgtgaataaactcggtctgattccaacggaacttgttgacgtgaacgcaggcaccggtctcaataccaatattgaaatcaaagcattcgaaaaatatccaagcaaaaaagacttcgcggttatgtcacgtcagcttgccaccatggtggcggcaggcgtctccctgattcgcgcactgaatatcgttactgaacaaatcggaaatgtgaaactgcgcaatgcggtacgtgactgcatgcagcaggttgaggcgggatcatcgttttccgaagcaatggacaataatcccgaccatctgtttccgcccattatgatcaacatggtgcgggccggcgaaaccggcggcttccttgacaaatccctgattaccgtggccgacagctttgaagcggacgtgcgtttgcaaggtcagatcaaaggcgcactggcttacccggtggtggtgctcggcattgctgtgctgctggtgggcgtgatgctgctgaccatcgtgcccatgttcgacagcatgtatgcgtcgatgggcgcggaactgccatgggtcacgcagatcatggttgatatgggcaagaccgcaccggttggcattcccgtgatcattgtgtgcgcggtggcgttcgtcatgttttggaagcgcaatcgcaacaaagacatcattcgtacctggtgggatccgttcacgttgaaggcgcccgtgttcggcaaactgaccaccaatgtggcattggcgcgattctgcaacaatttcacatccatgctcgcttcgggcgtgcccattctgcaggcgcttgacattgtcggatccacatccggcaattatgtaatcgacgaagcgtccaaacgagtgtctcgactcgtggaacgcggctataggctggcggacagtatgggtaccgaaaaagtgttcccgaacatgatggtgcagatggtggcgatcggtgaggattccggcgccatcgaccagatgctcgccagcgcgggcaaagcgtatgacgaagaagcgcaatccatcgccaaacagctcacttcgctgctggaaccgttgatgattctggtgctcggtagcgtggtcggcttcatggtggtggcattgtacatgccgatgttctccatgttcgacgccatcaacgggcaagcgtaagcgaaaacgggaaggttgaacatgaagaacggattgtgggccggactcaaccgcaggtatcgtgccagattacgccaacgcatgggggagcggggcgcggccatgatgctcgcggtactgttcgtaatggtggtgctcaccacgtcggcactggtaatgaccatactgctttcgcaagcattgccgtacaggaataataaggagaacgcgcaagtcgggtatgccgccgaatctggactcgaagtggcattgagtttcctgcgcgaagcggaagcaagcaaggactataagaaactgctaccgtcgaccgcatcaaacactggcaatgccagcttggatgagaccttcactacagcatcggacgggtcggtgctgctcaacaatgcggaagtcagcaacgacgtgtcggcaacgggcgtgagctcgttcactccagacgatatctcgtaccgagtgcaaatcggatattatgacgacgatccaagctcatcgccggccaaacgactcacatccgaaagcgagctgaagaacgcgaaatatgcgtgggtgcgttcctacgggtatatcaacaggtatccgaatgggcgaagcgcgggtacggaaaccagcgcgcgccgagccatgagcgccatctaccaattcgagacagcgagcggtgatgacagctacgtgatctccaccaagggtggacgtctcggtatgggcttctacgcggcagcgccaaacaacgagcgccgtaccaaccagccgacctggaaggaaatcgcctcatatgatgtcgatgagaacggtgatccgaccggcatggtgaactatgtcaacaagcctggctccaagaatgcggccgacgctatgagcaataccatcactatgaatccggcaaaccaaacttgcatgcttgccaccaccaagcctgtagacaaggtcgaaacgcttgacgccatgcttgacccgaacggcaagccggtggaaggatcggcgttggtgattcttatgcaagcgcataagaaagactccagcagcgacgacctgtattacacggaacagtgcaaagccaacggcgcctacaaagacctgaacacatgggtgtattggaaggatgattccattcgccctgcatccaatctgacattgtgcgttaccggagctgacattacgcatgttggcggaggcactgcaggagccgccacattgcagaaatgcggcgagtcgtacggccccaactaccaaagcgactattacaccgatcctgacaagaaagcgcagcaagacgaaaagaacgatccgtcaagcctgctcaacaaataccagaagtgggcgttctataacggtttcatcaatgcgggctactacaacgagctagatagcgtgcgcgatgaggcgaacaagtatgatgcgtctctaccggaatcgcaaggctatgccgttggcggtgtgcaaatgcagaagaagacgcgcttccaagtgctggaagtttccaacaaggcgaatgtgggcgccactattcaatatctgagcggcggtcactgggcgtccaacgtcgatgatgctgtcgatttgactccgcatttcctgatggtgtcgaagtgggattattcgctcaccgacgtgaaatcctggttcgacgtgaacggtgatttcgaagacgccaccgcatcgttcggacaggcgggagaagccggctatgccacgaagcagatcgtcaatgaaacgtccggattctgcatttcgtcatcgcaagacggattcgacgcatacacgtcaacctgccgagtgggtggcggtgatttcaacccatactgctaccacaacaccatcaatggcaatccggcgcaatcatcttccgatctgcatcagatcgactactgcggggtgtccgattccaccaagcgtaaaaccgatcaggccgaatatgttgaagacacgtcgagtgacggcagtggcgtgaacacgcagatttggacgatggtgaacgggtcgaagcgttgctatgggttcggcggttcgggcaaattccaacttatggaatgctcggctgcgccaacattcacccgatacaacgaaaaagcgtctgacgagcacagtaaaggtacgttccaactcaacggtcaatgcctgacggaagtgtatccgggagacaaaatcgacggcaatccctcatactccggacgtatcgacgggcatgccgacgtgattatggccaaatgcggatcgtcacgagactttttgaaccgagaaatcaaatcgcaggtgtggaatgcctcggttaacctcggaacaggcggctcaggcggcggcgtgatttatggcggtggtagttctaccacattggagccatcctccaccaaaggctacgtgacatccaaagaactgaacccgtccactatcgcatggtgagcgctgcgcgagatggatgtgaacatgagcattgtgaacgatacgtcaactgtggtgctgctactcgtggcatcgctggtaatcggctgcattttcggatcgtttctgaacgtggtgatttggcgcgtgcccaaccacatcagcttggtaaatccgaaacgcagtttctgcccgaactgcgaagccccgatcgcatggtatgacaatattcccatcatttcttggctggtgctcggcgcgaaatgccggcattgcaaagagccgatcgccgtacgctacccgattgtggaagcgttgggcggactgtcgttcctcgccgtcaccttgggggcgctattcggcgcgtattcgccatggatattgccggaactctacgtattcgcagcggtttcgatcgtgatcgcatacattgatctcgaccatcatctgatcctcaatgttgtgctattgccaacgctgattgcaacactggcactgctggctttggcatcactcggtacgaatgagtggaacaggctcggtcgcgctgtgatatgtgcgatagtgctcggcgcgttctacctattgctttccatcatatggaaaggtggcatgggcgatggcgatatcaaacttgcgttcatacttggcttgattacgggctggctcggatggtcgcaattcatcatcggggcgttcgcagccttctttattggaggattcttaagtcttgtgctgattatcggcaaaaaagtcgatatgcatggaggcataccgttcggaccgtccatgctgctcggcatatggcttggcatattcgtcggggctccgatcgccacactgtacttgcaagtgacgggactcgcctgaaccaatccccagccaacctgcaacacgttatatataaggagagagcatgagatcaataacggcgctgtcgatcgcgaacgacgccatccgtgcggcggtcatagcagacccgtattcggatctgcccaccatcaagcatttccaggcgatcccgttgccgaacggagccgtagtggatggcgaagtggtcgaccatgatgtggtggccggactgctgaacacactggtgaagcgattcaaattcccccgcgaggacacggctctcgtctactccagccgacgcatggtgtttcgcgaggcggactttccctacatgtcgctgaacgatctgaaatccaccttgcctttccaagccaaaggcatgattccgctgcctattgaggaatccgagctcgacttcgtgccattgaacgtcatcgacagcgaacaaggcaaacagttgcacggcatactcgtggcgacattgcgtaacggactggaaaaaaccgcgcgcacagccgaagacgcgggatttgtgatcacatcgatcgatgcgggcccgttcgcgcttgccagactgttcgccgacaccaaccagcagcagaccgaagcggtggtcaacatcagcggcaacggcaccgacgtgatcgtgctcgaaaacgggcagcccgcctacatgcgcgtcgtgccatccggcgcggatgacgtgactgacgccatcgccaacgcgctcagtatctcattcgaagacgccgaacgcatcaaaaaccagatcggcctgcaaaacgtgaccggcgacgaacgactcgaaaaagccgaggaagtcatccgcgaaaccacggcgcagctgatcgtcggcatccgcaatacgctcaacctgtacgacgtggaccatgcgggcggcaccatcagcggcgtggtgcttaccggaaccggcgcacggctgatcggactgccgccggtattggccagttccatcaacaaagtggtgcggatcggcgaccccttcatccgtttccggctttccaaagaagtggaacggcagaacatcatggcgcacgcgatcgatttgggcgcagtgcttggactggtaatcggaaagaagccgaggtgaacggacgatgagcagaaaaaacaacggaagcatgaagcagatcggcagctcccaccgcggtcgacgcggcaaaatcaaggataatccgaatcctgaaaccagtgatggcgagaaaacctcgattttgtcgatgaatatttccgacatcggcaaagcgctgcgtgcgagcagttcgaaaacctccaaaaaggctgatctacccgccgaatggaatgtgcgcgccaacctgctgccacgttccatcgtgacgctcaaccgtgatcgtgccatcaaatacttgctgtcatacgtgcttatcgtggtggcggttgcggccattgccatcagcgcgggcatggcggtgcgcgtgagctgggccgaccatcgcgtggaggaggcacaggcgaaaaccctgtcgttgcagaaggaaaaggcggaattcaaagacgtggaagacacgttgaactcgctgtccgattcgcaaaggtcacgtatcgccgcgctctacgacgaaatggattggatgaaggtggtggattcgctcaatggcgcgctgccagccggaggccagtacacgaacctgtcgttgagcagcttccagattggcgggtctgacgcttcttcgcatagcgctacatcttcagtatggtctgggaatggtgtgatttccgttgattttaccgttctttctccagatttcatatctgcaaaagattttatcggtaattttgctgcaattcctacctataaaacaggctatgtgagttccattaccgaaaacagcgatgaaaacggcaccacctatacatacacgggaacggtgtcgttgaagatggataccaataccacgtcacgaagcgacaacgcggccggtgctgacgaagccaaccgagcattgcagcagcagctacgcgacagcctgaacaaagccgcggcaggggagtcgactgatactaccgacagcgcgaccgcaactgacgaaacatccaatgaatgatcgggagcaatcatgaacaagcataaaatcgcatggatcgcattggccgcaggtattgtcttcgtcatcatgctgacatggctggtcggcgtttccccgcaaatcagccatatcaaatcatccgacgcgcaaactgcgcaaatcgatgagaacaataaggaaacacgcgacgaaatcgaaacattacgcatcgccagcgaaacgatcggcctgcagaaagaccgtttgcgccagttgcagcggcagattccagacggctataaccagcaggaattcatcaattcgttggatgcgtccgctgcgggaaccggcgtcgccatcaaatcggtgaatttcgatgatgcggtcgacgccgacattccagctgaaatgcaaggtaccattcaagccggtcagctggtgcaggtgtcggtaagtatcaccgccacgggaagctatgatgccatgcgtaatttcgtggcatccgtgcagaacatcaaccgtatcgccgtgccggaaaatgtgacctacacacttgacagaaacggtgacgaaacgaaaaatgccgtggtgatcgattgcaagatctggtcgctattgctcgacaacgacacggttgaagacgagaacgccacgaaacagtaacgcgggtggcgttctgtcaccgcgtaaaggtaggctttgcgcttgtaaagaccccaaaccgttcaaaccagaaggtgcattgtggctgtatccaaactcgatgaagtcgtatccctcgccaagcgtcgtggctttgtttttcccgccggtgaaatctatggtggaacccgttccgcgtgggattacggtccgctcggcgttgcgctgaaagacaatatcaagcgcgaatggtggcgttccatggtcgtcacccgtggcgacgtggtgggcgttgacacgtccattattcttccgccggccgtgtgggtggcttccggtcacgtgtccgtgttcaacgatccgctgatcgaatgcctcaactgccacaagcgccaccgcgccgacaagcttgaggaatcctatgccgaaaagcatggcgacaagctgccggaaaacggcctgaaagacattgtgtgcccggattgcggcacccgtggcaactggaccgaaccgcgcgacttcaacatgatgctgcgcacccacctcggaccggtcgaagacgagaactcgctgcactacctgcgtccggaaaccgcacagggcattttcgtggacttcaagaacgtgatgacttcttcgcgttccaagccgccgttcggcatcgccaacatgggcaagtccttccgtaacgagatcactccgggcaacttcatcttccgcacccgcgagttcgagcagatggaaatggaattcttcgtggctccgggcaccgatgaggaatggcaccagtactggatcgacgcgcgtacccagtggtacatcgaccttggtgtgaagccggagaacctgcgccattatgagcatccgaaggagaagctggcccactattcgaagcgtaccgtcgacatcgaatacaagttcggcttccagggttccgattggggcgagcttgaaggcgtcgccaaccgtaccgacttcgatctttccgcgcatgccaagcattccggcgaggatctgagctacttcaaccaggccaccggcgaaaaatacgtgccgtacgtcatcgaaccggccgccggcctgacccgttccctcatggccttccttgttgacgcctacgacgttgacgaggccccgaataccaagggcggcgtcgacaagcgcaccgtgcttcgccttgatccgcgcctggctccggtcaaggccgctgtgctgccgttgagcaagaagccggaattgcagaccgtggcacacgatctggccgccgatttgcgtcagcatgactggatgatcgactatgacgaggccggtgcgatcggtcgtcgctatcgccgtgaagacgaaatcggcaccccgctgtgcatcaccgtcgacttcgacacgcttgacgatcaggccgtcaccattcgtgaacgtgataccatgcagcaggagcgcgtcgcactcgacaaggtggctgattatgtggccgcacgtattggcgagaagcatgtacgttacccgcaggtgccggttgagatgggcggcgaggcttggcctgagtccgtcaagatcgccgaagccggtggcttgtattaaagctggatactggttatcatagcgttcttatgccagatagcattgtgactgcttacgaggaatccgacgtgctcgacccgcgtaccgacgcggtgaggccgtcggttcctccggttatgaagcctgttgatttagggccggtacacgttgaaaccccggtggtgctttcgcctatggcgggcgttaccaactggccgttccgcgtgatttgcgaaagctacggaccggacggtctatacgtggccgaaatgatcaccgcgcgcgcgttggtcgcacgcaatcccaaagcgttgcggttgtgccatttcgcgccgagcgagaaaatccgttcgctgcaactgtacggtgtgaacccggcgatcgtggaacaggccgcgaaaatcgtcatcgacgaaaacatggccgaccatgtcgatctgaacttcggatgccccgtgccgaaagtgacccgacgcggcggcggatcggctttgccgtggaagacggatctgtttcgcgagatcatccagcgtgtggtcaaggtctgcgatgctgccaacgtgccggtgacggctaaaatccgcgtcggcatcgaccatgagcatgaaacgttcttggaagcgggccatatcgcgcaggaggaaggctgcaaggcggtgaccttgcacgcgcgtaccaccgccgaatattacggcgggcattccgactggagccggattggcgagctggtcgaagcgcttgacattccagtgttcggcaacggcgatatttggggtgcgaacgatgcgcttgccatggttgccgaaaccggttgcgccggcgttgcgattggccgcggctgccaaggcaggccatggctgttcgccgatatcaagaatgcgttcgctggcagcgacaagcgtgttgaccccacgttaggagatgtgtgccgtgtggttgaacgccatgcggaactgttgaccgaattctatgatggcgatgagcagatggccgtgcatgatctgcgtaagcatatcgcgtggtatctcaagggattccccgttggaggctccacccgtcgcgcgttcatggaatgtgaaaatcttgaggatgtcagagccgaaataggcaagctggatcccaacatctgttttcccgagcgagtggtcgacaagccaagggggcgcgtgcgcttcgcaaagaaagtgcatctgccttacggatggttggaatcacgggaaacaacgcatgatgaacgtcaggcgttgtttggggatgatcctatggacgccagctattgaatatatgacatgctgatgtggttaaatcgtcgtgggggcaccgaaagagggtaaatcgcaggcgaaatgaacacgttagcaataaaaaagtgaaaaaacgccgttacacacggcgaaaagtgcgcgtactgcagcgtgtctgcgataaagttgtgcgtaaacgcgagtgacaggagactatggtgagcgagattgcccagactgacaatttcaacgacaaaacgaatatcaaggttgtcggtgttggtggagctggcggtaatgccgtcaatcgcatgattgccgagggtcttcaaagtgttgaattcattgcgatcaatactgacgcgaaggacctgatgcgttccgacgccgatgtcaagatctccttgaacgatgccaccagccgcgggcttggcgcaggtgccgacccggagaagggtgccaaggccgctcaggatcatcagtccgatatcgaggaatcgctcaagggcgccgatatggtgttcgtgacctgcggtgagggtggtggcaccggtaccggtgcaagcccgatcgtggctcgcgccgcgcatcagcagggtgccctgaccattgcggtggttacccgcccgttcagctttgaaggtccccagcgtgcggcttccgcagcacttggcattgagaatctgcgcaaggaagtcgatgcgctgatcgtgattccgaacgatcgactgcttgagctttccgatcgcaccatcggcatcgtcgatgcgttcaagaccgccgacaccgccttgctggccggcgtgcagggcatcaccgacctgatttcttcgaactcgtacattcacgtcgacttcaacgatgtcaacgctattctgcgtggcgcgggcaccgcactgttcggcatcggttccgcacgaggcgaggatcgcgccactcaggcagctgaaatcgccatcagctcgccgctgctggaagaaagcatcgagggtgcccacggcgcgctgatcaatatcgccggcccgtccgatctgaagttgcaggaagcggccgccgccacccagctggtgggcaaggccatccatccggaagcacagatcatctggggtctttccctcgacgacgcttacggcgacgaagtgcgtgtcactgttatcgccgcaggctttgatgccaactccaagaaggcggctcaggctgaagcccagaagcaggcagagcctgcggaaagcacggtgccgctgtcggcgttgtccgcagccccgagggcagcggcggttccgcagcagccccagcctcagcttattcagactccggaagccccgaaggtgcagccgctgtccacttatattccgtccactccggaacccgtcgttccgtcattcgaccagaccaccgagcatgaagtggtgtcttcgaacgacgccggcgatttggatattccggatttcctgcgctaaaagcaacgcgaagacgcgaaaggatcgttcatggcaggttttatgaaaagcgcgatgtcctatttgggcatgaccgacgttgccgaaggtgacgaggatttcaacgaggaggctgagagcagcgaaacctcgttcgattccgaccattccgtgaccccgatggcttcgactcctgccgcgacgtccgcaccgcgcgagcagaccaaagccaacccgttccaaggcggaagggtgagtcgtatcaccacgattcacccgaaatcctatgaggacgctcagctggtcggacgtgccattcgcgacggcgttccggtggtgctgaacctgaccggtgtggccgaggccgtggcgtatcgcattgtggacttttccgcgggtgtggtttttggcgtgcgtggctccatcgaacgtgtcactccgcgcgtgttcctgctgagcccagctcaggtgaacatcaaggttgaggaaccgcaggcgaataactcgtcgcacgatttgttcgccgactgatatagacgaaagccgttgcgaaagcagactgcatgaagcctccgtcacccgtgatgggggctttgttatgttctgttgctaaggtggtgctccatgattttgtctttgatcggtagcatcgtccactttttggtgaatgcctacattctggtgctgttcattcgcatgattctcgattgggttgctgtgttggcatcggcatggcgtccacgggggttggtgtcgtcgttgatcgacgcggtttaccagttgacggagcccccactgcgctggctacgccaatatatccgccctattccaatgggtcccatctacttcgatgtggcattcatcgttctttatttcattctcattgctattgatttcctcatttaatgtatgtcaaatgccgatttttcgcaaaaaatcggtggtcccgtgctagagtcgaacaatgaaagcaacaacagcaaggcatcaagcccaaagcgaggtgtaagatttatggctctgttgacgccgaaagatatcagagagcataccttccagaccgtgaggttcaaggaggggtatgacgtcgatgaagtcgacgattttctcgatcaggtaaccgagacggtggaggcccttggcaagcaggcggttgccagcggccaggctactcagtccctcggcccggatgttgcggggctcaactccaagatttccgagctcagcgcccaggttcagtccctgcagcaggagaacgcgacattgaagtccgcctccgagcaggcagctggcgctggtgatcaggcagctcaggccgcacaggtcgcagcagccaagctcaccgaggctgaggaaagcaaccgtgctctgtcggctcagaacgaacagctcaagggtcaggtggatcgcctgtccgcacaggtcgaccagctcaccgcacaggcggctgaagctgcaggccaggcggatctgggcgaacagctgacctccatgcagcatgagcgcgacgcattccgtgcacagaccgaagacctgtcccgtcagctggcttccgcacagcagcaggttgtggtggcccagcagcaggcggctgagatccagcagctcaatgcaaggcttgaagaggctcaggagcaggtcgcccaagctcagcagctcacgcagcagcatgcggcacagtcccagcagcaggatgagcgtgcccagcagcaggccgcgcagattcagcagcttgcacagcagctgcaggaatcgcagcagcgtgaagcccagctgcgcgagcaggtcgccaaggtcgaaccgagtaccgaaaccggaagcctgcagaagattgcaggagccgcagccagcgccaacacggagccggagcgtgccaccgccatgctgaccctggctatgcagctgcacgaccagtacgtcgacaagggcaaagccaaggctaaggaaatcaccgacgagtcccagcgtaggtacgatgagctcatcggcaatgccaacgattactccaaccgcactcgcaccgaagccgacaactactccgaaggcacccgttccgaagccgatcagtattcggctgacactcgtgccaaggctgatggctacttgaaccagaagactcaggaaggcgatgcctatctgaccaagcgtgctcaggaaggcgatgactatctggcgcagcgcactcaggaaggtaatgcttacttggatcagaagactcaggaaggtaacgcctatcttgctcagaagacgcaggagggtgatacctacttggatcagaagactcaggaaggcgacgcctatcttgctcagaagacgcaggagggtgatacctacttctccacgaagcacaacgaagccgacgaatacgagtccgaagtgcagaagcgcgccttcgactacgattcgaagacccgtaccgcagccgacgactacgcccagcaggtccgcgacaatctcgaagcgcagaccaaggtcatcgaaggcaacattcagggcctcaagcagttcgaaaccgaataccgtgcacgtcttaccgaattcctcggccagctcgtgtcccaggtgtccgacacgaacaactatgatcaggactcccaggacgactgagattaggctgtgtctgacatcatgacaaatgatcaaagacggctgcgcacccgcgtggccgtctttgcgtgtatcgccgttgtggcactggtactcgaccagatcagcaaggcatgggcgcagtcggcgcttgccgacgggcagacggtacgtgtgattccgggcatcctctcattcacgctggtgcataatccgggtgcgtccttgggcatgggatccaacatgacctggttgatttcgttgcttgccatcgtggcgtgcgtggcgttggccgtactggcaatccgtaccatttccatgaaatggacggtggtgttcgctcttgctttcgcaggagcattgggcaatctcatcgatcgtgtgatgtatgccgaaggtttccttaatggcaaggtcgtcgatttcctcaattacggatggtcggtcggcaatgttgcggatattttcctgatggtggcgggcgtcgccgccgtcgtactgctgtttgtcggagagcccttcagccagaaggatcttgacgaacaggccgcagaacagacgaaacagacgaccggagaccagaacgcatgagccgtcttgttcccgcacccgacgcgcttgtcggcaaacgattcgatgtggccgtggccaagatgcttggtatctcccgagccaaggccgcggaactcatcgaaagtggacaggcgcgcgtgcttggtcgtgacatttccaaatcatcgactctgcaatcaggcgaaaccgtcgaattcgatattgtcgaggaacggaccgagcctgaaccgatcgcacgagatatggcagtggtctacgaagacgatgacgtcatagtggtcgacaagccagtgggtgtggctgctcacgcttccgtcggttggaccggtccgacggtgctcggcagtctgcttgacaggggagtgcacatcacctcctacggcgccgcgggacgtcagggtatcgtatcccgcctcgacgtgggcacatccggattgatgctcgtgtgcaaatctgacctcgcctacgtggaaatgcgcaggcagttcgccgaacatgaagtcgtcaaaacctatcatgcgctcgtgcaaggcaatctcaaggaaaacaaggccacgatcgaagcgccgatcggacgtgccaaagtctccgattttcgtttttgcgttacgcccgccggcaaagaagccatcacccattgggatgtgatggaacgtttcggtgaggcgacgctggtttccgtgaatctggaaaccggtcgaacccatcagatccgcgtgcatttctcgtccatcgggcatccgcttgcgggagacgccatgtacggtgccaatccgcagttgggtgaggcattgggattggaacggcagtggctgcacgccaagcaacttgaattccgccatccgcgaacccatgtgtggaccacggtgaaatcgcattatccagctgatttgcagcatgcgctcgacgtgatgcgcggcaggcacgacacacaagacaagcctgaagtgtgatcgcacgtcaccaatcaccggtagattggaacgtatggctacttccggaaatttcgtgcaactgcataatcacacgcattattcactgcttgacggggcgtcaaagattccggatctggtcaagcgcgccaaagaactcaacatgccggccgtcggcatcaccgatcacggcaacatgcatggcgcatacgaaatgtggagcactgcggtcaaggaaggcgtcaaaccgattatcggcattgaagcgtatgtgacgccggaaaccgcacgccaagatcaaacccgcgtcagctgggataccaactggaatcccgatatcgatccgcaacatcgcaggcgcaaccccaacgacgtatccggcggtggcctgatcacccaccttacgatgtgggcggaaaccgatgagggccttgtcaatctgatgaaggcgtccactgacgcgaatctcgagggacgtgtcatgcgacacccccgaatggataaggaaatccttgccaaatattcgaaaggcattatcgcatcttccggatgcccgtcaggcatcatccaaacgcgactgctgctcggccaattcgacgaggcattacgtgcggcaggcgaattgcaggatattttcggacgtgacaatttctatatcgaattcatggaccacggtctgaaaatcgaaaaacaggtgaccgacggtctgctggacattgcgaaaaaactgaacgcgccgctgctcgccaccaacgattcccattacgtgcgcgccgaagacgccggctctcaggatgccatgctgtgcatcaattcgggatccacgcttgacgagccgggacgattcaaatttgacggcaccggctactatctgaaatccgccgaagaaatgcgtgagctgttcaaagacattcccgaagcatgcgacaatacgttggaaatcgccgaacgctgcaatgtcatgttcgacgatcatgaagatggcgcgttcatgccccaattcgactgcccggaaggttgggatgagacgtcgctgttcctgaaaaaagtcgaggaaggcttggaacggcgttatgacgggcatccgccgatcgaagtgctcaagcaggccgattacgaatgcggtgtgatctgtcagatgcagttctgcggatacttccttgtggtggccgactacatcaactgggccaaatcgcatggtgtgatggtcgggcctggccgtggctccgcggcaggcgccatggtggcgtatgccatgggcatcaccgaactcgatccaatcaagcacggcttgatcttcgaacgattccttaacccggaacgtgtgtcgctgcctgatatcgacgtcgatttcgatccggacggccgcggtcgcgtgcttgactatgtcggagacaagtacgggcgagacaaggtcgcgcaatgcgtgatctacggcaccatcaaaaccaaacaggcgctgaaggattccgcacgaatcatgggctacgaattctccatgggcgagcgcatcaccaaggcgttgccgccggcgcagacgggtggcaaggatattccgctgcatgatattttcgagccgagttcgaagcgttatgcggaggcccgcgaattccgtgagctttatgattccgatccggatgtgaagcgcgtcacggatgaggcgatgggtatcgaaggcttgatccgtcagaccggtgtgcatgcgtgcgccacgatcatgggtagcgagccgatttcgaatacgtcgccgctgctggaacgtaccgatggtacggttacgaccacgttggagtatcatacgtgtgaaacgcttggtttagtcaagatggacttccttggtctttccaacttgacggttattcgcgatacgttgaacaatatcgaggcgaatggcaagacgcgtatcgaccatacgaagattccattggacgatcgtgccacgtacgatctgttgtcgcgaggtgacacgcttggcgtgttccagttggattctgatggtatgcgttcgttgctgaaaacgttgaagccgaataacttcaacgatatttccgcattgatcgcgttgtatcgtcctggtccgatggatatggattcgcatacgaattatgcgaagcgtaagaatggtttgcagaagatcacgccgattcatcctgaagtggccgagccgttgaaggaagtgcttgacgaaacgtatggtctgatcgtgtatcaggagcaggtgcagtcggccgcgcgtattctggcgggttattcgttgggcaaggcagacgtgttgcgtcgagcaatgggcaagaagaagcccgaggtgctggccaaggagaaggtgccgttcttcgcgggcatgaaggagcatgggtattcccaggaggcggcgcaggccgtgtgggatattcttgtgccgttttcgggctatgcgttcaacaaggcgcattcggccgcatacggtttgatttcatattggactgcatatctgaaaacgcattatccggtggaattcatggccgcgttgctgcagggtgcgagtacgaacaaagacaagaccgcgttgtatttgggcgaggctcgtcgcatgggcatccaggtgttgtctcctgacgtgaacgagtcggtgtacgagtattccgctgtcggcgatgtggtgcgtttcggtcttggcgccatccgtaacgttggcaaggctgcggttgatgcgattgtcaaggaacgtgagaacgatcatggcaagtatgtgaatttccctgatttcatcaggcgtgtgccgatggaggcgttgaatcgtcgattggttgaatcgttgattaaggccggtgcgtttgattcgatcgatccgaaccgtcgtgccttgtttacgattcatgaggctgcgattaattcggtggtcggtttgaaacgcaagcaggccgaaggccagtttgatttgttctccgatttggaagatgccggcgaagacgatgcgggcatgggcgatgccatggtgaatgtgcccgatgtggaggagtgggataagaaaaccaagctgaatttcgaacgtgaaatgcttggcttgtatgtgtccgaccatccgttgagcggtatgcagtcgattctggtgtcgttgcgtgaaatgtcgatcgcgcatctgatcgatcgcgcggcgaatatgccggacggccagcaggtgacggtggcgggtttgatcacgaacgtggaccgtcgtatgtcgaagaagggcaatccttgggcgattgtgaccatcgaggatttggaaagctccatccagtgcatgttcttcggcaaagtgtatgaggccgccgctcccgaactggcggtcgacacggtggtgcagattcgcggacaggttgagaaacgcgatgagacggtaagcatgcgtgccacggaattcaacgtgccgacgttggaagcgcaggatgagaagccggtgacgattatgctgccgccgattgcgcttgaccaatcgcatgtgcagcagttggggcagattctttcaaatcatcctggaccctgcgaagtgaagctcgccttgatggacgataagggcaatgccaaggtgttgacgttcggcgaccgtttccgcgtacgccgcgacacgagtctgttcgccgaaatcaaaatccttttcggtcccagttctctgcctttgggctgaccggtcgtggggatgatgccgaaagttcagccgaatatctcactatgcggctgaacttgagacgcgcgggcgttctcgtgacatcacgttgttaccatggggcgttatgagcgaagaaaactatatgcgaatcattgacctgcgtggcaagaagctgacccgagctgaaatgctggaggctatgcctcgcgctgagatgggcaccaacgaggccaccgatctcgtgcagcccattcttgacgatgtgaaggcccgcggtgctgcggccctgcgtgacttcgcggagaaattcgaccatattcgtccggagaacctgcgcgtgccggtggaagccatgaaggccgccgtcgacgagttggatccggaagtgcgtgccgccatcgaagaatccgtgcgccgctcccgcgccgtgtccgcttcccaggtgccggcgccgttccacaccgatctggctgaaggcgcgcgcgtttccgagcgttggattccggtgcagcgtgtcggcctgtatgtgccgggtggcaaggccgtctacccgagctccgtcatcatgaacgtggtcccggcacaggccgccggcgtggaatccctcgccatcgcaaccccgccgagccgtaacaatgccgacggtctgcctgacaagaccattctcgccacctgcgccattctcggcgttgacgaagtgtatgcggtcggcggcgctcaggccgtggccatgttcgcttacggcgccaagggatccgaaccgcaggacggcgaaatcctgtgcgatccggtcgacaagatcaccggtccgggtaacatcttcgtcgctaccgccaagcgcatggtgtccggcatcgtcggcatcgacgccgtggcaggaccgaccgaaatcgccatcatcgcagacaagggtgccaacccgagctggctggccgccgatctgatcggtcaggccgagcatgacgaactcgccggttccgtgctcatcaccgacagcgaagagattgccgaacaggtgcaggagaacctcaagtaccgtgtgccgcgcaccgagcactccgagcgtgtgaacacgtcgctacgcggacgccagtccggcatcatcctcaccgatggcatcgagcagtccattgacgcggccaatgcgtatgccgccgaacaccttgaggtccagaccgccgacccggatgccgtgatcgccaagattcgcaacgccggtgccatcttccgtggcccgtactctccggtgccgctgggcgactacatgtccggctccaaccacgtgctgccgacttccggcactgcacgcttcgcctccggtctgggcgtgcacaccttcatgaagccggtcgaagtcatcgaatacgacgagcagggattgaagaccctcgctgctcgtgtgaacgccttcgccgtttccgaagatctgccggcacacggtgaaagcgtgctgagccgtttcatcgacgatccgtacaacaaggaaaccatcaaggaacaggaagagcaggcaggccttcgatgagtgagacttccagcaacgccattccggcatatcttccgctgcgcaacgatctgatcggtgaggagccgtacggtgcgccgcaattggacgtgccggtatgcctcaacgtcaacgagaatccgtatgcgccggaaccggcagtggtcgaaaccatcgcgcagcgagtcaaggaaatcgctctgacgctcaaccgttacccggatcgtgagcatatcgcgttgcgtcaggcattctgcgactatctcgaacgcgagtccggcgtcaagctggaagtcgaccagttgtggggtgccaacggatccaacgagatcatgctgcagctgttccaagctttcggcggtccaggacgcattgcgctcggctgcgatccgacgtattcgatgtatccggaatacgcccgcgacacgttcaccacatggaagcttgcgcaccgcaacgaggatttctcgctgaacgtcgacgccaccatcaaggccatcgaagacgtcaagccggccatgatcgtgctcaccagcccgaataatccgaccggcacaccgctgaagatggatgatctcaagcgcgtgctcggcgccgccgaaaccgctgaagtggccggtgccgccgaaggcgtgcatccggtggtcgtggtggacgaagcctacatcgaattccgtgatccgggtacgcccaccgcgctcgaactcatcggcgagtatgagaatctcgccgtgagccgaaccatgagcaaggcgttcgccttcgcaggcgcgcgagtcggctatctggccgccaacaagggcattatcgactgtgtgcgcatcgtgcgtatgccgtaccacctgtcggccgtcacccaggcagccgcgcttgccgcgttcgaacataccgacgaacagctcagccgtgtggcgcatctgcgtgacacccgcaatcagaccgcggcatggctcaaggaacaaacctacaagggccagccgctcgaagtggccgagacgcagtccaacttcattctgttcggcggtcatttcgacgatcgcgaccgcatcttcgacgaactgctcaagcgtggtgtgctcatccgcaccgtcggccctgacggctggatgcgcgtatgcatgggcaccgacgaggaaatggcgcgtttccgtgaagccttggtcgaagtgttgcgtattgtggaacaagactgagcacatacgggactgaaccaacacaacaggaccgaacattttccaaaaggagtcgcaacatggcgcgtactgcaaccatcgttcgtgaaaccagcgaatccaaggtcgaactgagcctgaatctcgacggcaccggcaaaactgacatcgacacgtcggtgccgttctacaaccatatgatgacggcgctcggcaagcattcgctgattgacctgaccatcaaggccacgggtgacaccgacatcgacgcgcaccataccgtcgaagacatcgccatcgtgttcggtgaggcgttgaagcaggcgctggggaacaagcgcggcatccgtcgcttcgctgatgcgaccgtgccgttggacgaggcgcttgccaaggccgtggtcgatatttccgggcgtccgtactgcgtgtgcaccggcgagccggaaggcttcgaatactgcatgatcggcggccatttcaccggctccctcgtgcgtcacgttatggaatccatcgccatgcatgccggaatctgcctgcatctgcaggtgatctccggccgtgatccgcaccacatcgccgaagccgagttcaaggccttggcacgtgcgcttcgtttcgccatcgagtcggatccgcgtgtcgacggtattccgagcacgaagggcgctctgtgatgagcgacgatcgaaataacgatttcgacgatttccaaggattcgatggatcaaacgatttcggtgacctcaacgccgacggcatgcatttcagcgaagaggaactggaagcggccatggccggcttcgagcaggaattcaaggatgccgaagcgtccaagcatgagcgggcggacaatccgccatctgaagctttcgattcctccgaagcttccgataacgcggaatcctccgaatcctccgaatcctccgaatcctcggaagtcgacgacatgctcaacgcggctgaggattcgttgaaattcgaagacgagctgcagggactgcttggcaatcgcgcgaaagtggcggtgatcatcaccagactgacctcgccacgattgctgtcggcattctgtgaattgtccgacatttccgcgcaatgcatcggatcggcgcaaggtgctgtcgcggtgctgcgcaatctcgacggagacggtccggaagcggcggtcaaagacatgacgatcgtcgttgccggcatgcccgcgattcttgccgtcaaccgtgcggacaagctcgaagcgacgatgtacgtggaaggcagagcgggcaaaaccttcgctccgccggtgctattcacctccaccgcgccgttcgttgaggatctcatgctgggcatcaccgatatgaacgcgctggaacaggcggatatgaccattttcgattccgctgaccttgatcgggatgcggcgatgagcattatcgccgagcatacgcggttcggacgcggcacatcaagcatcagttaacgacggtaaacgcgagtcatcctgccgaacatgcgttatgcgacacaagacgactcgcgccacagaacaacgaatgacacaagaaggagaacgcccatgacttccgtggtggttttcgattatggtttcggcaacgtgcgttccatggttcgtgcactggctgatctcgaccttgacgtgaccctcacttccgaccatcggcaggccttggaagccaacggtctggtagtgcccggcgtgggcgctttcggcgcatgcatggaaggactcaagtcggtgggcggagacaccgtgatcaaggatcgtctgcgtgccgggcgaccggtgctcggcgtgtgcgtgggcgagcagatcatgttcgaacgcggtatggaacacggcaccggcactccgggccttggcctgatcaagggcgacgtggaactgcttgacgccgatgtggtgcctcacatgggatgggacaccgtcgaggcgccggaaggttccgtgctcatgaagggtgtggaaggtgaacgtttctatttcgtacattccttcgccgcgatgagcgtcgctcccgccgacacgtccggcgaccagcttgatttcggtgacgccgaggagcgcgtgacctggtgcacgtacggacgtagccgtttcgtggcggcctacgagcgtggtccgctgttcgccacgcagttccaccctgaaaaatccgccgaagcgggctcgcagctgctgcgcaattggattgcgacgttctgatggtgcgagatcgccgatgattgtttcgacgatgctttgacatatacgcttttaaaacgaccacttggtacatttatttgcgattgccgtttagtggcggtcggttgatcacagagaggtacagacatgtctttgacattgcttcccgcagtcgatgttcgtgatggcaaggccgttcgcttgcgccaaggcgaatccggttcggaaaccgattacggttcgccgctggaggctgcccgcacgtgggtcgagtccggtgcggaatggattcatctggtcgaccttgacgcggcattcggcacgggcaacaaccgtgaccagctgcgcgccatcgtcaaggagcttggcgacaaggtcaatatcgaaatgtccggtggcgtgcgcgacgacgcatccctcgacgcagctttggaagcaggcgccgcccgtgtgaacattggcacggcagcgcttgagaatccggattggacagcttccgtcatcaagaagtacggcgatcgcgtggccgttggccttgacgtgcgcggccacaccctcgcagcccgcggatgggtgaaggaaggcggcgatctgttcgaaaccatggcgttcctggattccgttggctgctctcgttacgtggtcaccgacgtggctcgcgacggcatgatgagcggtccgaacatcgatctgctgcgtgaggttgcggaacgcactgatgcgaaggtcaccgcgtccggtggcatttccaagctcgatgacctgcgcgccatcaaggaacttgccgatctgggcgtggattccgcgattctcggcaaatcgctgtatgcgcgcgccttcactttggaagaggcgcttgaagtcgcacgttgagcattgttcgcaaacccatgacgatacggccgtccacaacgtggacggtctcgtcatattcggcgcgtgttaacgactttcgtaacatgcgcatggaacgatggggcactatggataaacagcaagagtttgctttgcgcacagtcgaagaacgcgacgtgcgcttcattcgtttgtggttcacggatgtgttgggaacgctgaagtccgtggctatcgcaccggctgaattggaagctgcgttcgaggaagggctcggattcgacggttccgcggtggaaggcctcacccgtgtgtccgaagacgatatgatcgtcaagcccgacccgtcgacattccagattctgccgtggcgtggaggcccgcaaggcaccgcgcgcatgttctgcgacgtgcttacccctgatggcgagccgtcgttgggcgatccgcgtcatgtgctgaagcaggctctgtcgaaagccaaggaaaaaggcttcaccttctacgtgcatccggaaatcgaattctatctgttcgaaagacaggatgattggtcccagacgccaaccccaatcgatgagggcggctatttcgaccatgtgccgcgcagcccaggcatggacttccgccgcgccaccgtcaacatgctcgaacagatgggcatttcggtggaatactcgcatcatgaggcgggtccaggccagaacgagatcgatctgcgttatgcggacgcgctcaccacggccgacaacatcatgaccttccgcaccgtcgtcaaagagatttcgctggagcgcggcattcacgccagcttcatgccgaagccgctttccgacgctccaggttccggcatgcatacccatttgagcctgttcgaaggcgacgccaacgcgttctacgaggcgggccaggaattcaacatgtccgtcaccgcacgccagttcgcggccggcattctgtaccatgcggctgaaatctgcgcggtcactgaccagtacgtcaactcctacaagcgcctgtggggcggcaacgaggctccgagctacatctgctggggccacaacaaccgttccgcgctgctgcgcattccgcagtacaagccaggcaagggcaattccgcccgcatggaattccgtgcgctcgacccggtcgccaacccatacctcgcatattcggtgctcttggcagcaggccttgacggcatcgacaagcagatgcagttgggcgagccgaccagcgacgacgtgtgggagcttaccgatgcggaacgtcaggccatgggcatccagccattgccggagtctcttgacgaggcgttgaaggttatggagaagtccgacttcgtggccggagtgctcggcgagcatgccttcgaatacttcctgcgcaacaagcgtcaggaatgggaggaataccgcaagcaggtcactcctttcgaactgaagaagtacctgccgaagctgtaagcgaaccgtaatcgtttcatcaaagaccgttgttgcaatcatgagaaaactgattgcaacaacggtcttttgctttccgaatgattatttgaatcttcttttgatgtttctgcaagtatcggattaaagttccaatgactcaattgaccgtaaattaacggttttgcgaagaatctcatcaccatagtcagaaaatatgaatgtcacaggcgagttgctttgcgtttcaaaagcgactgtcgtcgtcattttcacgccgggagtgaccttgcgtgttgtggaatagctatcatcgtcaagatacgtgctatgcaactcagtgccgtcttgggtcgcggaaacatccatatagttcaggaaagcccggtatttgcttccattttcgacataccaggatatgcgtgcgaacgctatgtcatgatcggcatatgaggggcttgtcttctcaatggagtctacgcggaaatgcagggtgctttcgtcataatcggttacggatccgtcttcgtcgaaattcgaagcgtccacttgctcgggctgagggacggccgcataatcaatatgtttcaaggatccttctatgtcgacttcgtcaaaggaaaacgcggcgcgaacaacattatgctgcgaataattcatcagctgaaccacaactggtgaattggtgtccgtaagaacgaaactgctggtggtctgcgagcttttcttcggtttcatttcggcgccggagaactccgtgcggtcggaatcctcgttggaagtgaatgcaggagcaagctcgatgccgttttgcatgaccatcagatctgcgacggcatgaggatacatcgttttcttgccgatgttcgtgcaggtgagcaaaaccgtgagcgtggcgtcgccgttcaaatcctccggacctgtctgcacgccttcgatgttcacttccaatgcttttcctccggtggagtagagctttccaacgtcttcgctgacggtttcctgcgtggacagctcctcgaactggcttgtggatccatcgaaatcggagatgatgtttgacatgctgtcagaaagcattccgccaatcgacgctattacagcgatgatgataacgatctccaaaacggtgacgaagccgtttttatggcggcgttgcttcttgtcggaagtggattggaactcgcgtgtggctcgttccgtttgtatgcgcggcggattatagggctgcgatgggcgtccttgcgggttctgcaggttttgctgattttgccgcaacgcctgttgcaagctttgctgcatggactgggcataccgcatggtttgcgtggaccagtcgttcaacatggtttggagcgtgtctcctcgtgtggactgatcgccttgcgcctgttgagatctaccgtcttgcttggatcgggtgttttgtggggcctgcctgtcgcgcgatgcctgatcgctctgcgcgggtttcacatatcgccgctggacataggattcacgccgtgcatggtcacggttcacctgattagacaggcgttcggcgttgctgctgggatcgatgtaatcggaacccttgaatgggtcgatatagtcgttgttgttgagtaggctcatgaaaggctccttctggtcagtcccttccatgagcaattgtatcgaaaaatcagcctcgaggagagccgaacatcgaattgtagatgattgcgaaattacgattgccgtaagtcgaacaggcgtcgccttcgccgactcccgcatccaatgcggctgcattcggctgataaggcgtgtaaatgtacagcagtgctgtcgccttgttttcgatgtacacgttgctgccaccgcagctggcgtccggattgtattgaatatagttgagcgtgcccgcatggtatccatagcgatcctcatgttgcacgtaatactggtagcgtttcgccgcgccatacacctgtttgaaaaaacctgcatattccgggtcacagttcgcgtcgtccgggcagctcaatcccatggccgacttgaattggaagtcgcttggatcggtggcggtaagcagatgctgctccttttgcagcacggtgagcagcactttttgactgatgtcgcacgcctttcccgacttgtagatgatcgccgcggcgctttcgttcggctctccctcatatgcttcgcagtattcgttggcgggttgcgattcggtgctaaacgtcatggatttcaagcatttctcgccgctgcatgcggcaccctgtttttcgatgatggcgttcacctgctgctcgctcaacgcgttcccgttgaagaacagaccatctgaaatgatgttgcccggattgaaatcgtattgcgtctgcaattgttcctgcgatgcgaccgcttcatccacttgcacacgccaaccgacgaatcgcaccaatccaacgatcaacgcgagcgcgacgatactggctatcagtgtttcgccgactatgaggatgcgttttggggtgtttgcttttttccaggcgttacggagtttggtgaggcttggctgcttgtttttcttgggtttgcggttgttttttgctgtggtggttgttttgcgtgtcatcgcgcgtcattgtatcgcgtttggcttatcgtttgtttgacgattgattcgtcaatcgattgacgtgagaagctttaatgacaatgcgagtttggcgaggcgtggggagttcgaggggctatggaggagaagtgtatggcgaagagtgatgtggcgaaggaacggtttttcaatctgcctgtgattgtgctgatctcgctgagtttcatgctgggcatgagcgagttcattgtcgttggcgttctgccggatatcgcggctggcttgaaggtgtcggaggtgacggtcggcaatcttgtgtcgctgttcgcgttcgtgtatgcgccggtcacgccgctcggatcggcgctgtcggctcgttttccgcgttttgccacgcatctgacgctggttggggtgtttcttatcggcaacgtgttgtgcgcgttcgcgtcgaattatggcgtgctcgtggtggcgcgaattctcatcgcgctggtgtccggcacgctggtggccattgccatgacgtacgcgcccgatgtaacaactgaacagtaccgcacggagttcatcgcatgggtgttttccggcttctccatcgcatccgtggtgggtgtgccggttggcacgtgggttgcgaacacgttcggctggcgttgggcgttccatttggtgaacgtgctcacagtggtgcttattgtgctcatggtggtggtgttgccgcgcaacagccgtattgtgaagattggttttctgccgcagttccgcctgtttttcgaccgtcgtattcagttgggcgtgcttgccgtggtgtttggcgcggcggcaacttacgtgttctatacgtatctgacgccgatcatgcgagacgaagtgcatgttcccgaacagtatttaagcgtcggcctggtgattttcggcgcggcctgcctgtggagcaacctgtatggcggcaagcttgccgaccgtggcaggggagtgggaccactgacgcatattcgtccgatctactgcgcgcacgccgtgctcatggcatcgctgatcgtaacgcattgggtgccggtgtatggtgcgttgctgctggtggtgcttggcatgttcatgtatctgcagaattccgcctcgcaggtgctatatatggatgttgcctctcagtcgcatccgggatcgctgaatctggccgcatcgctcaattccatgtcgttcaacatcggcatcgcggtcggctccgcggttggtggactggtcaacgcccatttgggactgatgtggcttggccctgtgggcgcgatcttcctgctgtgtgcggttggcaccacaaccctgctgcgcccgttcgcagctcgagaacgcgatttctacgccaaacagcaagcctgatggcatttggtcgggtttgaacgagcggtttctgaaagcggcaaagttatagaagttttatctgtaattcgttgagattgcggaaagcgattagtggactgcgatgttggcgggctgggcagtggacccgccgacttgcggagcgtagtcggctagatcgattacgcgatcgcaggcgtcccgcgtgtccggatcatgggttgccaccagcacgatcatgccttgaccggccagattgccgagcacatggcttacggaatgtgatgtacgcgtatccaactgggcggtcggctcgtcgaccagcagcatgttcggcctggaacataccgcacgcgcgagcataagacgctgcgcctcgcctccggacaaagcgcagaaacgcctgtctgccgcatattccagatcgaacagttccatcgcttccaaagcctttggttccgcttcgcggcggctcattcccttggcgagcagtggaaacaccacatggtcgagcgctgtgcgttccgcaacaccatacggattctgaaacatccatccaacacgatccacaccttctcgcgtcaccgtgccagcgtaaggctgctcccatcctgcaagaatcgacagcaatgttgacttgccgcatcccgacggaccgcatatcgcaatggtcacaccaggttcggccacgaaactcaaattctcgaacagcagatcggttccctcaaatcgatgagccaacccctcaaccgcaacgcgcatagccaacctttcacgaggcaatcaccttaccgatgcacccttgccaatcatttgtagtcccctaatcgcaaccacgcaacatccaccctacctcatttgcgtatatgcaagtaagtttttcggaaatgccgcctgctatgcacattatcatgcggtgctacactcgttgtgatacattagtacgggggtgaagatggtgacttcttggatgtcattttgcaagacttgcgttcttgccgtcgcattgtcaatgcttttggcgggatgctcaattaatggggatgccacaggcgcatcttctgattctgccacatcggaatcatcatccgaaaatgggtcggcgggcggacagaaattggcggcgtcgttgagtgaatggattgaacagcgggaatcgcaaggtaatatcgctgaatcgcagaaaacgatattggacaaagccaaaagtacgggtgagatttcgacgtcggattatgagaaagcctggtctgattaccggcagtgcatgatcgacaaaggatataaggaaatcaaactcatcaaatatccgagcggactctatgccgaagctggacacaaacaggggacgaccattcaggaatcccgatattccgatgattccacggaatgcggcgatgagtatgttgcagatgtgcaggatgtgtacggcattatcgtgggcaatccgaatctgtatgccgatcaagcgcaagccgtggtcgattgtttgcatagagactcgctcgtgccgaaggactataccgtaagccggttcaacaaggagttttccggaacggatggcaatacttcgtttgacatgcagaacctgcaagtgcgcagttgccttgtgtcgaacggctacaacgtgggatatgcgaccgacgatacggaacagttgtggtgagaaggtaagtgattccaggggaattatggtgatgtgttcgctgatggtgcttgttggctgtgagtgaatgggtatatgtgagtatgacgcgacgattcggaatgaggcaaaggacgggcggtaagcgttcgaagtgcactgctgtgacttggactctgctggcggctgtcacggcagcttgtattgcggtcggatcctgcgcattgtggctgcctgaccgcacgccgacattactgagctcggcggtggagaagaccgtggctcccgccagtgtgcaagaatatacgggcatgcagcaggttactgtggtgcccaccatttccagtgaccgtgatctttccggcaatgcgagtggcatggtcaccgcggactggtccggcgacggcctgatctcaggcaaaggcgcctaccaggtgaacgatcgcacggtagtggcgttgaacaccgcaacccccttgtatcgcgatttgaagaccggagacatcggcggcgatgtgctcgccctgaataatgaactcagcttacttggctacaacagcgttcccggatcggatacctacgggtgggccacatcggacgggtggaagcagttgatggccgacaacggtaatacgtcggatggatcgttgtcattggccgacacattgtggattcccgaacacgaagtcgcagttgccgagtggaacgcaaccgccggatccatggtgacgggcggcaccgcaatcggcaaaatccccggatcattgacgaaactcaccatcaaaaacggcactgcatccgcgcaggaacgttcgttgacgatattcggcattacgggaacattgccagccaataccactgaaatcacggatgccgggttcctgcaacaagtcgaagcgaacgacagttaccaatccgtggacgtggaatccagaaaagcgggatttgacgccactttggccttgagcgaacggatgcgagtgctgcgcgttcccgccggcgcggtattcggcatcaacggttcaaccggctgcatcgtgcccgcatccaacaatcatggcagcactcccgtgaaagtgtcgatcgtgggaggcgaacttggcgtgagcctcgtgcaagccgacagcgaagacatcgcttcgatctccaatgtggaaatcggcagcggacttaacaatctcacctgcgagtaggcgattatgcgattacgatcggtgctttccgaagcgttgcgcaatattggcgcgggagtgagtcatgcgctgcttatgtttgcagcggtattgttcgcgtctacattgctcggcggatatgaggccgccaatgtggtggggctcgaaaccgaggcggtgcaacgcatcaacgcctatgccgacgttggcgccatcgttgggggaacggtggacggagccgcatgtgacaggctcgccgacgctggcggcggtgtgatgggcaccttggccggtgcgatgcgtgccggtcaacagattgtgccgcttgccacgcccggcaaggatatatcgtcgtatgaagtgacgcccggcatgatcaggatgatcgccgggagcgcgaagtccgatgtgtccggcgtgtgggtatctaccgacgtggccaaggattttggtctcaccaaaggcagcgtaatgcagaccgaacagggaacgatgagcgtcgcaggcgtgttttattggccgaacgatggtcgtgacacgcgattcgcctacgctctccttgtgcccgtatctgcgtcgaatggcacgttcgacgaatgttgggtcagacagtggccgcaaagcgggcagacggaggatgtgttgttttccacgctggttgcgtcgggttcgtcatccaatgccggcgtgacgcaggtgaataagagtttcgattcgcattacgatgcgcaagcttcgtacgggcagcgtatgactcgttggatgccgtggctgggattggctgtggggctgatgttcggcgcgttcggcgtgcgtcgtcgtagattggaatatgctggcgcattgcattcagggcagtccaaaggtgcgcaattgctggaaatcgctgtggaaacgttgatttggagcggcttggcgtgtgcctcttcggccgcgctgttgggtgcgtattgcgttcgcatgagcatcgccgattcaatgaccgtatggttgggtgcgatgcgcgcgccatgtgcgatattcgctggagtgatggtatcaagcgtgctcgtcggtatgacgatacatgaaacgcagttgttccgtttcttcaagcaacgctagacaccgctaaccatggttcgattgaggatgatttcattaggttctattgccgtcgatactggaaaaccgcaagtatcgacggcaatggaatgcgaaagatgatgatgcgttagctcaacgctttcttgatgcgctgcaggctgatcggcttcggcgtgccgagttcctgcgcccacaatgatacgtagaattcctcaagcatccaacgtgcggtgaccgcctgcttcatcaacgcctcatgacgcggacctgcaggctcacgttcggccttcgccatggccttgtcggccaactgcttggcctcatcagcctcccaagcccaacgcacatcacgattcttgtcgttcttcgccttacctaaacgaagcacgtcagcatgcagataccgttcaatcggcgccaacgcatccggaggagtcttaccaatgaatcccggatacaccagcgtggcgatatgctcacgaatcgactgcaaaacgctcaacatcggcagatcggccttgcctgacacggctttatcaacctccgcataccgcttcaaaatagcgatcacatcatgcgcaaccgcatacacggtatcttcgaacacttcacgtacatcaagcaccgcattcgccaacgcctcatcatccggcaattcgtcaacattcggcagcaaacgcttcaccgcagccaactgcagatcctcagtaagatccttcgtggactgatatggtgcggacgccaacatcaacgcctccgcacccaaccaacgcgacgaaatacgctcgctcggcatacgcaaaacatcaagtgcaccgcgccacagcatggtggaacgagcttcggtagtggcaccagccttatgcagcagattggcctgctccacaagcttgccctgatttccagcgttttccgcctgcttcttcaccatctgccgtgcggaagcctcggcttgctccgcaaacttgcgctgcaactccaccaacgatttgcccgagccaagcaccttgacagggccccgcgcatgacgcctgccatgctgactcttgcgactcggaggcaactgctgctccacagagaacgtcacgcgcaaatacggcatgagcttgctccacaattcaccagtcaacacttcagggtgaatctgcgcgccaacaatgctgattgccgcctgcgtgaacgtatgaggcaaatccggccacgcggccacaccctccgcattggtaggagcaagattcggcttctgctggttaccggaaccaggcagatccggatacctctcatcaatccacgcacgaatcttacgagccgtatcaggagcgggaacaaactgcacgcgcaacgtcttcggcaacgacttgatcatgccgacaatcaactcatccaacaatccgggaacattccacgtgaactgttccggtgtcaaacgagacaacaccttcaacggcacatgcacggtcacgccatcgtttggatcatgcggatcatacacataactcaaccgcaaatcgataggggagccgtccgtacccaacgtatgccaatgatccggataatcagccaacgacactgactcggcatcagcaagacgctccaccttctccggatcaaaatccaacaaatccggctgctcatcatgctttgacttccaccatttcgcaagatccgcaaccgacgtgacagtattgggaatcaccgaattataaaaatcgaacagatcctcatcactgaccgcctgcgccatctgacgtgtgcgactcgcatcgtcggcggcatcctccaacacatcgcgattcttcgcaatgaaatcgtcatacgagaaccgctgctgaatatcaccctcgaccaaaccctgacgaatcagaaaatcacgggcctccagcggattgatacgaccccactgcaccgtacgatcctgcactatcggcaaaccatacaacagtaccttcgcgctcgccaccgcggagccacgcgaaccagaccaatgcggatccgcatacgtggttcgcgtcaacgaacccgccaacggttcagcccaagcaggatcgatctgggcggaatatcgcgcccacaagcggctcgtttccaccaactccgtgctcatcacccattgcggtgtcgacttggcgaccgcggaagccgggaacaatgcgaaatgcgtgccacgcgcaccctgataatcattcttcgccatcttctgcgcacgcttcatggcacgcgcacgggcagcgcccttcaagccagcgaaatcagatgccttcggttcacgcacgatctgcatgcccatcatcgacaacaagcccgaaagcatcgacgtatggataccctgcgcatcccacgaacaacacaacgaatgcgcagcctgctgattcgacggaagctgacgaatctcaagcggcggacgcgaagccggaatcggatcgccaaccttgaacttgaattccttgcacatctcacgcaactgcgtgaccagatccttccactgacggatgcgcagccaactcaaatactcagtcttgcaaatcctacgaagcgcggaattgctcggctcgccatcagcttggaacacgcgatcccacaagttcaacgcggtcagaaaatcactggacggatcggcataccggttatgaatgcggtcggcctcctcacgattctcatccggacgttcgcggggatcctgcaaacttaggaacgcgaccaccaccagcactgcggccaacgtgttcggcgtggtcgacttcgcagcctcgatgatcatacggcccaaacgcacgtcgatcggaatgcgtgcaagcatgcgacctgtatgcgtcagcacaacctcgccatgcttgcgcgccacggccttcaactcggtcaactcattgaaaccatcagacaccgccttcatatcaggcggatcgataaagccgaaatccgtaacatcctgcgcggtacgagccacacccaccgacagcatatgcaatacgaccgcacccaacgacgtgcgcagaatctcaggctccgtgaattccgggcgcgtctcgaaatcctcgcgagaatacaagcgaatcgcaataccatctgcaatacggccgcaacgacccgaacgttggttcgcgctcgcctgactgatcggttcaatcggaagccgttgcactttcgcgctcttcgaataacgtgaaatacgagcggtgccagggtcgaccacataacgaatgcccggcaccgtcaatgacgtttcggccacattcgtagcgatcacaatacgctgatggtcatgcggctcaaacacgcgatgctgctccttggaggacaaccgcgcgaacaacggcacgatctcaatcgcatcaggacgacgcatatcaatggcacgcggaccataatgatggcgcagcgcattctcaaaatcatgaatgtcgcgctcgcccgaggcgaacacgagaatatcgcgcgggccacggtcatgactcgaatgaatcaccaactcggcacaggcgcgcgccaccgccgtcggcatgtcaacgttcggctcgcgggaatccttcgcgtcaggagcggccgacaacgtttcatagtcggcatcgcccggcatcgcgcccgtttcaaaaccgggtacggaacgcatcaacgccggagcggtgcccagcggctcatacacgacctgcacggggtaggttcgtcccgaaacctcgataaccggcactttcgtatgcaaagcgtgctcgaaatgctcctggaacttcaccgaatcaatcgtcgccgacgtgattaccaatttcaggtcacgtcgtttcggcaatagcgcagtcaaataaccgagcagaaagtcaatattgagactacgttcgtgcgcctcgtcgataacgatcgtatcgtattgcatcagtttcggatcgcgttgaatctgcgccaacagaataccgtcggtcaccacgcgaagacgggtcttcggtgagctctcatcggtgaaacgcacctgatagccgacctcgtcgcccaaacgcacgcccatctccgcggcgatacgttcggccacggtacgagcggccagcctacgcggctgcgtgtgcacaatctgcctgccatgcgatccacggcccaattccaacagaatcttcggcagctgcgtggtcttaccggaacccgtctgaccagacacaatcacgacttggctcgacttcaccgcctcggcaatatcgctacgtgcagcggaaaccggcagttgggaaggatattcgaatttcatgccttcataacctcgataacgcggaagcccttcgaactcgcgtacttacttacctcataaccatcgccaagctgcgtggcaagccacggaatcaacgaatccgaccccaaattcttctgcaccaccaaataggcggcaccacccgcattcaaacgtggtagccacgtcatcaacaactcatgcagcacatccttgccaacacgaatcggcggattcgaccaaatcagatcaaacgtcatatccgaagggatctcatcggcggtgaccgcatgaacgttcctcacaccattgagctcggcattgcgacgcgtcagatccaacgcgcgttcattcacgtccaacgcccaaatatcagccttcggcgaagcaaaaccaagtgtcaacgcaatcggaccccaaccgcaacccagatcaaggaacgtaccctcctcaggaggctccggagcctgacgaagcagcacggacgttcccaaatccacgcgattgccggaaaacacgccattggaaacctcaacatcggcctcattgcctcgcaacacaacatgcagcctcttacgtacatccttcgactgcggatcagccgcgaaatactgttcggcctgtgccatacccactccttgcaaacgctcgcctccggcatcacgcaagccacgctcatccacgtggcgaatgcccgatacccatgtctctagagaatgatgataataaagacaccatagtttaaccgtgagaggtgccattgagccaagaaaacgacatcgagcatagcatgagcgccaacgacgtgtcaggcgtgctcgccgaccagtccgaagtgctgcttgataccaacggcgagaaccatttcaacgaatcccatgacgaacaatggcaggaacgcgaatcccgcaatgcgttgaagcatgtgtccggactcggcgaaatgcaagacgtcaccgaagtcgaataccgaaaagtccgcctcgaacgcgttgtgctcgtcggcgtgtggtccagccgtgaaaccacacaggcacaggccgaagaatcattgagagaacttgccgcgcttgccgaaaccgccggcgccgtggtatgcgacggcctgctgcagcatcgtatcaagccggacgcagctacatacgttggctccggtaaagcccgcgaactcgccggaatcgtggcgcaagaggaagccgacaccatcgttgtggacgatgacctgccgccaagccaacgccgcgccttggaagacgccaccaaagtgaaggtcgtggatcgcactgccgtgatcctcgacattttcgcccaacatgcgacctcacgtgaaggcaaagcccaagtggaactggcacaactccagtacatgctgccacgactgcgaggctggggcggatcactgtcgcgacaggcaggtggccgcgccgcaggagacgcgggcatcggctcgcgaggacctggcgaaacgaaaatcgaaatggaccgccgtgtgatccgaagccgcatcgccaaactccgcaaacagatcgaacagatggctcccgcgcgtgacgtcaaacgtggcgctcgccgtcgtttcggattgccgaccgttgccgtggttggatatacgaacgcgggcaaatcgtcgttgacgaatcggttgaccggatcagcggaattggtggagaacgcgctattcgccacattggacaccgcagtgcgcagggcgcgtgccaaagatggacgtcaatatgcgtacgtcgataccgtcgggttcgtgcgtcgactgcctacgcagctgattgaagcgttcaaatccacgctggaggaggtttccgaagccgatctgatcgtgcatgtggtggacggctcgcatccggacccgttctcgcaaatcgacgcggtcgacgatgtgctttccgacatcgacggcgtcgaaaccattcccacgattatcgtgttcaacaaggccgaccgtatggatgaggccacacgcgagcgtatcgaggcgttgatgccggaagcgtacatcgtatcggcgttttccggcgaaggcgtcgacgagctgcgtatgcaggtggaatccatgctgccgacgccgaacgtgcatgtcgaggcgttgctgccatacactgccggttcgctggtgtcgcgcgtacgtgaatacggcaaagtgatcaacgtcgaataccgtgacgacggtatgatgctcgaagcggaagtggacgatcatttggctgcgcaaatcgtggaacagtcaatcggctgaaaaccttgcaaaacagtgcaacgcaacgaacacagcgtttgtgagcgctcacatcttttgtgatgcatatcacttttcattatttgcaagtcgtgttataacgccttgaaacgtcatgctgtgtggataaagtaaagatgaaattctaagagaaaacctgctaccagcgggacattctttcttataagagaggtaagcacatggtggattcaccaatcaagcccacaaagctcgctatcatcggtgccggtgcagtcggctccactctcgctttcgctgccgctcagcgtggcgtcgcacgtgagatcgtgctcgaagacattgccaaggaacgcgtcgaagccgaagtactcgacatgcagcacggctccagcttcttcccgaccgtgtccatcgcaggctccgatgatccggaaatctgccgcgacgccgacatgatcgtcatcaccgcaggtccgcgtcagaagccgggtcagtcccgtctcgaactggtcggtgccaccatcaacattctcaaggccatcattcctggcctcgtgaaggtcgctccgaacgccatctacatgctcatcaccaacccggttgatatcgcaacccatgttgcccagaagatctccggcctgccggcaaaccaggtcttcggctccggtaccaaccttgactccgcacgtctgcgcttcctgatcgcccagcagaccggcgtcaacgtcaagaacgtgcacgcctacattgctggcgaacacggcgactccgaagtgccgctgtgggcctccgccaccatcggtggcgtcccgatgtgcgactggaccccgctgccgggtcacgctccgctcgacgccgaagttcgtgagcagattcaccaggacgtcaagaacgccgcctacaagatcatcaacggcaagggcgcaaccaactacgccatcggcatgtccggcgttgacatcatcgaagccgtcatgcgcgactccaaccgcatcctgccggtgagctccatgctccacgacttccacggcatctccgacgtctgcatgtccgtgccgaccctcctcaaccgttccggcgtcaacaccgccatcaacaccccggtgtccgaccgcgagcttgcagcccttacgcgttccgcagagacgctgaaggaaaccgctgcccagttcggcttctgataaaaacgcggtaacggagtgctagctgcgttacacggaattcgacgtacctctgtacgccttcattccgtgcgccttgctgtcacatgcgttaccgcgttttttattgttttctggcggtaacggagtgccagctgcgttaccgctttttggttgcttgggtattgacaggcgattgatcagtcgttagactgcaaaaagaaataaaggaaaccccggcctatggctggggtttcttgcgttttgagagcaatgaaaatggtattgagaaacaatttcaataagtttcttaatcgggctgaaagattaagcatatggcacatgaccacgcgcacggatcgatagcgaacacaggagcggaacatcaaaaacggctcatgatgtcgctcggtctcacctcgacggtattcatagcggaagtcatcagcgcggtcatcacagaatcgttggcgctgctcgttgatgccggacacatgctcaccgacatgtccgtactcatcgcatcaaccgtcaccgcaatactgatgcaacgcaagcccagcaacaaacgcacctggggctgggcaaggctcgaagtgctaacagcggcagtcggagccctcatcctcctcatcgtaggtatctatgcgcttgtggaagccggcatgagacttttcggcggatctgccgacgaagtaaacgacgtgcgattgctgctcttcatgggcatactcggcctcgcggccaatatcggatcaatctttatcctcgcatcgcaaagcgaagacaacatgaacatgaaagcggcattccttgaagtcatgaatgacgctttagggtccgttgccgtaatcgtatcggcaagcgtgctcatctgcaccggctgggccggattcgacgctgtggcaggtggcatcatcgcactcatgatgatcccgcgagccatcaaactgttgcgcaacgcggttcgcgtgcttctcgaagaaacccccaacggtcttgatctcgatgaagtgcgttcccacttggaacaagtgccgcatgttgtggcggtacacgacatccacgcgagcatcgtatccacaggcatgccgatcttcatggcgcatgttgtggtcgaacaaggactcaccatgaaagaagcggcggaaatactcgcacaactacaagattgcctgcgcgaacatttccccgtatccgtacctcataccaccttccaactcgaaccggaaggatacagttcgaccagcaaatccgaaatgcattcctaaacattcttaaatgaccggtgcgtttaccggaaaagaatcgcgcacacaaagatggagtctttgtttatggcttcatctttgtgggcgcgatttcaatggcgttgaatagtctaacgtcagattttgcggagcacggtgaccaccttgcccatgatctcagcatgcgtgccatcgataggggagtaggcgggattgtgcggaatgagccagacatggccatgatccttgcggaacgttttcaccgtggcttcatcgtcgagcagcgccgccacaatatctccattttccgcggtgttctgctcgcgtaccaccacaaaatcaccatcgcagatagccgcgtcaatcatggagtcgccatgcacttcaagcataaacagattgccggtgccagtgagacgttccggcagacgcatcacatcgtccacatgctgctcggcggtgatgggcacgcctgccgcgatgcgtcccaccaaggggacatcgcgggaagccatgatggatccgctggaatcagattggctcgggaatgggatgacctgcgctactttgccgggcgaaacctcgtcatcgtcgaaactcacgacttcgatggctctgcccttgttcgcgttcatgcgaatgaagcccttgtcgtcaagcacttgcaactggtgtttgacggatgacggacttttaagccctgcggcttcgccgatttcgcggaatgagggagcgaacccctgctcgacgagatgttttttgatggcgccaagcaccttgcgctgacggtcggtcagcgtgctttcatccggacgctcggcatcctttttgggcgtgaatgggacggtgctcacggtgggctcctttcaggtcttaggcaagcataacgcgaaacgccgagaaaatcaaacatctgttcgaggtgtgtctgcaattatcgaacatttgtgccatactcagaacatgcgttcgatagaacagctgttcgagaaggagtggcgtgatggatcgtgtgccgaaggctcatggcgttgatttcaaagtctgggcggatcgactggccgtaatcatgatgctgatggtgctcgcatggtgtttggctggattgatgatgcctgcacgcgcgcagtcagatcccggagcgacgccggtggtggtatataccgtccagccgggcgatacgttgtgggggtacgctgcgcgtattacgcctgatggtggcaatgttgcggatactgtggacgagctggtacgactgaataatctggattcagtatcgcttcgggccggtcaaagacttatcgttcccgacgaggtatgaacccgcgcaagattggcctagttcaatggttcaggctattcttgacaccatgcattgccctttttgtcagaatccagataccaaggtggtcgatacccgcatcagcgatgacggccattccatccgccgtaggcgtgaatgcccgaaatgctccaagcgtttcaccacgctagagaccactatgttgttggtggtgaagcgttccggcaacgttgagcagttcgataggaacaaggtgatttctggtgttcgcaaggcatgccagggccgtccgatcaaggaagacgatttgaaggctcttggccagcaggtcgaagaggatcttcgtgcccgaggactggctcaagtcaaatccgacgaggtcggcagggccattttgaaaccgttgcgtgatcttgatgaggtcgcgtatatgcgattcgccagtgtataccagaattttgagaatcttgaggatttccagaacgcgatcgacgagctgaaggccgatgcgctgaagtaggttcgaacggttgcgaacgcatatgataatgcgtttgttttggctgaaatggacttggtagcgcaaaactgggcgattacggcaaacggcattagggttcatgcattgtgggggttccagccaataagtgattggaacccccacaatgcattcgtatcgtagtggcgtttgccggattgggatcgtcagctgatcacacgcatacggatcgtgccttcgatggctgcgagttcgtccaaagccttctggctggggcgctgggccacatcggtgaccacatagccgatttcgccttcggtgcccagtgcctgtgccgcgatgttgatattctcttctccgagcacacggttcaccttggcaagtacgccaggcaaattcgcgtgaagatgcgcgatgcggaagttcgaacgaatatcagacagtgtgatctgcggaagattcacggacaacatggtggatcccctgaaccaataatcctcaagacgctgtgagacgaactgtccgatggacttctgggcttcaagcgtagacccgccaatatgcggggtcagaatcatattgtcttcatccgcaaggctcgtcaaaaactcgtcgccgctcttcttcggctcgacagggaacacatccactgcggcgcccgaaatgtggccggagtccaaatgcttcttcagagcgtccaaatcagccacaaaaccgcgggaaagattgatgaagatcgaatcctgcttcatatgcgcgaactggtcctcaccgaagaaaccggtattggacttgcggccatcgacatgcagtgtgaccacatcggactgttcgagcagttcgttcagcgtggagcaacgatgggcattgcccatggcaagcttctcttcaatgtcgtagaacaccacgcgcatgccaagtgcctcggcgatgacggaaagctgagatccgatattgccgtagccgatgatgccgagcgtcttgcctcgcacttcatgagagccggaagcagacttgtcccacataccgtgcttcatatgatgggtatgcgcaggaatgcggcgcatcaggcaaatgatgtcgccgataaccagttccaccacggagcgagtgttggaatatggggcattgaacacggcgacgccgtgcttgcccgcatagtcgagatcgacctgattggtgccgatgcagaagcagccgacggccgtgagcgtcggacgtgcgtcgatgactttgctggtcacgctggttttggagcgaatgcccagcagatcaacgtcttccaaggcgtcgatgagttcatcttcgttgagggcgcccctgaggcactcgacttcgaagccgtggtcacgcagtgactgtgccgcgtcaggatgaatattttcaagtaacaatgctttaggcatggttcctaccttatagcttgagcagtttttcgtctgcatttgtccggactataagcagacgttgtgtcggtctggtcatggcgacgtataaatcggctgcggccacaatgcgtgagggggcattctcctcgatgcttcccggctgcaccaccatcactgcgtcgtattccaagcctttcaccatttgcgtggaacaaacggtgacctgttcatcccaagagctctgcgcatcgagacggtcgaactccttcgccgtcaatgtttcgcgaagctgttcgtacacccgcctgcgcaacggcttgaccatatcgtcaggtgcgatgatggccacgcgtccggtgccatcggaggagacgaatgcgcggaccagatcgacggtctgctgtgccacggcatcggcaatcagactgtcgtcggccagagtgaggcgcttgaccgaatccggcacgccacgcaccgcattgacggtggagatgtacaatccctccgttgccgcgaaatcacaggcgagctgcgacacttccttcggattgcggtaattaatcgtcaattcgttgagttgccaattgtggggtccgaacaacggatccatcatacgccgccacgaacgggtgccgcccaatgcggaggtttgcgcaacatcgcccacaatggtgaacgaacgcgacgggcaacggcggatgagcatgcgccaatccatggcggtgagttcctgagcttcatcgacaacgatatgcccatatgtccattcacggtctgcggcggcgcgctgcgcggtgagttccgcgtccatcccgttgatattgtcgaccaacatctgcgaagtgacgatgccggagccgatgccagcttgagccagcgtatcttgcgcgaactgctcctcctcggcgcgcttggcgtccaacgccttttggcgggcgaccgctttggggtcggggccaagcagttccatggcttcatccagcagcggaatatcgctgacggtaaacggcgaccctttggggcgaaccaatgcttcgatatcgcgttcctcaagccatggtgcgaagcgacgaagctgctgcggcttgcagaacagttggtcgataagccattcgccggtcatcggcaaccatgcgagattcaacgtcttgcgcaaggtgtcattcatgcgcaactgctgcatcacatccgtcaactccgcctgctccggctcgtaatcaagcttgtccacataacggttgcgcatggcgatcaacatgctatgcacgaaagtttcgcgtgctttgttgtgctgctgtcgcgtgcgcttggcatcggtgatggcctgttcgatatccgcgcgcacgatgggcactgcgaatccgttgatgcggatcgacggcaatgatgcggggacgcgttctcgtgcggcaacggcattggcgatggctttggacatacgacgttcgcccttcaatttcgcggcgaacgggttgtcatgcgccgtcgcgatcacgccggggatcagatcggcgatggttcggctgaccactccggtctcgccgagggaggggagcacctgatcgatgtaatgcaggaaggttgagctcggtccgaccacgagcacaccggagcgttcgagcattcgccgatgcgtgtagagcagatatgccgcacggtgcagcgccacggcggttttgccggtacccggtccaccctgcaccaccacggcctggttgaggtcggcgcgaataatgcgatcctgctcggcttggatggttgccacgatatcggtcatcttgccggtgcgcttggcgttcaacgatgcgagcagcgcgccttcgccggtcagagtgccgtccgaagacgcctgcccgacctggtcggagtgcacatcgagcacctcgtcttcaacgccgaccacttcacggaagctgagtgtgatatggcggcgcattacgatatcgccatgattggaaggcgtcgcttcgtagaacggacgtgccgcgtcggctcgccaatcggtgaggatcggctcgtggttttcgttggacagtccgatacgcccgatgtatctgtgcgcaccgtggacatcgtcgagtctgccgaacaccaggcgatcttcgacggcacgcagctgggtgaggcgatcctcgtacatggtggcgaaggaatcgcgttcggtgcgttgcgtgggcgatccgtgcgagccggcagcacgcacggtgtcgagacgggcacgagcttgggcccgcagatcatccaagcggccgtacgcgcggctgacggcctgttgttcttcacgcaactgggcggaataactcgacatctgcaatcccttcctcacaaaacttaggcactccaatgtaccccgaggcttctacgaaaaccgacgagggcgagtgcgacatagcgaagcaaggatgaatttacggtagttgatttgatgccattcgttcaatgtggggaaaatcaacctcagcatttgctgattttttccatttatgtggggatttatggtgatgcgtggggtaaagtggggaaagagttttgggtctaggtgttcccgcgcatcatgtaaggaggtgtggcgatggttcaaagcgttgaaaccgagcccttctccgacgatggttcgacgcaagcgagcggtgtgatggctggactgcctccgctgctgttgggaacatacactccaaaaatcgacgccaaaggacgtatggcattgcctgcaaaatttcgcagccagctgggaccgggcatggtgatggcccgtggtcaggagcgatgtgtctatctgttgccccaatcggaatttcgccggatcgcattgcagatccagcgcacatccatgggaaacaaggctgcacgtgattatttgcgtgtgttcctttccggcgcggttaatcaggagccagacaggcaaggacgtgtgctcgtgccgcagatgttgcgcgattacgcgaatttgggaagcgacatcgtggtgattggcgtggggacccgagcggagatttggaacaagcaggcatgggaggaatatctcgccgaacaggagcagggatattccgatattgccgatgacgtattaccggcggtggaattctgatgacagatgtaacgaccatacatcagccagtgttgctgcgcgactgcgtggatctggtggtcccggcgttggcgaggccagggtcgattgcggtggattgcacgcttggtttggcggggcattccacggcttttctcaaagcgagtccgcaagcgcgtctgatcggcatcgatcgagacacggaggcgctttcgctcgccacgcagcgaatgcggatggaaggtcttgccgaccgcttcatacccgtgcacgccgcattcgacgatttcgcgcaagtgcttgatgatcaggggatcgaccaggtaaacgccgtgttcatggatttgggattgtcgagtttgcagattgacgagacggagcggggattctcctattctcacgatgcgcctttggacatgcgtatggacgtgacccagccattgaccgccgaacagatacttgctgaatattcgttcgctgatctggtacgcattttccgtacatatggtgaggaacgcttctccaagcagatagcccgcgaaatcgtgcgtaggcgtgagatcgaaccattgaccacatcggggcagctcaaccgattggtggatgaggttgtgccgcaagcgcaccgtcctgcgggaaatcccgcgaaacgtgtgttccaggcattacgtattgaagtcaacggcgagctcgacaaattggcggggacgctaccgcagatcgccaaccatcttgcggtgggaggacgtttggtggtggagtcgtaccattcgctggaagacaagaccgtcaaaacatttatgaatcaaggtctgaaagctgacgtgcccgcagatatgccggtaatacccccggatatgatgccgttcttcaaagaactgacgcgaggcgccatcaaagcggccgaggaagaaatcgccatgaatccaaggtcggcctctgtgcgactgcgcgcagtggaactgaccagaccaattcctgaacgctggcgaaaacgattcgaccaaggcaatgattacgcaagcatgaaacgacaaggaaggaggggctgaacgtggccgcaccaagaacgatcgcatcaaacgcggctcccgcaggacgccgggaccaaaccgaaaccgctggcaccactcgccctgaattgcacgtcgtcaaaggaacgcgggccgaaggcaacagcgtcaagcgaggattcgaacagctcatcacatggacgcgcaccagaagcactccattgttgcatctggttatcgccgtggtgttcctcggcggatgtcttctgggatccttaacgctgcgtacccaaatggtgcagcattccttcgaggcgaaccagattgagtcgaacattacccgcctgacccaagacgtggaagatgaccaggccaagcttgacgaacttgaagcctcgctgccgagcaaggccgaggaaatgggcatggtgccccaaaaaggcgctctaacgattgatctgaacggctaccagccaagcggagacgacgctcagtgaatccttttcaccgcacttacgcacgtttccacaagaaactgcttacgaaaaccatggccatcggcgtcattctggcgttgatgggcacggcttgccttattcaattggccaacatccagttgatcaatggcaaaaccatggcgcaggccgcggcgcaaagccgcacgattaccgtgactttgaaggcacggcgcggcaaaatcatggacacgaacggctcgattctcgcgcaaagcgtggagcgctacaccatcatcggcaaccccgaggaagcacaggccttcactcccacaacctgcaccaaacagaccggagacaactgccatcagatcgatggcaagccggtaggtgctaccggagctgcggcggtagctagactcctcgctccggtactgggcatggatgctaccgaattgggtgccatgctctcgggaacaggccaatacgcggtgctgaagaaagacgtgacgccggcggttaaacgcaaaatctccaagctcaatttgggcggtatcgtctatgcggaactcagcaacgaacgcatctattccaacggaactctgatgggagcgttgctgggaggcgtcgatggcgaaggcaaaggcgttgccggtatcgaacaaatggaaaacaagacgctgaccggcgaagacggataccaggtctaccaacaaggcaacaacggcgtcgaaatcccaggaaccatgaccgaatcaaaagatgcggtcaacggatccgacgtcaccctgaccatcgatcacgacgtgcagtggtatgtcgaaaaagtactgagagaaagctgtgagaaatacagttcgccatggggaatcgctgtggtacaggacactcaaacaggggatattctcgcgctcgccgacagtgacgagatcgaagccggcagcgatcaggcgaagatgacggtttccagggccgtcagcgaaacgtttgagcccggttccattggcaaggtcttcacaatgtcgggcatgatccagcttggattgcatcaggcgtcagacaaattcaccgtgccggaccatatcacggtgaacgggcagacctacagcgatgcgaccacccacggtgccgaacgctggacccttgctggcattctcgagcaatcgtcgaacgttggcatgatcatcgcaggggagaagatgtctaacgagcagcgatacgatttcatcagaaaattcggtatcggccaagacaataggctcggacttcctggcgaatcggatggtttgctatattcggccgatcaatgggatctgcgaacccagaacaccgtgttgtttggccaggcttacacgaccaatgcgcttcagctgacgaatgcggttgccgtgatcgccaataagggcgtcaagaagccgcagcgcatcatcaaaacgatcagcgatgccgagggacattccgaagagcaaaagcccaagggcgaggcgacgcgcgtgattgacgagcaggtggcctctcaggtgatgaacgccatggaatccgtgtctgaccattactcccagttcatcaaggtggatggttatcgtgtcgcagcaaagtccggtacggcggaagtcgctggtgccgatggcagactgtcgtcgattatcagcgattattcggcgattattcccgcagacaatcctcgctttgtcgtcacggtggtgctgaaggatccgcaaggcgtttttggtggtctgacggcaggtccggttaccgcggagattggtgaattccttatgcagaagtatgaagtgccggcgtcaagtccgcgaactgatgctattccagtaacgtggtgagtatgcaagcatgaagaacggaggggcggaaagatgagcgcggtcagtgagtccatgaacagacgaatgacattgggtctgcttgccagcagatatggctttgacttggatcctacgtttgccactgaagtgacgatcacgtccattgcggacgatatcgattcggtgcggccgggatcgttgttcatgccgtccgcaccggtggatgagcaacagttgcgtcaggctcagacgcttggcgcatatggtgcggtggtgcctcatgcgttgcgtggtaagacggaaggtatacagattcctgtgatctatgccgagccgaccgcacagcagttgggtaggcttgccagcgaaatggcgggtagcccgtccgattcgttggcggtgttcgccgtggcgggaaacgatgcgcaggcggtggaccagggagtgagggatcttgctgatttcctgcatatgcttggtaatccggttggtgtgatcagctcgggcaattcgcaatcgttggaacgatatctcgatctggactatccattatcgattcttgacgtgcagcgtacgatggctgtgtgcgctgaagacggtgctgctgctgtgattctcgctttgagcgatgagacgttgaaagacgacgcattgcagtcggtaagtgtcgatgtgcttggttgcgatgacaatggtctaggcgaagccgagatcgtcaaatcggttgcgcgatttggatgcgctgtcggaaagcgaactcatatcgccgtccgtacgcaggaatccgatgtactcgcatcgcaagcggcagcggcgtacgggcagacgaacagcagcgcattgtcgctgtccatatcgatggtgcttgcggcgggtgtacgcaaggccaatatcaaaagcgcgttgcgcgtatctcgagatctgaactagtttcaatcggaacggatacgtaaagcacacacgataatcgcaaacaacgtgaacagtaaacggaacagcaacacagaggagaaaacacagtgagcagcctgaccatgatgccaatgagcttggaggagatcgcccaggcggttcagggacggctgattgccggaactgcggcagtgaatgtgccggtggccaccagcgcattcaccgattcacggcagatcgttgaaggttcggttttcgtagcgattgccggagagcgtgtggacggtcacgattacgtgccgcacgtgggcgctcaaggtgccgttgccgcaatagtcgaccatgagatcgccgacgccggtgtgcctcagattgtggtggaggatacggtgctggccttgggggcgttggccaagcacaatatcgagcgccgtcgcgcgctggggactccgtttacggtggtcggcatcaccggttccgtcggcaagaccaccaccaaggatcttatgaaggcgttgctggcgcacataggaccgacgattgcgccggtcggatcgttcaacaatgaaatcggactgccgttgacttcgctcaaagtacatgcggaaactcgctttctggttgcggaaatgggtgccaatcatgttggggaaatcgcgaatttgacgtcgctggtgccgccggatattgcggtcgtgttgaaagtcggcgtcgcgcatctaggggaattcggctcgccggaacgcatcgcacaagccaaatcggaaatcatccgtggtcttgttccaggtggtctttccgtactgaacgcgaatgacgagcatgtggctgcgatgagcgccatcgctccgggcgacgtgatgtggttcggacttccgcagaacaatgacggcaagccggcaatcagcgcgcaacatgtgcattgcgacgaattggaccatccgagcttcattttggacaatggtgatggcgagcatgccgaggtcactctgggcatttgcggtcagcataacgttatgaatgcgttggcggctgcttcggtagcgatgcatttgggtatgtcgatggatgaggtcgcgtccgcgttgtctgacgtcacggccatcagtcctcatcgtatggctgtttccacggtgcacaagcctgaaacatcgttcaccttgatcgacgattcgtttaatgccaatcccgattccatgaaggcggggcttgacggattgttgcgttggaaggcgggtgctgagacccaaccgttccgtattgcggtgttgggtgccatgcttgagcttggtccggatgaaaaggatttgcatgctggcatcggccggtatgcggtggaaggcgacgttgacgcgttgctgacggtcggcagcacatccgatgcctctttggacgctctggccggtgccatggctgaaggtgcatccgctgcgggatgtgcttcccatattgattgggtgcacgacattgacgaggccgatcgtctggtgacgcaactcgccgtggaacatccgggcgctgtggtgctgcttaagggctcccacgcttccggcttgagcgctttggccgaacgttggcaggccctggctgcacaatagaacaagaatatttggcaagattcgaataatcgaataaacgacgttatctgaagaatgtctgactgaaacggagaacatcaggtgatttcgctcatcatcggaattgtggtgtcgctggttgtgacgatcgtgggcaccccgctgctgattcgtttggtgcacaagctgaattatgggcaatacatacgtcaggatggtccgaaatcccatctagtcaagcgtggcacgcctacgttgggtggcgtggtcatcaatttggcggttgtgttgggctggggctcgtcggcgctgtaccgcttcgtcacgcggggtgagactccgtcgtggtctgcggtgctggtgctgtttgccatgttgtcgatgggattgcttggttttattgatgatttcgcgaaggttcgtaagaagcagagcgagggattgacggttaagggcaagttcatcggtcagttcattctggctaccatatatgcggtgctggcgttgattctgcctacgaattccggtttccccagtgcccaggccggcatgagcttcattgaggagccgttcttcagtttcgaattcgcgggtaaggtcgtggctatcgtgctgttcgtgatttgggtgaacttcctgatgaccgcgtggaccaatgccatcaatctgactgatggtcttgacggtttggcagctggctcttcgatgattgcgttcatgggatatgcggtgatcgctttttgggagttctaccaccttaagggatcggggcatgagggctttacctacgcggtatctgatccacttgatctgaccattatcgcggcttgcgcggcggtagcatgcttcgggttcctgtggtacaactccaatccggcttcaattttcatgggagataccggttcgttggcgcttggcggcctgttcgctgccatgtccatcgccacgcatacggaattcctcgcgattattctcggcggcctgttcgtcatggaaacgttgagcgatgtcattcaggtcggctatttcaagatgacgcataagcgtgtgttcaagatggctccgatccaccatcatttcgaattgaagggatggcccgaagtcaaggttgtgattcgcttctggatgattgaactgctgttcgtgctggtcgccttggtgcttttctatggcgattgggttgcccgttccggcttgtgacagtcgatgctcggtctgttgccgttgcgaatgaacgcaatatgactgtgatattaaggcgtatgaggttctgacgatcgaaggatgatggatatggatatgagcggtaagaccgcgattgtggcgggtcttggagtttctggccagagcatgatggaggtgttgggttcccgcgccgaaaaggtgttgggcgtggatgagaagaagcctgatgccgatctgcactctttcgaccacattgattgggatcatgtcgacttggtgatgacttctccggtattcaatccgaggaccccgttcattctcgaagcgcaacgtcgtggcattccggtgatgagcgaggtcgagcttgcctggcagctgcgggtggattgcgatgccactgggcatcctgcgcaatggattggcatcaccggtaccaatggcaagacctccactacggaaatgacttcggagatgttgacggcttgcggtttgaccgcacctgctgtcggcaatatcggcaaagcggtgtcccatgccgcagtcgatccggcaaatgatgtgctgtgtgttgagctcagttctttccaattgcatttcaccgattctcttgagttggattgcgcggcgatcaccaatatcgctgacgaccatcttgattggcatggcggtatcgacaattacgcgtccgataaagcgaaggtcttccaccatgccaagaaggcgttggtgtacaacgcggatgatgagcgcgtgaccaagctggcattcgcagccgaaaccgcggaaggctgccgtagggttggattcacattgtcggaaccgcaagatggccagattggcgtgaaggacggctggatcgtcgacatgtccggcatcgcgggcggtgaggcgggcaagcctgaacaggttgccaaagttgccgagttcacacatctgaccgagccggatggcacggtatatccgcatttgctcgccgacgcattgaccgcattggcgttggtgttgggacttggcgcggataaggagaaggcgatcgcatccctgaagcagttcactccaggtggccaccgtatccagaccgtcgccaccgccactacggcggatgggggagccattcgtttcgttgacgactccaaggcgaccaacgcgcatgcggccaaggcctcgctcaatagttttgccgataaatccgtggtgtggattgccggaggactggccaaaggcagcagtttcgagcaattggtggctgatcaggcgcataccatcaaagccgcggtcatcatcggcagggatcagcagccgatgctggatgcgttcaagacgagcgctcccaacattcctctgaccatcatcgatccggcggataatggggtcattatggaacgggcggttgatgccgcgggcgagtatgtccaatccggtgatgtggtgctgatggcgcctgcatgtgcgtcgatggatcagttcaagtcgtatgccgatcgtggaaaccagttcgcacagcaggctcagcgttgggtgaacgagcatggaaaagcctaaaaccaggcaggttgatagtagtcgtcagaaaaagaaggccgccgtcggaaagcaggtcgacgattttcatggttatatcggtctgcgaagcctgcttaatccgatttggtgttttcatgggttcagaaccgcggtgatcattctcaccattttcggtgtgatcatggtgttttccagctcttcggtaaacatgattgccaacggacagtctccgtggtcccaagcactgaaacaggggggattctgcgttcttggacttatcgtgggtgttgcctgcatgatgattccggcggagctcatcaggaaattcagtttcgtcttcctgattatcgctttgcttttgcagtcgctgacgtttacccccttgggtatcgatgtccaaggcaacaaaggttggatcggcctttttggatttaccttccagcccgccgaagtcgttaagcttgcgttgtgcatatggctgccgcgggaactgatctacgcgcagaagcagataaacaaagtcggaccatataaggcatatctcaagttgattgcgtggcttggtcttgcattgctgttggttgtgagtggcaaggatcttggcacggccatgattctgttcgcgatcgcaggtgccgcgttgctgttgggagattttcctggcaaatggttggctatcgtggcatgcggcggtgcggttttggttggcggactcgttatcaccagtccgaaccgactcagccgtatcatggccacataccaaacttgctccgcatccgacatgcagggggtctgctatcaggcggtgcatggcaaatacgccatggcctccggaggtttgcttggagtgggcatcggcaattccggagaaaaatggggatatctgccggaagcgcacaacgatttcattttcgccatcatcggtgaggaaacgggctttgtaggcgcctctctcgtcattctgctgttcttggtgcttggatggtgcatgctcgtggtggctttgcaatcgcaggacaggtacatcactttggtattggccagcattaccgtgtggatcgtcggccaggcattcgtgaacatcggcgttgtggtgggattgtttccggtgatgggtgtgccattgccgtttgtgtctgcgggcggttcgtcgttgattctgtgtttgggcgctgcaggcgtaaccatcagcatgatgaagcagcagccgcagatccaagcggagatgcagcgggtctgagtgtcggctgcgaccgcagcatacgctaccgcgtattgcggtgtgcaaacgtagatgaaatgtgagcatccgcgtgtgcgacggtatggcgcgcggcgtactggggtgccgtgggctaagctcgtacactatgagcaatcagaagcatatcgttcttgccggcggtggtacggcaggtcatgtcaatcctctgctcgccgtggcgcatgtgattcgcgagcttgaaccagacgccgatatcgcagtggtgggcactgtcgtcggcttggaacacgatttggttccccaggccggtttcgaactggaaaccattgagaaggttcctttcccacgcaggcccaatatggcggcgctgaagtttcccgcgcagtggaaggccgaaacggccaaagtccgtgacattctcacccgtcatgaggcgcaggtggttgtcggcttcggcggatacacgtccgctcccgtatatgcggcagcgcacaagatgggcattccgatcgcgatgcatgagcagaatgcccgtgccggaatggccaacaaattgggagctcgctgggcgtccatgattggcaccgcctatgcgcaaaccggcttgaagccacgcaagggtgttgaagccgagcgtgtgggattgccattgcgtgccgaaatcgcagcgatagcccatggcatggaacatgaccgcattgccacaagacaatcggccgcagcgcaactcggtgtcgatccgaaccgtccactggtggtggtgactggagggtcgctgggcgcggtgaacgtgaaccgtgcggtggcggcttccgctagggagctgctggaacacgcccaggtgattcatctgactgggaaaggcaaagatgatgaagtgcgttcattggtgtcggtgagcgccggcgaacaggtgcttggcgagcttggcccggaccatggcaatgatggcgattatcgtgttgcgccgtatttggaacgtattgatctcgcattcgcttgcgccgacctgattatctgtcgctctggggccggcaccgtatcggaattgacggctttgggactccccgcgatttatgttccgctgccaatcggcaacggcgagcagcgattcaacgcccagcctgtcgtcgatgcggaaggcggtctgatggtggctgatcgcgaattcaccgccgaatgggtcaaacagcatgtgccgaagctgcttgccgattcggatctgcttgccaagtatggcgacaacgcctggcaatacggtattcgagatgccgccgaagtcatggccaagcgcgtgctttccatgattgacgaaaagtaggctgcggcgatggcaggtgcgttcgtcgcattccaaaatcccacccatgatcggccatatgcgagaccatgggtgagaccataatggaacaagctagaaaaaacatgcaagaggagcagtcgtgtctgacaaccagcgtgaagccggtaccatcgttcttgatccaacccatgcgtcgttcagtccgcaggaaggcgtgaatgatttgggggcaacccatttcatcggcattggaggcgcgggcatgagcgtgctcgctgaaatgctgcacgaacagggcgttgaagtggacggttcagatcgtgaacccagcgccaaaaccgatcgtctgcagggaatcggcattaccgtcgaattcgggcagcgcgcagaaaacgtcgaaggcaaacataccgtcgtattctccagcgccatcaaatccgacaatccggaaatcgtcgcagcatacgaagcaggcgaacgcatcgtgcaccgcagcgacattctcgcattgctgatgaacgcaaaacgtgcggtgacggtcgcaggagctcatggcaaaaccacgaccagttccatgctggcccatatcctcacccatgccggtgagggaaatctggccgatccaagctatgccatcggcggatccatccaaggcaaggatggtgtgacgcttgacggaggccatgctggtaagggcgacgttcttgtggcggaagcggacgaatccgatggcagctttgccaagtatcatccggaaatcgccattgtcaccaactccgaagccgatcatctcgaccattacggcacacaggaaaactatcgtgcggcttttgtcaatcatgttcagcatgccgaaaaatcggtggtgatgtgcggcgatgatgaaggcaatcttgcggtattgcgtgctctcgacccgcagacggccaagcgtacggtcgtgtatgcgacgcaggatacggtttcgttgggtgatttgaacggtgccgcgttcgtgcatatcgaatcggaaagcgaaagcgcgcaaagcggcgccgaacatttcaccttgcacatgcccgcgggattgttgggcgaacatgagcgtatggttccggtgacgcttaccgttccaggcattcacaacgcgcgcaatgcctccgctgcgattattgcggccgcgttgttgggcgtcgatgtcgagaacgctgcccaagccgccacgtcgttccttggagctgcccgtcgtttccaagtgcgtggtatggtcggccaagtgactgtcgttgatgattacgcgcatcatcctacggagatttcggcattgctggatgcggcgcgccgcaggtacccgcagtcggtgattcgcgtgatcttccagccgcacctgttctcccggaccatgttctttgcgagtgaattcgctgaagcattggccaaggcggatgatgtgatcgtcaccggcattttccccgcacgtgaaaagcaggaggactatccgacgattagctccgccaccattgtggacgaggcgcttaagcttgaccacacgcctgccgaggattggattcgcggagtggaggatatgcataccgcggcacagatgatgacgatgcgtgctcatcatggcgatgtcatcttcactgttggcgcaggcgacatcacacagatggacgaggtgatgctgcactcccttcaggctcatcgttgggattgtgagggctgatgacgcgaagggtcatcagttcgggtacgggttcggatggttccgcaacgacgcctgaaaatcagacgtcgcatggtagaaccatccaaagccggaaacacagcgatgccggaaagcaggttcagccgaaaggccgttccgtcgctggtggagcgggacgcgcgtcttcttccgggaagaagacgcaggaaaatacggttgagagtggcaacaaaggcagcgtgagccgttcgagatcaggcgatttcgtggacgcgcgcaatcttgccggcgaggatttcgtttcgaagacattggaggaaaccataggcacgttgggcgtggtaacgcgcccgaaggtggttgatttcagtgcgcgtctgaaagaacgacgcaaggcgaacgcgcgtgtcgtcgccatgcgcgcgtgcgtttccgctgctgtcattgttgttgcaggcgcgttggtatggctgtttttcttctcatcggtattccgtctcgagtccggcaatattagcgttgtcggcgccaacgaatgggtgagtgagtctcaggtgttggatattgcgggccagcaagcaggaaaatcgattcttctcgtgtcgaacaatgacgtggaaaagaaaatcaaggagattccgggagtcacttccgcgcaatccaagaaaaaactgcccgactcccttgaagtgaccatcaaggcgcaaaagcctgctgcgatgctcaagacaggcaaggacagcatgaccgcggtcgacagcaaggggcgtatattgaattccgtcagcggagcttccgtggaaggaattcccgtcattgaagtgaaggatgtcgaaacaagtctgagcaatcgttccatcaaggaggcgttgaagatcctcagctcattgccggaatcgatgcgcaactccatcaccaaggtgactgccgaaacccaggattccatcaccacggaaatcaatgggggagaccgtgtgatcgtatggggcgattcatccggcctcaagttgaagaaagctgtcgtcgataaaatcatcaatgatccgaatgtgatcggagacaagcataacgtcgacgtgtctgcgccgttgcgtccaatcatcaaatagtcgcgttgatatacgaagaaccccggttgccttgcggtaccggggttcttcgcgaataggaggagagaaggagaagttcgattattggaggccgtcaggcgttcggattggccttcaacgcaggagcgacggagaccgcgggatcgagacgcggaatcagcgtgcactgcgtggcatggtacaggtcggacttgcccggccagacggtaccgatgacctcgttgtctttgttcagctggtggaaccaagaaccgttcttatggtcgatcaggtattcgtcaatgtacttccagaaggtcgcataccaatccttgtacacctgcttgccggtgacggtggccagtgtggccgaggtgttcacggattcggcaagcgtccagtgcatgcggtcggtgacaacgggcttgccgttccaatcggtggtgtaagccaaaccgatggtgccttcggcgttccaggcgtcggcaagtgcctgagcgaacaggttctcggcggcttcgataagctgctgcttgccttcttcggaacgctgcttggagctcaacgcatactgggtgatgagacgtgcccactcgatgccatggcccggagtggcgccgtacggcttgaactggtcatccggcttgtcatggttgcattcgagatccggctgccaatcggcggtgaaatgctcaggaatacgccagttattgttggccgcccatccgaccacatgatcgatgatacgaccagcgcgctcgcggtattcctcgtttccggtcacatcggcaacggcaaggaatgcttcggtggtgtgcatattggcattgatgccgcgataggagtcaagctcggtgaattccgtgttccaagtatcgacggccagaccgatctcgtcatcccagaaatgcttgtcgtaggttgccagagcctcttcgagcagctcgtccgcgtccgggcggccgataagcttggcggaagtggcggcaagaatcacgaaagcgtgggcgtagcagaccttgcctgcttcatgggtggagccgtctgcggaaatggacggataccatccgccgttttcatcgtcatgcagcggaccgcgcaggccggcgatggccttgtcaaccagttctgcggcgcccggctcgccgtgcaggaaccccaaggaatacacgtgcgccatgcggcaggtgatccacgtgtggatgttttgggtcagatccggattgccggtatcgtccagccagtaggagccaccctgcggggcggggaaattgtgtccgaaatgcaggagctcgttggtttccgcctcgagcagggcatggttttcttcggagccgaacacgtaggcttcgggagagtaagtgcaggtcatcgatcaagtccttccttgacgtcgtctactgtgacgtgataactaggttgatgtattaactatgttaatcacttaagcggttaatgcaagtcgacacgcggaatttgatggtgggattctgatgatttgtgatgggggagagctggattcttcgtatgttgatttgacgaggttgtcttgtgaagaggagtacctaaaaacgtaccttgcatgctgtttagggtggtagacagatggaatttggaagagattaagcaagccggaggagggatttttgcccacatttttttagaacatccggcatatcgggggtaatttggagtaaacccaggaatcttcgaaaaccgttggaaatacaagaaaagccgccatttctggcggctttcaatccgtggagatgcggggaattgaaccccggtccgataaccgaaccctcagtcttctacgtgcgtagtctgctggccgtgcggcggtttttctgctcccatcgatatcgcagacaactgatggcgggcatatctacagtaaaagtcccttgccggccctgtggctcagtcgacaaagcaagtcttctaaacgacgctcagcatccttccaaagacgagaaggagtgaacggagcggctgctcactggttaatcctggcgcgaagctcaggcagcgagagcgaactcagtgcggttagatttagcacttattcttttgtagggggcatccacgagcggaccctacgttctcggcacgcttccctgcgacgaacaggtcaccgtcgaaaccgatcatccccaatcttgaattatcaagcacccggtgcaagaccggacttttcaagatatcatggaatgtcaataagtgcaaatcatctaccgtaattcttgcgctgtgagcgaagccaaagcttaaactgatagccactcacagcttgacgtgaataccgaaataatccatgaccaattcacagaacatcatattggcccagctgaaccacggacgggtataggagttcgggtcgttcgcgtcaaagctttcatgcatgagatgcgtgccggcgtcggcggcgacaagttgatcaagaatacgttctttttcggctttgtcgtggcttgtcaatccttgcatggccatggcgatcggccaaacataaccttctggcgtatgcggagaaccgatggcatgtgcatagtcaccctcgaaatagtaaggattctcctgactcagcaaagtattgcgcgtttcgagatacagcggatcgtccgcttcgcagaatccgagataaggtgccgacataagattcggcacattgctgtcatccataagcaacgcgttgccgagaccgtccacttcgtatgcgtagatagcgtttccggccgcattgcggatggttgcgtgatgggcaagaccatcatcgatggaatgctgcagcgccgcggcacgaccggcgatttcacgatcgtcaagcacgtcgatgaaaatcctttgcacatatcccatgaccacgctggcgaacatgttggacggcacgagatatgggtagacgcaggcgtcgtcgctggggcggaatccggaccatgtcatgccggtgacggcaaaaggtcctccggcaccatggttgggcacgctgtcgcgcggatcgtcgttcggacggaagaagcggtaatgcgaattcgaatggtcaagctcggtttcgaacacgtcaaggattcgacggatgccgcttacaaacgcatcatcgaaatggctggtggttcctgtattgcgatacaacagccacgccagctgaatggggtagcacagggagtccacctcgtatttgcgttcccacaaccatggttcgaacgaatcggtctgatcgttcggatcccaggtagcgccgctgggtgtttcgttgaacgcgtttgcgtatggatcgatattgatgaacctgaattgctgccgaacaagcccggtaataagcgcggtgagctcgggatcatctatggctacggcgagatatggtcggaattgcgctgaggagtcgcgcagccacatggcaggtatgtctcccgtcagcagaaacgtcgtgccgtcatcatgccgtctcacggtggtggtgagtgtattggcgaatcctgcgttgaagttttcggcccatcttgcgtgttcgccgccacacaagtcggtgatatgccgcatgaaatcggaaactgactgcggaatatcggattgtgaagcggcgtttgtggtgttgctggtgtcgttcatggcatcattcttcgttgaggtgcgtatatcgtgacaatcgtgattgcaccaattgcggattgaatatgggtatgaaaaacgaggccatgatggcagacatggcctcgttgatgatgatgatgaaaggaaaatctgggcttacttgccggcttcggcgagataatccgggacgccttccgcagggtaggttggccagccgccttccttggtgcacacgtaggcggcggtgttcacagccgcacgatgcgcttccttgagcggtgcgccgctcagcagcttgccggtgaaggaaccggagaaggagtcgcctgcaccaacggtatcggcaacctcgacgtgaggggtcagcagcgtggaaacctcgccattcttggcggtgatggtgctgaacgtggcgccgccggtcagaatgatgtactcaaggtcgaagcggtcgatgaaccacttgcatgcctcttcgtcgttgcactcaggaatggagaacatgtcgcgcatcatgatcagctcttcgtcgttgatcttgaagatgttcgcatagccgagcagttcttcgatgagttcgttggagtagaagttcgcacgcaggttgatgtcgaagaacttcagagcgccttccttggtgtgcttgagcagttcgacgatggtgtcgtgggattcgggggagcgcagacccaaggtgccgaagcagacggcgtcggccttggacacggcttcgacgagctcgtcggtgagcttgatgtggtcccaggccacgttttcgacgatggtgtattccggaatgccgttggtcagggccacgtcaaccgtgccggtcgggtattcgttggtctgcaccagcgtgttgatgccggccttgtgagcgtcggagagcagttcggtacccagctcgtcgttgccgacggcgctgatggcgaagcttttcgcgccgttctgggacgcatggtatgcgaaattgacgggtgcgccgccggcacgcttgccggtggggagcatatcccacaggatttcgccgagagaaatgacgattggcttggacatggtgttcctttctttggttgtggcgtgctatgcgacgtcaaagaacatcgaaggatgttccagaaaattggtgatggccacggccgcggcaccgctgacggtggcgtccgttgggaggttggacaaggtgattttggtatcgtgcccgacttcggggatggtacgttcccgaacgacttttttgacctcgtcaagcaagggctgtccggcttgggagatgatgtcgccgagtacgatatgcgtcggattgaaggcgttgatgatattgaccgcgccatatccgatatatcgagcgacctcggaagtcagatccatggccgctttgtctcctgccgcagctttggcgaacagcgcggtgcatgcctgcgcgtgcgtcattgcctcgcatccgggcacaatgctcggctgttcgttgagccgttcgtggattgcgttggctgagcagtaacgctccaggcacccgatattgccgcagtcgcaaggcttgccgttgacgtcaacggagatgtgtccgatttcggtggccgtgccgtgcgcgccgtaatagatcgaaccattgtcgatgatgccgaggccgatgccctcgccaagcagatagtaggcgagcgatccctcggacagttccgggttgaacaggaactgcgccaaggcgcctgcgcgtgcgtcctgttcaacgaatacgggtacgttgaacgcttcgctgaactccttgatgaagttgacctgccgccaaccctgcatggatgagacgagcgcggtgcgaccttcctccaccagatacggaccaggaacggccatgccgacggctacgatgctcgaatcgtccgcaatgagctgtcgtacggtggcccggatctgttctaccgtttcgggaatatgctcctcgtcaacggtgggcaggtcggtgagggaaatacgattgcatttcaggtcgaacactgcgatctgcaccagacttcgtgcgaatttcacgccgacgacatggtatttcgcgcaattgagattcaggccgatggaacgacgattcttatcgccttccatgtctccggtttcttcgataacgtctcggaacagtagttttgcggtaattttcgtaatggccgcgggtgtgagttcgatggctttggcgatttgcgcacgtgagctgatgccgttgtggtagaggtattgcagaattctggaacgattgttttctgaaatcgatgattgctgagcgctgtaactactcatgacacctccttgcgccagtgcacggacccttcgttgaactagttgatatattaacgccgttaattagttgatgcaagttccgtctttcggcgtgtcacgaggaccgtcgattctcaatatgggattcgctgtctcattatttgacacacacttttcggaaaaaaattaactgcaaaaccgttgtgattgctgagttttcgttggatcgagaaagggtgacgtcgcaaaatgagcttccgtgaaatgtttcgctaacaaagtgtgccctacccttgtggcacgtcgttttggagtaccaattacgacagcaggaagagaaaggattccatagtgaatcacaagaagattatggctgcggctgtctcgattgccgcactggcctcgctcgcggcatgcggcggcgtaaaggatagcggttccgcatcgggggatgcggatgtcattaccgtcggcaccacggacaaggttactagcgttgaccctgccggctcctatgacaacggttcctatgccgttcaaatcaacgtgttcccgttcctgtatgcgcaggactacaacacctctgaactgtctccggacatcgctgcggatgacggtacctggagtgacgacggcactgagttcaccgttaagatcaagtctggcctgaagttcgccaatggtcacgacctgacttcgtccgatatcaagttctccttcgaccgtgtcaacacgatcaacgatgagaatggtccgagttcgttgctggccaacatcgaatccatcgatacgccagatgacaccactgtggtgttccattccaaagtcaagaacgatgtgaccctcaagcaggtgctttccagcccggccggtccgattgtcgacgaagaggtcttctccgccgacaagctcactgatgctgacaccatcatcaaggagaaggctttcgccggtccgtacattctgacctcctacaaggccaatgaggttgcaggctactccaagaacgactcttatcagggtctgaccccggccaagaacagcactgttcaggtcaagtactttgccgattcttccaacctgaagatggccgtgcagcagggacaggtcgacgtggcctaccgttctctgactccgaccgacatcgatgatctgtccaaggactccaaggtcaaggtcgtcaagggtccgggcggtgaggaacgcttcctggtcttcaacttcaacatccagccgtacggcaccaagtccgatgaaccgaatgccgacaaggccaaggctgtgcgtcaggccgttgctaacctcatcgaccgcgaggagttggcgaccaaggtctataaggacacgtacaccccgatgtactcctacattccggacggtttagttggtcacgaagacaccttcaagactgcgtatggtgacggcaacggcaagccgagcgccgacaaggccaagaaggttcttgaggacgcaggcgtttccactccggttgagctcaagctgcagtacaatccggaccactatggatcctcttccgccgacgagtatgcggctctcaaggctcagctcgaggagggtggtctgttcaaggtcgacctgcagtccaccgaatggacccagtacaacaaagaccgtgttgttaccgaggactctgatggatcctacccggtctaccagctcggctggttcccggattactccgacccggataactatctgtctccgttcttccgtgacggcaacttcgtgaacaacgcttactccaactccgaaatcaacgatttgattatggagcaggctggtgaaaccgacgaaagcgcccgtgaggatctgctcaagaagattcagacccttgaaaccgaagacctgtccaccatcccgctgctgcagggtgcgcaggttgcagttaccggcgccaacgtgaagggtgttgtgctcgacgcttccttccgtttccgtttcgcatctgtcaccaaggcgtgatgtgtgcggatgtgcggcatgacctgccgcagcctgcatagaaaaccactggggatccccggtctatggccggaggtccccatttcccgaattatctgcctgaaacggcgcagtgattcgatattgttgtaaatcaaagccgtacaggcttcttatcaaggagcatcgcgtgtcagacacagcagctccggccgtctctcaggaggcgaagccgaaacaagccaaaaagaatcatttgtcaggcggatttttccgtttcgtcctgactcgattcctgctcattattccaaccgttttcattctcgtcaccgtcgtgttttttgtgatgcgagctacaggcgatcctatttctgcggcattgggtggtcgtcttacccctgacgagttgcaaaagcgtgttcatgcggccggctacgaccgtcctcttattgtgcaatatatcgattaccttgggggtttgctccatggggatctcggcactacgttgactgataatcagccggttatcagcattcttgttcattacggatcagcgactttcgagttggcgctcctatcgctcattgttgctttgatcgtaggtatcggcttaggtcgtgtagctgcgtgcagacgcgatcacgctgccgatgcaggcattcgaacctttgccattctgtgctacgccacccccgtgttcttcttgggattggtcctgaaactcattttcgccatctggctgaacgtgttgccggcatccggtcgatgctcgttgtcttcggaaatgcagttcacccgactcgtctctccgaccggcttctacattatcgatgcactgcagctgggtgatatgagcgtgctggccgacgtgttgcgtcacgccgtacttcctgcgctggcgttgggattgctcaccgcaggcgtgtttattcgtttggtgcgcaccaatgtgatttccacctacaattccggctatgtcgaggctgcgcgttcgcgtggcgtcgccgaaaaacgtctgctcagcaagcacgcatggaggccggcgcttattccaatcatcaccgttatgggcatgcagatcgcattgatgctcgccggcgcggtgcttaccgaaaccaccttcgaatggaagggactcggattcatgttgtcccaatatctgaaagcgcgtgacttcgtagctgtgcagggcattgtgattctgatcgccatcatcgtggccgtcgtcaacttcatcgttgacgttatcgccgcgttggtggatccgagagtgaggtactgacatgactgcatcagcaaataacgtcaccgtcccgggtgacactcgtctgaacgatctcaaagtcaacaggaaagctccgttctgggccaagattccgatcatcaaggagcttcgcgtagcggtcggctggcagaaaggcatgctgattaccggcctgttgctcacggcgttcttcctgctcgtggccttgttcgcgcccgtaattgcaccgtacggctatgcgcagctcaaagatgccaatggagtttcattcccggcccaggcagcaccctcatccgagcatatttggggtaccaccgcaggtggttatgacgtgttcagccgtgtgatttggggctctcgtaccgcggtcattgcgattgtgatcgctgtgctgctttctattttcgcgggtgtattgctcggtttggtttccggatatttcggtggttgggtggatcgtgtgcttgtcatgatcgccgacgccatctactctttcccctcgctgctgcttgcgattctgatggccattatgatttccggcggtcagtctggtctgtggagtggcattctcgcttcgggtatctccatcaccgtggtctatattccgcagtatttccgtaccattcgatccgaggtcattcgaatcaaggaatccgcttacgttgattccgctcgcgtggtgggcgcgtcgacatggcgcatcatgaccaagcaccttcttaagaactccaccagaacgttaccggttattctgacgttgaactcgtccgaagcgattctgactcttgcgggattgggcttcctcggattcggcatcgaacctaccgcagccgctgaatggggttacgatctgaatcgttccgtgtcggatgtaaccgcgggcatttggtggaccgcagtgttcccaggtatcgccatcgtattgattgttctgggtatcaccttggtgggcgaatccctcaatgaccttgccgacccgcgtctgcgtgcacgcaaatccgctggtgaggtggttggatccatcgaagatacttcggttgatcccagccagaagccgggcgttcgcaacgaggtgatagccgagctcgcggccgccaagaatccaatgggagccagcgatcagccagtgaccgttacggatcgcgacccgtcatttaccgcctccgaatggggctccaaggaagaagagtgacgcaatgagtgacgaacaaaccaatcttgcgcaagtcaaggatctgagcgtttccttcatgaccgacgcaggatccatcaaagccatcgacaagattagcttcaccatcccacgcaaaaccgtggtgggtgtggttggcgaatcaggttccggaaaatccgtgaccgcacgttcgattatcaagctgttgccggagacggcaaccacttccggcatgatttatctgtcgaaccgtgaaggcaatgagcagcttgacgtactgtctctttccggagaagatctgcgccgtatgcgaggatcagaagcggccatggtgttccaggaacctaattcggtacttaatccggtgtataccatcggatggcaaatcgaagagggacttcgcgctcacggcatgaaagacaagaaggagcttcgtgccaagtccgtggatatcctcaaaaaagtaggcattcctgatgccgaaactcgaattgactactatccgcatcagttctcgggcggccaaaaacaacgtatcgtcatcgccatggcgttggtgctcaatccaggtctgattctggctgacgaaccgactaccgcactcgacgtgaccgtgcaggcagaaattcttgacttgttgcgtcttgcccgcgacgaattcggcgcttccgtgctgattatcacccataatatgggtgtgatcgccgatatcgccgatgaagtggtggtcatgtatcgaggtcatgtggtcgagcagggaagcgtcgaacagatcttctactcgccgaaagacgattacaccaagcggttgctcgcggccgtgccgcgtatcgggcagaaactggtcgttcgtgatgagcagggcaaggtgattgaacgcagcaaggattggcatgaccaacccattgccgtcgaggccaggggactgactatcacctatcctgggcatttgacgcagcctgatttcaaggcggtcaatggtattgatttcactattcaccgttccgaagtgctgggattggtcggcgaatccggttccggcaaatccactaccggtcgtgccatcgctggtttgcagaaagtgtccggcggctccctgaacgtgttgggtgtggaaatgaacggtgtcaaggaacgtcaattcaaacccaagcgtgctgatattggttttgtgttccaagatccgggtagttcattcaatccgctgatgaccatcgcggagaatgtggcagaaccgctgatcgtgcataaaaagtactcgtctgtgtcggaagcgagcgactatgtgggagatctgctcgaaatggtgcagttgccgcgtgcatatatgaaccggttcccgcatgagctttccggcggtcagcgtcagcgtgcctccttggcacgagcgctggcgcttaagccgagcctgctgatcgccgacgagccgacttctgcattggatgtgtcggtacaggcgaaggtgttggagctgttcaagaaactgcaggcggaaataggtttcgcatgcttgttcatcacccatgatcttgccgtggtcgatatgctggccgatcgcattatggtgatgcataagggcgagattgtggaacatggtgatgccgatcaggttatgaataacccgcagaatccctacacgcagaagttgttggcatcgctgccggtgcctgatccgcgtgaacagcgaaaacatcgcgcccagctgcacgagttgctcgccaaaggaatttgattccgaagtgagtttcgtggcttcctgacatacacaagagctggtgtgacggttcatgatcgtcacaccagctcctagtttatatattcaattgtgactgtattcagcgaatcgcaccgttgaaggagaattgcgcgtgtgcgtcgccgttcgccttgttcttgaggtactcacgcacgtagcccatgcgttccactgtggtgtcggccaggggctgaggcaggtcatcaggggagaaccaacccacgttgaggctttcctcgtcacctacgaacggttcggcattaccattcggatcgggcttgcacacgaacaggtgatccatatacatggtgttgtcgccgttcgcatacgtaagcaccttgcgggaagacttcaccgacaccaaatcggtgacgataacatccacgccagtctcttccttgacctcacgcgccaccgtgtcggcaggttcctcgccaggctcattaatgccatacaccatggcccactcgccggtatcggaacgcctgccaagcagcacacgaccttgctcgtcttcaacatagccggagacgcccatcagccacaggagatcgtgaccgactttcttgcgtaactcgagaatgaattcaggcgttggcatatcaggcctttgcaccttcggcagccatgctggccatccactcttcgacctcatcgatctgctttggaatgccggcggaaatccattccggaccatcctcagtcatcagtacatcatcctcaacgcgaatgccgatgccgcgatactccggcggaatcaacagatcatcctcacggaaatacagacccggctcaatcgtgaaaatcatgccaggacgaatcgcagcaccctgatacgactcataacgtgcctgagcgcaatcatgcacatccaaaccaagatgatgggccacaccacaggcgagccaacggcgatgctgctgtccttccggagaaagcgactcctcgacatcgaccggaagaatgccccaatcatgcagacgctcggcgatcacacgcatgcacgcatgatgaatgtcggaatacgtggcacccggcttggcagcttcaaaaccagcctgctgggagtccaaaaccgcctgatacagctttttctggaaatcagtgaacttcccgttggtcgggaacgtgcgcgtgatatcggccgtatacaagctattgacttccacaccggcatcaattagcagcagatcgccggactccacggtaccggtgttacgcatccaatgcagaatcggcgcatgagcgccggaagcgatgatcgtatcgtagccgacctcattgccttcctcacgggaaatggcattgaacgcgccttccagcatacgttccgaacgaggtttgtcgagcgacgacggcagcttgcgcagaatgttgtcgaaaccatgcttggttgcggcaacggccttgcgcatttcacgaatctcatattcgtccttgcacatgcgagcctcggcggcaaactcatgaagcttgtcatcggcatgcgtattgccatccggatctgcgaaaccgttcgcctcgcgaatatcctccaccatttcggtgatctgcggatcagcctcgcgaatcacacgcacacgcacggcaccggcttccgcgccgacatccttgctcaacgcgtcagccaactgcgcgatgtcattggtctcaataccggtcattgcagtcatctcctgcaagccggcacgaggaccaacccaatattcgccataatgggcgttcatgaaaaagtcctgcgtgtaatggttcgcacgcggagccacgaacaattccggcacatgcgtcttgccggccgcagcctccggagaatcaggatcaaccggattcaacaccagcacggcaccggcttcgtagtcttcgcccaaaccggtgtaatacgaaaacgtcgtatccggacggaacgcataatcgcagtcgttgttgcgcaccttcggctgaccggccgggatcacaatacgctctccgggaaaagccttacccagcgtgtcaagacgagcctgaatgtaatgggaagactccaacggttcaataaccggctcattatcatcccaaccggtggtcatgaactccttgaacgcctcggaacgcgggcgcagcgaacgattgttcacacggtcgctcatcgcctgatcagggccgggagcgctggactgctccatggcttcatactccttgtctttatcggtaatgacttcgttcatcacatctcctgaatatggttatccatgcttacgcaattaccgcaaaccatcctataactttttgcgccgcgcaacgttcatgcaagcacatagaataagggagattgagtgagcaatcccaaggtaggggaggaatccgaaagaatatgtcattcgaacatccgaatcgcaacaatgaaagcatgatcgacgtcgaacgcgacatcatgagccgcccatcagagcgcaataccaccaatcttgacctgcaacgcatgaagatgatcctcgacatcatgggacatcccgagcagtcgttccgtgtgattcacatcaccggaaccaacggcaaaggatctaccgcgcgcatggccgaggcgatctgccgtgcctacggcatgcgaaccggtttgtacacgtcaccgcatcttgaacatgtcaacgagcgcatcgccatcgatggacagcagctttccgacgacgatttcgttgatacctgggatcaaatcaaagaccttgtagccatggtcgacatgaagatggaagaactcgacaagccaaaaatgagcttcttcgaagtgctcaccgccatggccatctggaagttcgccgacgctccggtcgatgtggccatcgtggaggtcggtatgggcggccgctgggatgccaccaacgtgctcgatgccgatgcggccattatcggaccgatcgacatggatcatatggcatggcttggcaataccgtggaacagatcgcatccgaaaaagtcggcattatcaagccgggctgcaccgcggtcatcgggcatcaaccgcatgaagaggccgtcatgccgattatcgaggaagcggcgaggcagaaccatgccaatctggtgagggatggcatcgaagcggaagttgtgactcgtattccggcagtcggcggtcaggttgcgaccctgcgtacgccgaatggcacgtacgcggaagtgccgatcgccaaattcggcgagcatcaggcccataacgcgctcgcggccttgtgcgcggcggaagtggtgattcccgtcaacggtgcgcttgacggtgatcttgtggctgaggcgttgagcacggtgaggattccaggccgcatcgagcagattcgtacatcgccaacgatcattctggatggcgggcataatgtgaatgcggcagaatcgttgcgtgccgcgattgaggaaaattacgatttccagcaactcgtcggcgtgatcgccatgatgggagacaagcaggtcgaagagtatttgggcgtgctcgaaccattactgagccatgtggttgtcactgaaaactcgtggcgtgatcgtgtgatgcccgcggaagacctgaaaacggttgctgaacgcgtgtttggtgcggaaagggttacgtgtgttcctgaactgccggatgccattcaggaggctgttaatatggttgacgccgatgatgagcttggtgttggctatggtcacggtgtgctgatttgcggtagcttcaccacggctggcgatgcgcgtctcatgctggaagagaaagtcaatcccgatttgaagaagccgaagtcggaacgtgtcttccaggaggctgttgagccggaaccgcgtaaggatcaggacgaggcggatctcgatttcgaatccgacgccaatcctgatttcgatatcaacgatttcggcagtgtcggtccggaacttcccgatgatgaagatactgatgcttccgaagttgagcatgcgcatactgcatcttctgaagatatgcggtaatcgcatatatgcatggcaatgatggatcgtcggttgttgctgacgatccatcgatccaacgatctgtaatgcaatgcaaaggaggatgcagcgatatcgattcgctgcatcctccttcgtacgatattttgcactaaccgtctgaggtgcgattattacttgcgcagtttgcgacgcagcgactgcagcagcgtgagcgaacggtagaacgccttcttgaccggaatatcgcgaccggccgaaacctgtacgatattctcggagaatttcgtcttgaatccgttcagactcttcaatgaaggcgcgaaatcgttgccgatacccatcaaatcgagaacagtgcagccctgctctccaagtgcgcaacatacaacgtaaatcagtttgtcgggaacatgctggcgcatgacttccgtacgcatgcaagcatagtaatagaccgcgtgatcgccactgatggtgatgatggaccatgccacaaccttgccgtcgatacgtgccgcgaacacgcgcgcatgatcaggaccaagattgctgatcatatcgacatagtcgctcatcggagcgggggagaatccgtcacggttggcggtgtcaaccatgacctcgtagtattcggaaaaatcagccatcgcctgcgcggtctcatcggcgcaaacggcggggctctccctcaacgccttacgcacgtcgcggcggccacgcttcttcatacgtgtaagaatcgcctcatcgccaccggtgatgtccacatacacggtctcgttgtaaggaacggtggaaagcaccgggaacgagccctcgaaattccacaagtcgatacgcaggaacacaacgtttttatcgcgtttgcgtacgtcctcaacaagcaggtcacgaacctgtgcttccagctgcgcggaaggcttgtcaagccaagccggaccatgaacggacctcaaatagtggtagccatgggtttcgtaatcgatgagtgcgatgaatgcgattggagcgccgtcctgcttcaccacatacgcaccccacggcgtacgtccgtcaatggtgttctggtatttggcccacactgcggtctgttcgatgggcagggtaagacccgcctgcacagcctgctgttccatggtgactgcgtcggtgaattcaagagtgatcatgattgttggattgttccttatggttggtgattactcgatgatggttggctgttgctgcaggtcaggcaagtccaaaaatacgtttcacaatgtggtcgtcgccttcgaagggaatatgactgccgtggtctttgaaccagcgctcgttgcctttgccgatgataaggatgatatggaggcggttgggattcttgcggtcaattgctacggtcgactccaccgctttcgtacggtcgagaatgatcctcgcatccagatcgggattggtgacactgtcgagcatgtcttggcagacgtgttccacaggctcgtcatccgtgtcttcgaaggtgagaatcagatggttgacgcggttctgcgcggccctgacgatttccgatctgcgatcgtacgctttattgcctgcggatccagtgaccagcgtgacttcaggatcgtccttgccgtagcgttggtcgacatagtcgagcaacgccgttacggaagcataattgtgcgcataatcgacgatggcgatggtgttcgacttcgtatcgtggaaatgctccatacgaccggcgatacgtaccggttccatattgcgcagcgcttccttcgcggtggtctcgtggaaatcgaatccaacggcatgcgcaatggcaatggctgcggcggcattcgcataattgaaatcaccatccaactgcaggctgatcgagccgatctgctcaccttccaccgcaatggcgaatcggctatggtcggcggattccggccatgcgatcacatccgcggccgatgcttcgccaagagcgaacgcggtgacgggaatatcggcgattgcagcatcctgacgaataagatcggcatgtgcgcatgccgtgccgagaaccaaggaacggcaattcttcacaatctgacgtttgcagtggaagtaatcctcgaatgtcggatgctcgatggggctgatatggtccgggctgatattgaggaatgcggcgacgtcgaaggtaattccgaaaacacgatcaactttgtaggcctgcgacgaaacctccataaccaggtattccatgccgttatcagcggcttcgcgcatcatacggaacgcatccatggactccggggtggtcaaatcggactcgacataggtatgtccgtcaaggcaattatcgacggaggagaacaatgcgcatttgccgccggagcagccgttgagcatggcttgggtgaggtaggcggtagtggtttttcccttggttccggtaatgccgacgactttcagctggccctgcgggtgcccatagaatgccgcggacagcagactcatggctttgcgcgcgtcattcacgatgagtcccggagctttcgtcgccgcggagaagtcgttttccgcaacgtatgcggcaagaccacgattatcgatgccatcgagatattccgctttgaaacggcctttgcagcataggagcgtgccagatacgacctgcctggtgtcgtaggtgattgaaccgaatggcttgtcgaatccgttgacggtctgcgcgtcaagcgtccaggcgtctccttggatgatttcgcgcagcaatccatgctcgctgagcagacgtgctgctgatgccagagtcaaagccatatttcgtgttctccctgttcttcggataccgaacagtcattctaccttcagctatgtgcatggcatgtggaagtcgatgtggttacaatgaagctgtgactgaagtacgaacggaaaccatggcaagcaaaagggcgcgttttgaaaaacttgccatgcctgtggttgatgcgttgtaccggcaggcgatgaagctgaccaacgatcccgacgacgcccaagatttggtgcaggatactttcgaacgggggttcaaggcgttcgactcctttcaggagggaacgaatttcgccgcatggatgacgaccatcgagcgcaacgcttacttcaaccaatacgccaaagccaaacgcagaccgcagcgggccaacgattccaccggcgaatacgacgattgggacatttattcggcttccgagcattcaccggaagagctcaaatcggcggaacaggaatatttggatgcctatgcgcctgaagaaatcatggcggcgctcgccaagctttcgccggaacgccgtcaggtgttcatcgatgctgcgatcgacggcaaatcataccagcaggtagctgacgaacagggtgtgaaaatcggtacggtgatgagccgtctcaatcgcgcgcgcacgcagttgaaacgagaacttgccaactatgcgagggaacgtggctatgccacggcagggaagggcagagcatgagtgaatcgatcgaacggcatatcaccactgtcgccaccagcgaggacggcactgtgacacaggtgacgcatgccagcgtgcgcgttagcacctccggtgattgtttcgaccccgaacgttgctgcgacgagcgtgaacgggcattgatcgcggccatgcgtgcgtatttgcgtccgcagcatgccccgcagagtcttatcgaccgccttgaggcaacgctcgaccattgttgtggagagcggtgagcaagccgatgagagtatgagaaaaccccgccgatcataacgattcagcggggttttcgatgctctgtagcgttattcacgctggcagggatcaggcgtttggacgcttgccgtgattggcggccttcttacgacgatccttgcgcttacgtccgcgcatgcccatgattggactcctttacttacgattaataagccttcgggattatcgcacacgagcgagacgtttgccaaatccggtgttcgataggtggccacttagacttatccgtcgggtttttatatgaccggaatcagccggtttaaccgactggatcactcgatcacgctcactcgcatgtttactcggccataccgaggaacagcgaggtgctggtggtttcgcccggcttgatcacgatcagctcgttgcctgtgttgaacgcgttggcgtaggcggtctgtggctccacggcaacgccggcaggatgctggaatgcagggaacttggtaccggtgcacacctggaacgaagtgatggtttcatcgccgccaacacggaccttcttgccatcggcgcgggtgaacactgccgtgacggaaccgtcttcggcatgctccagatcggtccatgcatcgtcgaacggctgctcggtaagtagggtgtcttcgcgcaggtcgtatttggtgccgtcaaccagctcggtgccggtcggaatgaggttttcatctacggtgacatgcgtgcgagccggtagcgtaaggctgcacttggcgttgtgctcgtcgatttcgtcgccatagccgttgaggctgttggcaagccacgggtgaatggccaaagcccacggcgcgttcgtgtcgccgttattgtaggcgctgacggtcagatgcatgccgtcgtcggcgaggctgtacgtggcggtgacatatagatcaaacgggtagccgaccatgttgggggaacgccaagcgagggtcactgcgtcttcggcaagcgaaatcagcttccagaacgagcggtatccgtagccgtggatggcggtgttgcggtcatgctcatcgatcggcagcgaataggtcttgccttcgaacgtgtactcgccaccctcgatgcgattcgggaacggaatgaggatctggccgtggcagcaggtcaccagatcgtccggaccaagggcgaccgtcagatcttcgcccttataggtcagcttgcgcatcgttgcgccgagttcggtgatgacggcttcatagtcgccatgggagatggagaattgctgtccggtgcgggcaggcagattgatgcaggtcatagtcactccatagtgccgttggatatgttccggtaacggtagcgttaccgctaacaccacagtctacctgttttatgccgtatggcgatgccgtttctccggcgtgccgcccatgctttagtattgatgaggttttcacgaagtgacgaaaggcggccatcatgaccaagcgtatcgtactggcggatccacgtggcttttgcgcgggcgttgacagggcgattctgactgtgcagacgattctcaaagctgccaatacgtctcgcaatgatggtctgccgccggtgtatgtacgccgtcagattgtgcacaacaagcatgtcgttgaggaattgtcggctcagggtgcggtgttcgtacaggaattggatgaggttcccgatgccgcggcttccgcgggaattccgattgtcttttctgcgcacggcgtgtctcctgaggtgaaggctgaagcttcagctcggggcatgcatatcgttgatgctacatgccctttggtgagcaaagtgcaccgtgaagtgttgcgtttcgtcaaagaagggtacgagatcatctacatcggacacaacggccatgatgaagccgttggcgtggtcggtgaatccccggaacatgtgcacctcatcgaacatgaatcggatgtcgattcgctcgagttttcttcggatgcgaaattggtgctgctttcgcagaccacattgagcgtggatgagacggcgggcacgatcgctgcgttgaaagagcgtttcccctggcttgagatgcctccgaattccgatatctgctatgccacatcgaatcggcaggccgcggtcaagttggttgccgagcagtctgattgcgtggtgatcgttggttcggcgaattcgtcgaattccgttcgtctgatggaggttgcgcaggaggggctgaacacgcgtttcgatggcgtgccgaatggtcctcacggaaaggcctaccgcgtggatgatgcgtccgagcttgatcctgcgtggtttgaaggcgttgaatccgtggggatttcgtcgggagcatccgtgcctgacgaattggtgtcaggcgttatcgaagcgctggaacagcgtggtttcgatgatgtgaccaccatcgaaaccattaaggagaacatgcatttcgtgctccccagtgagcttcgtaagaaaccagcctgctgaccggcttctattaccggtgattaccaggtgccgataggtgcggctatgccgtcaagcaccttgagcagatcattgggattgatgccgatcgaaaagccgcgtttgcctcccgacagtagtatttcgccatattgcagcgcgctttcgtcgagcacggttttgtgatgcgtacgttgaccgagtggtgagatgcctcccaccacatacccggattcgcgcatggcgacttttggatcggccatagcggctttcttggctccgactgctgcggccagcgccttcagatccatgtgcccgcttactggaaccacgcccaccacacgttcggagccggtgtcggccataagcgttttgaatacctgatgttcatcgaagcccagtttggtggcggcctcaaccccataaccgtcatccatatggtcgttcgaatgtgcgtattcgtatgttttgaatgggattcccgcttgttcgagttgcactgttgccggcgtggagccggcgcccttctcatgctttttcttgcccatatcgattcactctaaaacgtatttgtgtcggttagcaaaagggctttcgccgtgagacgaaagcccttgtaccaagttctacttagtgaactgtgcggattgctccgccatggttcactcggagatctcagcgaagtacagcagggtgcgcaccatgttgcaggtgaagccgtactcgttgtcgtaccaagaaacggtacgagccatggtcacgccgtcaacggtgttgacgtcggtctgggtcggatcgaacacgccaccgtgggtgtctccgatgatgtcggaagacacgatgccatcctcgttgtagccgtagaagtcggtggaggagaaggcagccttgaatgcggcgttgatctcgtcagcggtgacttccttgttcaggacggtggtcagctcggtgacggagccatccggaacctggatacgctgggcgtggccctgcagcttgccgttcacggacggaacgaccttgccgatagccttggcagcgccggtggagtgaggaatggtgttgattgcggcggcacggttgttgcgagccttcgggaagcgcgggccgtcgaggatcatctgggtgccggtataggcgtggatggtggtcatgaagccagccttgatgccccagttctcgtccagcagcttgaccatggcggccatggagttggtggtgcaggagccggcggacacgatcacgtcggaagccttcaggatctcgtggttcacgccgaagacgacggtcggggtggtctcgtccttggccggagcggagatcaggaccttcttggcgccagcgttgatgtgagcctgggacttctcagcggaggtgtagaagccggtgcactcgagcacgaactcaacgccatcgttcttgacccacgggatgttgttggcatccttctcggcgtaaaccttgtattccttgccatcgaccacgatggagtcttcggtggaggtgacctcaaccggggtgccatcgtcatgacggaaggtgccgtgggtgctgtcgtacttcagcaggtaggccagcatggacggggtggtcagatcgttgattgcagcgacctcaatgtcaccggcctggccgccacgagcctgcagctcgaagatgcggcggaaagccagacgaccgatacgaccaaagccgttaataccaatcttaactgtcatgtaattctccctttagggtaggccacgcgtgtgctgggcacacagaagccattgtttaccaacgtcacccactttagtgcgtcacctgtacttaaggcaacgcactcgcgcgtgtgtttcagaaaacgtcgtatttttccgtgagcgctcacatcatcttttcgagataaacgtgatagacgaaggtgattttcttcgctttgcgattagcgggattggcgttcgtgcttggcaagcgatgaagatactttggtgtccaacgatccgaggtcaccctcaaatgtgtggtgccaagagactgctggtagtggggcttccgaagggaaagtcaccaccaaggtgccatgttcgacgccgatatgggcggcggctccgttgaggaattcgttactgacgccgttgacacgtgtgctggtcatcgtcatgtcatctacctcgtatttcagtccacgttcgctcacgccaagagaggtgtcggaatgggagaatacggaaaccatacgtcctggttcgacgttgttctcgccgaaatcgagtgctccatcgcaaatcgcggtcacaatggagccgttcccgtgcagaaaacctactgcaccatgctgagccagcaatgccatcagttggatattggatatggtgtgatcgattcgtccgccgagcgcgccatatatatggaaaagccgcgcatggtgtgaccagccgatttttagtgccgacagaaggtctggatcgtctttttctggaggtagggcaatggtgtgttcaccctgtgtcggacgttctccagtaagcgaatcgaaatcgcccaccaccacgtcaggcgacatatcaagtgcgcgtgcatggtcaagccctccgtccgccgcgataatgaatgctccagacggaacgatgggggtatcgctgtagtattcgccagccgcgaaaatcacgcatgtgttggaattatctgtcatatggggtcagtgtaatatggcgttggaatgattaaagaagatgtttcagaaggtttcattatgcgacacgctgtggtcgcggtgtgtggtattatctacaaggcttgagaaatcaagaaagcgggatatctccacctggaagcctttcagggcctcgggttcaggcataagcctctggtgccgtatgaaacggcagtggaagagctgtggtatggctctttgttgcgccctcgaattgggtgttttggcttgccgtgaacatgcgagactttgaaaactgccgatctgggagcattccgtcgaatggaacatgaggattggagtcatcatcagcgacgaaccacgcattaacgacgagattcgcgtctcccaggtgcgtctgatcggcccgaacggcgaacaggtgggagtcatcgcgacttccgtcgcactgaacctggcaaaggaagcgaacctcgatctcgtcgaggtggcgcccaacgcgaagcctccggttgccaagctcatcgattacggcaagtacaagtacaacgagaagatcaaggctcgtgaggctcgtcgtaaccagagcactgcggaaatcaaggaaattcgcttccgtctaaagatcgacgaccatgacttcgaagtcaagaagggccatgttgtgcgcttcctgaacggtggagacaaggtcaaggtcaccatcatgctgcgcggtcgcgagcagtcccgtccgatcggtggcgtcgagctcttgcagcgtctcgccagcgaagtggaggaatacggcaccgtcgaattcgctccgaagcaggaaggccgcaatatcatcatgacgctcgcaccgaagggcaagaaggttcacacccagtccgagcagcgtcgtcgtggtgatcagtcccgtgccgagcgtcaggcccgtcaggctgcacgtctggcggccaagcaggaagcccaagctcaggcggcggccgaagccaaggctgcagtggcatccgacaaaccgaagacttccgaaacgaagtaataaacaaggagggcagcaatgccgaagatgaaaactaattccgccgcttccaagcgcgtccgcgtgaccggttccggcaagctgatgcacgctggctccgcgatgcgccacaacctcgagcacaagtccgctcgtaagcgtcgcgcactgaaggccgacggcgttctggctacttcccagagcaagaacatgaagaagctgctcggtcgctgagtatagcgagagcgaataagaagacttaatagaaagctgaggaatcaaatatggcacgtgtcaagcgcgcagtaaacgcccacaagaagcgtcgcgtcgttctcgagagggcttccggctaccgcggccagcgctcccgtctgtaccgtaaggccaaggagcagctgcttcactcctttacttacaacttccgcgatcgtaaggctcgcaagggcgacttccgcaagctgtggatccagcgcatcaatgctgctgtccgcgctgagggcatcacctacaaccgcttcatccagggcctgcacctcgctggcatcgaactggaccgtcgcgctctcgccgagctggccatctctgatccggagaccttcaaggccatcgtcgagcaggccaaggccgctcttccggctgatgtgaatgctccgaaggaagcctgagcttcttcgctgattcagcgtgattgacaggaaccctcgctccagcaatgggcgggggttcctgcgttgcatggcagggctcgtttgacttatggtaagggaccgctcagtggtatacgatgagccggatgggatctgctggaaggagggtgatggacgatttcgaacggacaattcggcaattcctcgctcatatcgacgttgaacgaggactgtcgaaggcgacggtgtcggcgtatggcgccgatttgaagaagtatcgtcagtggcttgccgaccaaggcgttggcggtatcgcggccgtgacgacacaggatgtggaacgttatatcgtcttccttgacgagtcgggagagtcatctcgaagcaaggcacgccggttggccagcattcatgcgcttcatcgtttcgcagtgaacgaacatattgttgtcgatgatgtgtccgcgcaggtaaaggcccctaagggcgtgagcacgcttcccgatgtgctgaccgttgatgaggtggctagactgctggactctatccccgtttctcaaaacagagagcatgatggtgtcgtgtcggagtttcccgatgatccggtgatgttgcgtgacaaggcattgcttgaattcatgtatgcgaccggtgcccgcgtgtcggaggcgtgcggtgcgaatctcgatgatgtcgatgtggacggcagaatcgcaagacttatgggcaaaggctctaagcagcggctggttcccgtcggcagctatgcgtgcgaagcgatcatccggtatttgcatgcggggcgtcctaagctggaatccaaatcgaaaggtcccgtggaacggcgtgccctatttctgaataaacgaggaaaaagattgtcgcgacagtcggtttgggaaatcatcaggggagcgggggagcgtgcgcacatcgataagccgctgcatcctcacaccttgcggcactctttcgccacgcaccttattcagggcggtgccgatgtgcgtaccgtgcaggagctgcttggtcatgcaagcgttaccaccacacagatttacacgcatatcagtcctgaaaacctgattgagacatatctgatgtctcatccgcgcgccagatgatggtgttgctgccgttttgaacggtgacaatggactagcatggattacagtgaaaattgacacaaggatgttggtaaggtaaacggtatgcctacggatttgcttggacgtgattatgagacgtttcccgctccggagccgctgcagacgcacggtccggcgaggatcatcgccatgtgcaaccagaaaggtggcgtcggcaagaccaccagttccatcaatatcgctggtgcattgagccagtatgggcgtcgcgtgcttatcgtcgatttcgacccgcagggtgcggccacggtggggttgggcatcaacgccaataccgtggaagatacggtgtacaccgcactgttcaatcctcgcatggatgtgcatgatgtgattcgacataccgatttcgagaatctcgatatcatgccggccaacattgatctgtccgccgctgaagtgcagttggtcaccgaagttgggcgcgagcaggtgctggctggcgtgttgcgtcaggtcaaggatgaatacgatgtgatcatcgtcgattgccagccttctctgggtttgcttacggtgaatgcgctgaccgctgccgatggcgtgatcattcccgtggctgctgagttcttcgcactgcgaggcgtggccttgttgatgcagtccatcgaaaaagtacaatcccgcatcaatccgagtctggaagtgtacggagtgctcgtcaccatgttcacgcataccttgcattgtgatgaagtgttgcagcgtatttatgaggcattccaaggcaaggtcttccattcagtcatctcacgttccatcaaacttccggattccacggttgcggccgcgcctatcaccatttatgcgccgaaccataagaccgcgaaggaatatcgtgaggttgcccgagagctgattgctcagggcatcgtcgcataagacgcatagggctccttcgtggggcctttttcgttgaagggcatacgtgggttgaaattcaagcggtgtggtgaaacactgcacttatagtcatgttgactataagtgctacactgtgattccggaacaattcaaatcgacaaaagatcggagaggtgaggcgcgatgatcatgggcaatgtctcagaacggcgcaaacagccgccgcaggtgggcgtttccgtggtcattctcgctttggggccagcttcccacggaacgcaggaacatgctcgaaccagtgcgggatccaccttgtggataccgctggtccggcgcgtgcgccagccttttcttggccagtgggcgttgcccggtggtggtttgagggctgaccactcgctggagcaatctgcctacgttgcgctggaatccacgacatcgttgcatccacggtatcttgaacagctgtatacattcggcgatccggcgcgctcacacggcgggctgccgatggtatccatcgtctattgggcgttggtcgacgatcttaacgggcaactcgggcagagtatcgacgacaatgtcaaatggtttcctgtggatgatctgcctgagttggcatttgaccatggcgacatcgtggactacgccctcagcagacttcgtggcaaaatcgaatatccgcagatcgtcaccagattggtaggcgagaggtttacgctgagccagctgcatgacgtgtacgaggccgttgccggtcagagcatcgatctggcgaatttccgccgtaagatgctcgcatccgggcagctggaggacaccggtgacaaattgcgtgtcggacgcaatcgtccggcaacggtgtatcgctacaccatggatgtgctccgacagtcgacatggagcgatgctcgggatcgccatgatttcgatgtgcgggaaacgcaggatgatgtgctttccgcgttgacgacgatctgacgtcttttcggattgtttccttttcagacgattctgtctggttttcggcatgccttgtaggcatggtcgtttcgtatgagaggaagaagtatgacatccgtgcaatccgcatcggttgcttcgtcgggttcgttgacacgcaatgagcgtcttgatcgcctgccgtttaacaaagcgcataggaaacttctggtggcgtccggtatcggctgggctttcgacgccatggacgtcggcttggtgtccttcgttgtggcggccatcgcggctgacccgcatttcaatctgacaccaaccgagaaaagctgggtgctgtccatcggcttcgtcggcatggcgatcggtgctgcgctgggtggttttgtagccgatcgtgttggccgcaaaacggtcttttccgcgacgctggtgattttcggtttggcgaatggcggcatggcactgtcatggtcgttggccgcgcttttgatcgctcgtctgatcatcggtcttggtttgggcgccgaactgccagtggcttccactctggtttctgaattctctccgaccaaacaacgcggtcgtatgacggtgctgttggaatccttctgggctgtcggctggattgtcgccgcctgcattggctactttgtgattccgaataccggcgattggggttggcgctgggctttgctcattggcgcgttgccgctgctgtatgccattgtgacgcgtgttcatattccggaatccgtgcgattcctggaatccaaggggcgtgaggacgaagccgaacaggccgtacgctatttcgaacaggcaggtggcatcgagccagtggcttccccgaagggcaaaccactgccgaagatcaacacccgcgaactgttcggcaaaaagtgcatcgcgcgcaccgcagccatttgggccacgtggttcttcgtgaacttctcctactatggagcgttcacatggatgccgtcgctgctggccgaccagtttggctcgctgaccaagtcgttcggctatacgctggccatcgccgtcgcgcagttgccgggatacttcctggccgcatggctggtggagatctggggccgcaggaagacgctgagcgtgttccttgccgtgtcggccgtggccgcgtttgctttctcgcaagcgggttccgtagctgcggtgttgggctttggcatgttgttgtccgcatccaatcttggcgcgtggggcgtactgtatgcggtgactccggaaatctatccgacccgcctgcgcgctgctgcgtccggtgctgctgcggcatgtggccgagtggctgccatcatagctccgctgctcatgccgtggttcctgacgctgtccggtggcaacaaggcggtggcattcatcgttttcgcggtcgccttcattctggcctgcgttgcggcgttgtgcttgccggaacgcactggtaaggaacttgaggattaacgaattattttgagtggtcccaagagatcatacgtttgcggttgttgagattcgacaaccgcaaactttgtatgtgggcgaaagcgctgggaccggaactgtcgtaatggttcgctaggattggctcggtttgtgtggagtacggatttgtaagtaccgataaccagtatgtaccgaacggtaacgcaagagaacagcaatactaagagaggtttcgatggcggttcgcggcgatattcgaaatgtagcgattgtggcacacgtcgatcacggcaagaccacgttggtcaatgccatgctggcacagtcccacgtgttcaacgaacgtgaggaagttccggatcgtgtgatggattccaatgatctggaacgtgagaagggcatcaccatcctcgccaagaacaccgctgtgcagtacaccggtccgctggccgccaagtacggccatccggaaggcatcaccctcaacatcatcgatactcctggtcacgccgatttcggcggcgaggtcgagcgtggcatctccatggttgatggcgtcgtgctgctcgtcgacgcatccgaaggcccgctgccgcagacccgcttcgtgctgcgcaaggctttggaagccaagctgccggttatcctgtgcgtgaacaagaccgatcgtccggacgcacgtatcgaagaggtcgttggagaatcctccgatctgctgctcggcctggctcaggacgttatcgaagagggtgtcgatctcgatgaggatgcgctgttcgacctgccggtcatctactgcgcggccaaggccggctacgcttccgaaaaccagccggagaatggcggtctgccggataacgaagatctcgaaccgctgttcgaagccatcatcaagaacattccggctccggaatacgaggaaggcgcgcctttgcaggcacacgtcgccaacatcgattcctctgatttcctgggtcgactcggcttggtgcgtatctacaacggcactctcgaaaagggcaagacctacggtctgtcccgtgtggacggctccgtcgaaaacttccgcgtctccgaactgctgcgtacgcagggtcttgagcgcaccccggtcgattccgcgggtcctggcgacatcgtcgcagtcgccggcgtgaatgacatcatgatcggcgaaaccatcgttgatccgtccgatccgcgtccgctgccgctgatccacgttgatgatccggccatctccatgactttcggcatcaacgattccccgcttgccggaaccgaaggcaaggaccacaagcttaccgcccgcatgatcaaggatcgccttgaccgcgaactcatcggcaacgtgtccatcaaggtgctgccgaccgagcgcccggatgcatgggaagtccagggtcgtggcgagctcgccttggccgtgcttgccgaacagatgcgtcgtgaaggctatgagctgaccgtcggccgcccgcaggtggtcaccaagaccatcgacggcgtgatcaacgaaccgatggaaaacaccaccatcgacgttccggaagagtacatgggcactgtcacccagctgctcgccgaccgtaagggccgtatggagaacatgaccaaccatggcactggctgggttcgtctgcagttcaccgtgccgtcccgtggtctgatcggcttccgcaccgcactgctttccgccacccgtggcaccggtatcgcatcctccatctccgccggctacgctccgtgggctggccagatcgtgacccgccagaacggttccatggtctgcgatcgcaagggtatcgccactccgtacgccatgcagcgtctgcaggcacgtggcaacttcttcgtcgaaccgcagtctccggtgtacgaaggccaggtcgtcggcgtgaacaacaagcctgacgagctggatgtgaacatcacgctggccaagcatatgaccaacatgcgttcctccaccgcagatgtgctcgaaaccctgactccgccgatcaagatgagcctcgaagagtccttggacttcgccaacgaggacgagtgcgtggaagtcactccggaatccatccgtgtgcgcaagattattctcagccgtgaggattggtacaagtggcgcgccaagcagcgtcgacagaataacgctcagaataacaagtgattcttcacgttgttctgtcggcttcgcaagcacggtagtgtgcttgctcacttcgcctacggtgagcccgctgggctctccgtttgacggctcagcagaataacgctcagaagaacaagtgattctgttattgcttccatgaaaagagatacgtgtcctcgcgtatctctttttcttttcaggttggtgagcgatagtaggggatatgatgcaacagatgaagcaatcgcatgatacgtatgggtcgaatcaagatgcggcgcccgatgcgcaactgatgccatggtcataccgtctgccgatttggggacggttcctcgtcgatctggtttccggaatcatagtcggagtagtgggaaccatggcccatcgcatgggcgcatccatgaatattccctacggattggcgatcgcctatctcatggtgatcatttcgacatggtcagctcgatcacgcgacggtgtctcaggcctcgcattgcacctgatcggttcctctctggtggtctggacggtgatgtcggggtatggtccgggaggagacgccatgattcctgtgggattcggtggagatgatcccatgccgttcttcagtgaacaggcaggatacatgtggctgtacggtgtcgtgcttattccggttgtgatgctggtgctgccgaaacgttggttcgtcacacctccgcgtaaggagacgcgtgatggtgcgtttgctgctgatacgcagacgaacgagggtaaaacatctgataacgcccaaccggtggaataatcggcagtcgattccacggcaatgaggtaaggttcaggggaacaccaagaataaggaatggggttgaatgagcgcacgaaagctgttctatctaggtccgcaaggcaccttcacccatcaggccgcagtcaatgcatcgcaggcactggcccatcttgagccggaaggattcgaattggtggctgcggatgacgtaccgcaaatccttgatgccgcgcagcggggcgaaggatggggcgtcgtggcatgggaaaacaacgtcgaaggttacgtggtgccgaatctggacgcgctcatcgacgccaaagatctagtcggatttgcgcgagtgggcgtcgacgtaactttcgacgcatatgtgcgtgcgggatccaatccggaagacgccaccgtggctaccgcacacgcgcatggtctcgcgcaatgcaaacgtttcatcgcggaacaccatttggaaccgactccagcgccatccaatgctgccgcatgtcgcgatatcaaagcaaacgaaatagctttcgggccaagtatttgcggtgaactctacaatgtgacgcgcatcggtaccgccgtgcaggattatcaaggcgcacagactgattttcttgtgctcgcaccacgcaaggaagccggaaaactgttggaacagcctcgttcgcaagctgatatggaatacgaatccgtgctgacgcttattccgcttgtcacaggtcctggcgtactcgcgaacctgctggacgtattccgcgatgcaggcctcaatatgacaagtttcatctcgcggccaatcaaaggacgcacaggcacatacagttttatcgcgacgctcgatgcggcgccatgggagcaacgcttccatggcgcgctggttgaaatcgccgaacacggtgactgggccaaaactctggccgtatacccacgaagagaacgccccaatcctccagtcacctcatggatgctgccgcagggaggcgtacggcttgacgaacagcatctgccagatgattggcagaacagcgaaacggtcggaaaggagctgatgtggtgaagcagcgtatcgcaatcgtaggccttggtcttatcggagggtcactggctcgcagactcgttaatgctggctgtgaagtcatcgcatggaaccataacgatcgtccatatgaaactgcgaaagcggacggcatacgatgtgtgtccacactggccgcgctcgccgacacaaaacctgacgtgctggtgttatgcaatccgctcaaggccatgccgcaaatcctgggtgcgttgaagccactgatcgatacggacatcaccacgctcaccgatgtcggcagtgtcaaagcaatggttcgggaacaggttaaagccgttggattggaacattgctatgtgggcgcgcatcccatggcaggcaatgagctgtccggatgggaatcgtcggatccgacgctttacgatggcgcgctctgggccatcaccgtagatgaaaacaccgagtatcagcggttccgcgccgttgcgacaatgattgtggatcattgttccaaccgactcatcgttcttgacgatgcgacccacgatcgttgcgcggcactgatttcccacatgccacacgtcatttccacagctatgatcaacgagctggtggccaatcccaaccggaacatcgcagccgcgctcgccgctggttcatggcgggacatgactcgtgttgcgctaaccgatccaaaccgtacccgtgcaatggtggaagaggacgccgccaatgtcgaagcgttgctgcgtaatatggccaatcggttgacgcttatggccaacgtgctgcacggcatgaccacgcaacagggctcgcccactgccggtgacgacaaggagatggcgcgtttcttcatacaagggcagccattccgtgaatacaaggctctcgccaaagaacctgacttcgaagaacgttgcgaaacggtcgaactggcaattcccgaaaccggatggcagcagatgcttctggagtcggcgcgtaggggagagcatatcgtgcgattcgacggttaccgtcaagctatggcacaggtgcgttccgcagtgtgacgcgctatgggcgcggccgtgtcatggaacgttccggaatcggtttgacagtgacgatggtgtcggcgggaatgctgacacgttgctctgggcgtgaaccgttggctgccgcatcgcgcgtcatttccaatgtctgcccgtcccaagaacgtacgtgaccgacataatcgcggaatttcatgcgctggtcctttggatcgacaccttcgcaggtgcgcaccacaatgcgtgcacctgctggaatttcgtttggaatcggcataatctccccttcgaatagacgatcatcgacggattcgctgagcgaacgctactggacagcatagttggtctcctttcaagttgtgccggtatttcggtttctatcggagaatggacacataatggaaagaaattcatggattcgggcttgctgttgagctcgggaaaggctgatcggcatgctgttcgataagagcgtagaggcattcgatacatatctgaaagccaaccgtggattgagtgaaaacacacggaaggcataccgaggcgatgtcgaagaatgtctgcttgccttggggcggcttagatgcagggatcttaacgaggtgaccatcgaagatcttcgcatgtggatggcggaatcatcgaaaaaccatgcgaaaagcagcatggcccgaaaaactgtggcggtacgtggttttttcgcgtggacgcatgagcatggcgtgacgacgacggatccggcttgtgcgctcatgaccccgaaaatacctgatacgttgccggatgtgctcagcgaatcacaggctgaacagctgatggaacgcgtggatgaggacggtgaaacgtctcagccgaaggaacggaccatgaagcagcaggccattgagctgcgtgacgccgcaatgctggaactgttgtatgcaacgggcatgcgtgtggctgaactggtgggacttgatgtgccggatgtggtcttttccaatcgaacggtcaaagtgaccggcaaaggcaacaaacaacgagtcatgccatttggcgctccggcgcaaaaagcgatacgtcggtggctggatgatgggcgtcccctgttggtgggggagcagtccgcggctgcgctgtttcttgggagacaaggcaaacgcattgatcagcggatggtacgtcgtgtggtgcacgaatgcgcgcgtgatgccggcgttcccgacattagccctcatgctctgcggcacagtgccgccacgcatatgcttgacgggggagcggatttgcgtgaggtgcaggagctcttgggacattcctcgctgaagaccacgcaacggtacacgcatgtctccatcgaacaattgaaagcccgatacggtcaggcatttcctcgtgcgtagtcgcggtccatggatatttcgttacattcctgtaacagaaattggtgtttcttcttgatttagggtgtattacctagatgaagctggtacggggaaacaataccgaccggtaatccgaataatgagggaaaacataatgagtataaggaaaagcaaggtgtttgccgttgcggcggcggcctgtgtgcttggcatgatgctgggcggctgtgggtcttccacgtctgggaacgcgactgaaggatcgaatgtcattacggcatttgactccgaaccgcagaatggcttgattccgggcaacaccaatgaaaccggcggtggccgtccaatcgatctgctgttcgctgggttggtgtctttcgataaggatggcaaggcccagaatgaagtggctgagtccattaccgccaatgatgacgccacccagtacgacatcaagctcaaggatggttggaagttcaccgatggcaccgatgtgaccgccgagtccttcaccaaggcttggagctatacggctaatgcgaagaacgcgcagctgtgctcttccttcttcccaccatcaagggctatgacgcgctgcaggacaccgacaacctcaagggtgacgagcagcttgaaggtctgaagatcgtcaacgatcacgagttcaccgtcgacctgagccagtcggattccgcgttcgccaccaagctgggttattcgggattctatccgatgccggaatccttctacaaggatccgaaggccttcggagagtcgccggtttccgatggcccgtacaagttcgattcctgggaccatgacaaggaaatcaagctggtcaagaatcccgattacaaaggcaatcgcaaggtgaataacgacggtgtgacgttcaagctctacacggatgccaacgcggcctatgccgatgttcaggccggcaaccttgatgtgatggatacggtgccgtccgccgacagcaagaccttcgaatccgattcctccgtggtgccatacaacaaggccggttccgtgattcagacgttcaccattccgtcggatcttgaacattggaagacatccaccgaagaaggacagttgcgccgacaggcgttgtccatggccatcgaccgtcaggccatctgcgacaaggtactgaatggtttgggaactccagcggtcgaattcacgtctccgaagactccgggctactccgattcgctcaagggcaacgagaatctgaagtacaacaaaaagaaggccaaggaactctgggagaaggccaacgccatcagcccgtggacttccgacgacaagcttacgttctcctataatgcagacggcggagccaagccgatctttgaagccgtggtgaactccgtgaagaacacgctcgatatcgacgtgaccactaacccggtgccgaccttccaggaattccgaaacgacgttaccggccgcaagatgaccggcgcgttccgtaccgcttggcagccggattatccgtctcctgaaaactacctgtaccagctgtattcctctgacgctgctgatggcaatggttccaacgatggcgattacaagaattcggagttcgatgacctgtgctccaaggctgctgccgcacagaccaccgacgaggccaataagctgtaccagcaggctcaggagattctgttgaacgatctgcctgccatcccgctgtattactccaatgccaatggcgttgccgcatccggagtgaagaacttcgtcatgaactggcagaacgttccggtgtataacgagatttcgaagagctgacttattcttcggatacattgttcgacatgacggcggaaaacgtatgttttccgccgtcatgtcgtcaaggaaggtgtgcgttttttgggttgcatggaaaggttgtccgtcaattgagcaagaatagtgcactatcgccaaatagagatgcgtcggtgagtaggtcggctcgtttccgtttgtgggatgataatcctgatgtgatatcgaataggagaatgattatatgaagaagaaagcactggctttcgctgccgccgcgtgcgcttttggcatgttgctgagcggctgtggctcttccaacggcagcgacaccgccgctgaaggtgccaacatcatcaccgcatacaattccgaaccgcagcacccgctcatcccgggcaacaccaacgagaccggtggtggcaagccggttgatctgctgttctcccgtctgatttccttcgacgccaaaggcaatgcttccaacgaagtggctgagtccattaccgccaacgatgacgccacccagtacgacatcaagctcaaggatggctggaagttcaccgacggcaccgatgtgaccgccgagtccttcaccaaggcttggagctacgtggccaacgccaagaacggtatggtcggctcatccttcttctccaccatcaagggctatgacgcgctgcaggacaccgacaacctcaagggtgacgaacagcttgaaggtctgaagatcgtcaacgatcacgagttcaccgtcgacctgaacaagtctgattccgtgttcgccatcaaggtgggctattccgcattcgctccgctgccggaatccttctacgatgacacggatgccttcggtgaggctccagtcggcaacggtccgtacaagttccagtcctgggatcacgacaacgagatcgtgctcgtgaagaaccctgactacaagggcaaccgaaccccgaagaacgacggtgtgaccttcaaggtctacaccaaggatgacgcagcctacgccgacatccagtccggcgccctcgatgtgatggaatccgtgccggcctccgccaccaagaccttcgaaaccgatgagaccgtgcaggcctacaacaaggccggttccgtcatccagcagttcaccattccgtccagcctgaagcacttcgaagctggtaccgaagaaggcactctgcgtcgtcaagccatctccatggccatcaaccgtgagaacatctgcgacaaggtgctcaacggcaccggcactccggccgttgactttacctctccgctgaccccgggctactctgattccctcaagggcgtcggcaacctgaagtacaacgagaagaaggccaaggaactctgggagaaggccaatgccatcagcccgtggacttccgatgacaagctcaccttcgcttacaacgctgacggtggccacgagaccacctacaccgctgtggtgaactccatcaacaacacgcttggttccgaagtggctgccaccaacccgtacccgactttcaacgattaccgtaccgccgtgtccgatcgcaaggttcagggcgcattccgtagcggctggcagccggattatccgtccgccgaaaactacctggtggccaattacgcttccgccgccgctgatggcaatggttccaacgatggcgattacaagaattcggagttcgatgacctgtgctccaaggctgctgccgcacagaccaccgatgaggccaataagctgtatcagcaggctcaggaagtgctgctcaacgatctcccggccgttccgctgtactacgccaacgcctacggtgtggctgctaccggcgtttccggtttcgaaatgaactggcagaacctgccggtctacgagaacatgaccaagtccggcaagtgagccgatcttcgtgagtgaatctcgctgagccaattgcaggaaggggcggatcatatccgttccttcctttccatgtaatacgcaccgtttcagggtgacatcagtgtggccaagaggcgtcaggggtagatgccggtagccaagcatttttcccagctgattcccatgaaactgcaatataaagcagtttgttgtgtgttgccacaaaacttgcggggtaaatcgttaaccttccccgatgattatgagtaataatctgaaaaaggttgacaatgaataagcaaaaaaggagaaaccaatgggcagatatcttctgcgacgcattctgcagatgatccctgtgattctcggcacgacgcttttggtgtacgccctggtgttcgcgttgccgggcgacccggttaaggcgatgtttggcgataagccggtcaatgaggccgtcgccgcgcagattcgtgccgaatacaatctggataaaccgttcatcgtgcagtatttgctgttcctgaaaaatgcgctgactcttgacttcggcaagactttctccggtcagctggtcatcgaccagatcggacgtgcattcccggtcaccatcaagcttgcgctgatggctttcgtgttcgaagccgtgttcggcgtgatcttcggcgcgatttccggcctgaacaagggcaagtggtgcgataccgtgatcctgattatctctctgttgctcatctccgtaccgaccttcgtcacgggcttccttgcccagtatttcttaggcgtgaagttgcgtctgcttccagttacggccggtgccaatccaggattcatcgacctgctgatgccagcaatggtgcttggatctgtgtctatggcatatatcatccgattgagtcgttcggagatttcttccaatatcgcgcttgactatgtgcgcaccgcacgtgccaaaggcatggacaacaggtcggtcatgaatcgtcacgttttgcgtaactccatgattcctgtcgtcacttaccttggtcaggatcttggcgcactgatgggcggtgccatgatttccgaaaccatcttcaacgtgcatggcattggttacctgacttatcaaagcattctcaagggtgaaggcaatctggtggtgtccattgtgactctgcttatgctgatcttcgcagtgtgcaacctgctggtcgatatgctctatgcggcgcttgatccgcgaatccgctacgcgtgagttgggaggattgaacaatgactgatatgaacgagacgaatctttctcacgcgcttccgggacaggaacgatatgttgctcctctcgaggagacgccgcttaaggacgttgactcggtagatgagtccgcaccggcttcaagcctttgggctgacgcatggcgtaccctgcgcaagaacccgatgttcatcatttccgctgtgcttattgtgttcattatcttcgtggcgctgttcccaggagtgatgaccaagcagaatccgaactactgcacgcttgagaactccttggaaccggcttcgaagggacatcctttcggattcgatctgcaaggctgcgatgtgtactcccgcgtggtgcatggtactcgtacctcgctgagcgtcggcgtgttcgctacggtgctggtggtgctgttgggtacgctgatcggtgcgttgagcggtttcttcggaggctgggtcgacaccattctcagccgtttgaccgatattttcctggctttgccgattttgcttggtgccatcgtggtgctgcagatgttcaagaccaacgattccatttggaagattattctggtcatgacgttattcggctggacatccgttgcgcgaattgcgagaggcgctgttatggaagctaagaatctggagttcaatacggcttccaccgcacttggctccacgccgtggcgtaacctgttccgccacattctgccgaattccttggcaccgatcattgtggtgggcacaacgtctctggctacatacatcgtgttggaagcaacattgagcttccttggtgtgggtctgccgaccactaccgtcagctggggtggcgacatctccaatgcgcagtccattctgcgtaccgatccgatggtgctgttctacccgtccgcggcacttgccatcactgtgcttgccttcatcatgatgggtgacgccgtgaaggatgcgcttgatccgaagagccgtacgtgagtgtaagtgagggatattcgatgactgaaatgaataccgaaaacaagctcgaggccatgcaacgtgccaacggtccgctgctggaagtcaagaacctccaggtcgacttcaccactgatgatggtcagccggtacatgcggttcgcaactcctctttcagcgtatacccgggtcagtgggtggctatcgttggtgagtccggctccggcaagtccacgtccgctatggcggtgcttggtctgcttccgggcacgggccatgtggtcggaggatccatcaagcttgacggcgaggaaatctccggttacaagcagagggatttcgacaagttgcgcggcaacaagatgggtcttgtcccgcaggatccgatgagcaacctgaacccggtgtggcgtatcggtacccaggtgaaggaggctctggccgccaacaatatggatatcgcccatgagaagcgttcctcgctgtcgaaggctctcgccgatgccgatgtcgaacttaaaggcaacgacgatgaaactttccttggctccaaggagcttcctgagctgttgtccgcggcgaaggaagcgctgtccaagatcggtaagaccggcgacgacttcgacaagaccgtggcgtacttcgagtcggagtgggtcccaggatctgaaacgcgttggcgcgtggccgacgacctgatcaaggtcggcgtggccgaggatgacgcttggtacatcgccaagaagtatgtaatcggctccaccatggatgaccgcatcgcaggtcttctttctgaggctggtctgccggatgccgccactcgtgcacgccagtatccgcacgagttctccggtggtatgcgccagcgtgcgctcatcgccatcggcttggcatgccgtccggaactgctgatcgctgacgagccgacctccgcgcttgacgtgaccgtgcagaagaagattcttgatcatctccagatgctcaccgattcgttgggaaccgcagtgctgttcatcacccatgacttgggtttggcggctgagcgtgcgcagcacatcgtggttatgtacaaggggcaggtcgttgaatccggcccgtctctggaagtgctgcagcatccgcagcatccatacaccaagcgactggtggcggcggcgccgtcgttggcctcgcagcgcatcatctccgtcaaggagcatggtggcgatgccagcggcgtgatggaacacaaggtgaatgaagattccctgaagtccggcgaatccatcatcacggtggatcatctgacacgcgagttcaagctgccgcgcaagaaggagatgttcaaggccgttgacgatgtgagcttttccgtcaagaagggtaccacgctggcaattgtgggcgagtccggttccggcaagtccacggtggccaacatggtgctgaagctgcttgaaccgacctcaggcaccgtcacttatgaaggcaaggacatttccggcttccaaggcaaggaattgcttgacttccgccgccacgtgcagccggtgttccagaatccgtatggctcgcttgacccgatgtactccatttaccgttccatcgaagaaccactgcgtatccacggcattggagacaagaagagtcgtgctgcccgcgtgcgtgagttgctcgatatggtggaactgccgtggtccgtgcgtttccgctacccgaacgagctttccggtggtcagcgtcagcgcatcgccatcgcacgagccatggctctcgatccggacgtgattgtctgcgacgaggccgtatccgctttggacgtgctggtgcaggatcaggtgttgcgattgctcaatgacctgcagacggaaaagggcctgagctacctgttcatcacccacgatttggcggttgtgcgtcagatcgccgatgaggttgtggtgatgcagcacggcaagcttgtggagcacgccaccactgacgaggtcttcgaccatccgcagaagcagtacacccgtgatctgcttggcgccatccccggcggcaagctgcagctcggtcttgactgatttgatgcgataacatcatcaagataagccttcggcatgtgccgagggcttttcttgtatgcaagctaggctagaacgctatgacgatcactatcacgacttccaatgtgaacggaatccgagcggcaaaacgcaaaggcatcgaggagtgggccggacgcaacacacctgacgtgtggtgtatgcaggaggtgcgtgccccgcaaaacgaaatcgatcctattttcgacgaattcggtttcgaatactcaacggcgggacgtatttccgatcagagcgaactgcatcgtatgaacgagatttgccgtatcaaggggcgtgccggcgtaggtctgttgtcggcattgccggttgtcgacaaacgatatggattgccgggacttgaggatgacgtcgattccggccgttggatcgaagcggacatgcaaactccacaaggctatgtcattaccgtggtttgcgtgtatgtgcatgcgggaaataccgatgatccggaaaaaatgaagcagaaataccgtttcctcgacaccatgctgatacgcatggaacagttgcgtgacgaggcagcacacggcggaaaacaagcggtgctctgcggtgatttcaacatcgcgcacacgccgctcgacatcaaaaacgccaaagccaacgaaacgcatgccggattcctccccgaggagcgcgcatatgtcgacaaatggttgggagaactggagtttgtggatgtgatgcgtaatctcgccggagacatccaaggaccgtacacatggtggagccagcgcggtcgtgcattcgacaacaatgtcggctggaggatcgactatcagttcgcaacaccggaactggcggaaacggcctgcggattcgtgatcgataaggctccgacctacgacctgcgctggtccgatcatgcgccgctcagcattatgtatgacatttaagccactttttatcgtgaacagactgggaattggaatatcacaccccgattcccagcccatattaagcataggtgctaggctattcacggttgcaactgttatgaaatgaggaacatcatgggattgtttggattcggtaagaagaagcatcagagcaaggaagctcttgaagcggccgccggagaaaacgaagaggctgtcgacgcagctgaaaatgttgacgaagctcaggaagttgtggcgcttccggagccttccgctgaatacgagggccgcggtgacgagcatggtccgtgggatgtggaagatgagaacgttcccgactacgacgagtacctcgatatgggatcatattatctgccgttcctgaagggcattgaattgcgagtgaaggccaaccgtgccacccagcaggttcttggcaccaccatcacctacggttcctccagtgtggagattgaggcattcgcggcaccgaagacgctcggattgtgggatgacgttcgtgccgacctgattgaagccaacaaggacgcgaaggaagtcgaaggcgtattcggcaccgaactggcattgccggttaccgtcaagggtggacgcaaggtgcttacccgcatcgtaggcgtcgacggtccgcgttggatgttgcgcggcatcttctcaggcaaggctgccaccgatcctgagggtgaggaagcaaaggcattgaaccagttcttcgctgatattgtggtggaacgaggcgatgatccgttggcgccacgcgaccttattcccatgcatccgccggtcgctccggccgaacgcaaggctgcgaaggcagctgcggaagaggctgagcagaagactgagattcccggcaaaccgaagggtccattcgactccgaccagcaggttgaggtcaagaccacgctgtctcgtggaccgatgttctccgaagtgcgttgagccgcttgaaccgatagctaatacgtatggctgaaaccgaagcgagaaaacgaactggtcttggtgcgcttgccgacgccggtaatactgacgatttttccgtgatcgacgccatcggcggtccgagaggcgttattgaatcgatgctgccgggcgtcgtgttcgtggcactgttcgtcatcacgtccaatttgcaactgaccatcggcgtgtccgctgcgttggccgtgctgcaggtgatcgtgcgcctgtgccaacgacagtccgtcatgggagcggtatcaggcttgctggcagtaggtatctgcctgatctgggcatggaacagtcacgaggcacgtaactattacatgttcggatttctcaccaacgccttttacgttgttttgctgacgatttcactgctggtccgggtgcctggcttaggattggtcatcgagttcatccgaacgttaccgactgaacattttcgtgcctggcttgccgattggcgaggtgacaaggcgctcaatcgcgcctataccatcatcaccgcaatgtgggttggagtgttcgcgctgcgtctgatcgtgcaggtgccgctctatctcggcaatcacgtcggctggctgggaacggcgcgtctgctgatgggcattccgttctgggcgctcgcgatttgggtctcgtatctgatcgtggcgacgccaatgcaccgacataagatgatgcaggaagtttctgaagacgatgctgaggcagcacaaactaccgaaatgagggaagagcactgatggaatcgaccatccgcattgaacggtacgccgaccagggtcgttgcgtcggtcatattgacggacgtgttgtgttcgtgcgattcgcattgccgggcgaactggtccgtgtcgcattggacgagccgcatgatcgtgaggatcgcttctggacaggcgaagtggtggaagtactcgaagcgagcgaagaccgtactgatccaatatggtcgttagctggaccccttgccatgggcggtggtgtcggcggcgctgacttggtgcatgtgtcgcttgcagggcaactgaaatggaaagtcacgtcggtggccgaacagatggcaagactcggccacgtcgacgtggaagtgcccattgagcgtatgtcggaagacgatgcggagcgaggtttgcattggcgtactcgcatcgagatgattgctgatgctgatgggcgtccgtcgatgcaccgtcgaggcacgcatgtgcgcgttccgattgataccatgccgttggccagccgtacgttgctggaagtggccgaacgtgagcatgtgtgggaagggagcttcgaaccgggttcccagattcgtctatccgttccggaacctcgcgataatgcgccgatttcagacaattacgccgtgcttgtgaacggcgaggtggttgctggaagccgtgagcttacggaaaaggtgattgtcgccggccgtgaattcgaatacaacgtggatgcaggcggtttctggcagatgcataggcatgcgccgatcgctttgaccaaccatgtgatcgatttggtacgcggcgagcttgacggtgccaaatccgcatgtctgtgggatttgtattccggttcgggtctgttcacgctgccgttggccacgctgacggcggagcgcactcgcatgttgagcgtcgaaggcggcaaaactgcggtaaggaacgcgcaacgtaatttgaggcacattcatctgggtaatgtcgatgcgcgtgtgggcgacgtggcgaaaacacttgccaacgtgcgcaatgatctcgccaagccagatgtggtggtgcttgatccgccccgtgctggcgctcgcgcgaaggtgtgcaggcagattgccgaagccgaagcgaaaagtgtggtctatatcgcatgcgatccggcaagccttgccagagataccgccacgctcgtgttacttggctacgaattggcggatatccgcgcgttcgacatttatcccatgacccatcatgtggagactgtggcgctgttcagaaagcacgaacagtgagcatgccgttattcgcaagtcgtgcgttttttggaatgactgcgattgcgttgtcttgcgcggcgctatctggttgcgtgccgtcgaatgccgcggtgggggatacgcaatctcccaatactgcggtggcgcactccatggaggatcgtgacagcctgtccatcgccatgattggatcggatgatgtcaccgccgattccatggcaatggatgccatggaagccggtaaactcaagccggtgtacattaccgtctcgggcactgtggacgcgcaatccaccgcgcagcaaggcgtgcgtgacatggcgcaacgcaaggccgacctcattatcatcgcaggaatcgacgcgaacgaagccaatgccgaaaactggaatgatgctttggaaaccgcaagaacagcgggcgttccagtggtgcttctcaatcctatcgccgtgccgaaagacaacaaactgtatgcggctaccatgacggtcaacgatcgtatgaccgacgcgataccgctcgacgatgctgctgtggccgtggccaataatgatcctcacgaccgggaaatgctggtaaccacgattacccactgatatggttttgcaccatgtcggtatgaatgaccagcagttcgtcttttgatgaaataccctgaaaattccctgatttttacctgtgtttcacaagaagttgaccggaaaacgggagtgtgacggtagactggcaatcatgagcgaaagtcgaacaatgcccctcatcgaagagacggggctgacacaaggcgaagtgatcgccctcagggaaagcggattggacaatgtggtcaaggcatcgacctcatgttcgcttatcgatatcgtgcgagccaacgtgttcaccttgttcaacggcatcatctttgcggccatggttatggtattgatcactggatcgtggagagacgcggtgttcggcatgatcatcatcatcaataccggcataggcatctgcaccgaattgaaagccaagcgtactcttgacaaactgtcgattctggtggcttccgactatcttgtgcaccgcgacggcaaagacgttgaaataccgcacaacgatatcgtgctcggtgatttcatgtggatccgttccggcgaacaggtgcccgcggacgcgcagatcgtgcacacttggggactggagctggacgaatccatgcttaccggcgaatcacggaccgtacgcaagggcgaaggctgcgatattttctctggatccaccgccatctccggcatggcgttggtgaaagtcaccgccgtaggagagcacagttacgcggccaaacttaccgcacgggcgaaggtttacaggaaaaccgtatccgacctaaacaagggcatcaacacgattctgaaattcatgaccttcctggtggtgccgctctgcgtactgctcatctggtcgcaggtacgcactgttggcggctggaatgtggccatttcgaccggcgaatggcgttccgcggtcatttccgcagtggccggtgtggtcggtatgatcccggaaggcctggtgctgctcacctcgctgaatttcgcgctcgcagccattcgtttggcacgtaagaacacgctggtgcaggagctggaatccgtggagactctcgctcgtgtggattgcctgaaccttgacaaaaccggtactgtcaccgacggcaccatccgactcgattcgttggaattgctgggtgttcgtggccccgacgacatgcgaggcaccgtgaacgagcatgacgtcagacaggctctattcgacctatcgaacgaaggacagcccaacggtacagggcaagcgattctgtctggactacgggaacagggatttgcggacggcactgtcgaggcacgagtaccgttctcgtcggcgcgcaagtggagttcgatctatgacggcaatgcagtgtggacgatgggtgcgccggaagtcattctttcccaaatcaacggcgaccatgccgacatactcaaacaagtcaatgatctcgccaatgacggcaaccgtgtgctgctggtcgcgcgaatctacggtgcagcgcccgacgattacgaaaccgatccaaaactcaatccggcatcgtgccctgtcgcattggtgtgctgttccgaacatattcgcgccgacgccgaagaaacgcttgcatggttccgtgaacaaggcgtgcgttgccgcatcatctctggtgacaatcccgtaaccgtcggcgcgatcgcaagaaaagtgcatctgaccggcgaacatgaaccacgattcatggacgcgcgtgagctgcccgctgacattacggagctggcgcaagtactggaaaacgtggatgtgcttgggcgtgtgctgcccgatcagaaaaaggcgatcgtggaggcattgcatgcaggtgagcatgtggtggcgatgaccggcgacggcgtgaacgacgcgctcgccatcaaagaggccgatctgggtattgcgatgggcaatgctgcgcccgccaccaaggccgtggcacaggtggtgcttgtcgattcgaagttctcacatctgcccgatgtggtggcgcgagggcgtcaggttatggccaatatggaacgtgtggcaagcctattcctcgtgaaaaccgtgtattccgcactgatttcgttgggtgtgatgctgacgcagataccattcccgtatctgcctcgccacatcacatatgtgggtggattgacgattggcatgccggcattcattcttgcgttggctccgaacacgcgtcgttatattccaggattcctgaaacgcgtgctgcattttgctgtgccctgcggtgtggcggtcggattgtcgattttgtccacgtcgtggctgctgccgatattcatgaagtggaatgtgcaggattcgggtgcgcagttggcgatgctgcgtggcgtcaacgcgattattctgctcatgatgggagtgttcgtgcttgcgcgggtggcaaagccgttgcattcgtggcgtggcatattggtattggcctttgccgcaattggattcgggggcatgctcgtaaaaccggtggcgaatttcttcgcgctggtggtgccgaccgggcagatgctggctgcgacggcggtggcaatggtgctttcggcactcgtgttcttgatgtgtttgcgtttggtgccgaaaattccgagtattgtcccatactttaagaagacacgccagagctgaattaacttggctgtatcgtaggcgacgaataatcagctgtgttatacagccaaaaagctcggaggtagcatgtctgtgcgcgacgaccagctcgacaccctgaaggtggacggcaaggattatgaatattaccgcatcgcagatctgccgggcatcgatcatctgccgtattcgttgaaggttctcgtcgagaacctggtacgtaacatcgatggcgccaacatcacggatgatcatgtcaaggcactgttggattgggatccggctgcacagccgagtcatgagatccagttcaccccgtcccgcgtggtcatgcaggatttcaccggcgtgccctgcattgtggatcttgccaccatgcgtgatgcggtcaaggatcttgggggagatcctgaggtcatcaacccgcaggtgcagtccgacatggtcatcgaccattccgtacagatcgacaagtacggcatcgccgacgcggtcgaacagaacatggacatcgaataccagcgcaacggcgaacgttaccagttcctgcgttggggtcagcaggcattcaagaacttccgcgtggtaccgccgggaacgggcatcatccaccaggtcaatatcgaatatctcgccaaggtcatcatgaccaaggtcgaagaaaacggtggcaagactcttgcctatcttgattcctgcgtgggcaccgactcgcacaccaccaccgtcaatggcttgggcgtgctcggttggggcgttggcggcattgaagccgaagcggccatgcttggacagccgatctccatgctggtgccgcgtgttgtcggtttcaagcttaccggttccattcctgaaggcgtcaccgccaccgacgtggtgctgaccatcaccgatatgcttcgccagcatggtgtggtcggcaaattcgtggaattctacggtgatggcatcgcctcggtgccgctggccaaccgtgccaccatcggcaacatgggtccggaattcggctccacctgcggcattttcccaatcgacggcgtcactctcgactatctgcgcttgaccggccgttccgaagaacagatcgcattggtcgaagcgtatgccaaggcgaacaagctgtggggcgacaccaccgatccaaactacgtcgaaccgcagtattccgaatacctggaactcgacctcggtactgtcgtgccgtcgatcgctggcccgaagcgcccgcaggatcgcatcaaactgtctgaatccaaagcgaaattcgtcgaaaccttgcccgcgtacgaaacggacaagaccgtgcaggagccggttgccgtttccaccgacttccgcggtgacttcgacatcaccaacggtgatgtggcgatcgcatccatcacctcgtgcacaaacacatccaatccgtccgtgatgatcgcagccggtttgattgcacgcaacgcgcatgccaagggtttgaagcccaagccgtgggtcaagacctcgctcgcaccgggctcccaggttgtggccgactatcttaaggcggctggcttgcaggacgatctcgacgcgctcggttaccagctggtcggtttcggctgcgccacctgcatcggcaactccggtccgctgctgccggaaatctccgaagccatcaacgccaacgatctgaccgtcacctcagtgctgtcgggcaaccgcaacttcgaaggccgcatcagcccggacgtcaagatgaactacctggcatctccgccgctcgtcatcgcttatgcgctcgctggcaccatggatttcgattttgaaacccagccgcttggcaaggattcggacggcaatgatgtgtatctgaaggatatctggcccaccaatggcgaggttgccgccgtggtggacggtaccgtcagccgtgagatgttcctgaaggattacgcttccgtattcgaaggcgaccgtcgttggaaaggacttgacgttccagaaggcgaactgttcgcatggaatgaggattccacctacgtgcgtaagcagacgttcttcgatggcatgaaggccacaccggatcccgtcgaagacattcatggcgcccgcgtgctcgcactgctcggtgattccgtgaccaccgaccatatttctccagccggcgcgttcaaggcttccagtcctgctggcaagtacctgaccgaccgtggcgtcgaaccgaagaacttcaactcctatggttcccgtcgaggcaatcatgaggtcatggtacgtggcacgttcggcaatatccgactgcgcaaccagttgcttgcgtccgtaggagaagaggtcactccgggcggtttcacctacgatttcctcgaccagaagccgaccacgatcttcgaagcatcccgcgactacatcgaacatgatgttccgctggtggtgctcgcaggcaaagaatacggcaccggttcctcccgcgactgggctgccaagggaaccgtcatgctcggcgtcaaagccgttatcaccgaaagcttcgaacgtatccaccgttcgaacctgatcggcatgggtgtgctgccgttgcagttccccgcaggcgactcctatgagagcctcggccttgatggcaccgaaacgtacgatatcgccggcgttgaagaattcaacaatggcatcaccccgaagaccgtgcgtgtcaccgccacccatagcgacggttccacaaccgaattcgacgcggtcgtacgcatcgacaccccaggcgaggccgactactaccgcaacgggggcatcctccagtatgtgctgcgcaatctcatgaaataaataatcacatgattgagatcggcaagtgacaaagcccgtgtcgcactgtgcaatgcagtatgacacgggctttgtcgataccggtttttcatgcgtttgatactacgtcggaatcggtctgtctcgtcacattgttgacccaacgatactttcgataatgcagcaaagcaggaatcatcttgatgcattcgtcggtattcagcaaagcatagaccgccaataccggcaacttccacacgaaagccgccaacagaccgaccggtacgacgacaagccacataacgctcgcatcgcagacaagtccgaaccgggaatcgcctccggcagggaaaataccggcgatagtcagattggccatgcacccgcatgccgcataataggcgcagataaacagcataaccgacagataacgcgtggcctgcggcgtcaatcccgcccactgcaacgccaaaggacgtgccgcgataatcaacaggccggttccaacgccaactgccgccaccagtacacagagcctgtcgcccataaccttcgcctgatcgaaagcattgcggccaagcagattaccgacaagaatgccgcccgcattgccaaggccaagactcaaacagaccaacagatccttgacgatattcgcaatggaattggccgccaccgcatccgtaccaagatgacccataatcacggtgtacatggtgaaaccgcagccccaaaccagctcattgccaagcacgggcagactatacttccaaaaatccttctgcaacgccacatccggatgcaacatcatcgacaaccgcaaacgtgggcggccattgcggctggctacaagcacagaccacaccagttcgatggctcgggaaatcaccgtggaaatcgccgcgccgaaaatacccaatgcgggtaaaccgaaccaaccatagatcagcaccgcgttcagcgcaacatgcacgatcacgccaaccgtgcttaccgtcattccggtaaccgccgcacccacattcttcatcagacacaaatacatttgcgacaaaccgatgaacaggtacgaaaccgacgaaacccgcaaatactgtgagccgatggcaatcagcgtcgcatcgttcgtcataatcgacatcaacgtttccggaatgagtagcgtcaatgcgaaaaacaccagcgacaatccgccggcatacagcatgatgaacgccaagacacgttcgacggcattcgtgttgcccgcaccccaatactgggccaccagaatgctcatgccaagcgtgagcgcggcaagacacaaactgaaaatgaactggaactgcgtggcaagagacactgccgacagctcgttttgaccgacgttcgtcagcataagagtgtcggcgcacgatgacagcgccagcatcagttgttgaaacgcgatgggcagggcgagcgtcaacgtctgtcgaagaaactcgcgccaagtgatggaagattgcatgatgatgtgaggatggtgcggtgcgttttactgaatcgaatccttccaagcgtgatattccgctgccttgccttcccaatattcgcggtcggcgtcggtgatctcacggatcacatggcatggattgccgactgccaccgaatgcgaaggaatgtccttgaccaccactgatccggcaccgatcaccacatcatcgccgatggtgacgccagggccgaccaccacattgccgccgaaccagacatcgttgccaatggtgatcggacgagcgccttcagggccggaggaacgcaccgtcgcatcgatcggatgatacggcgtgtacaggcccactcgggggccgaagaacacgcggtcgccgatggtgatgcgtgccacgtcaaggaaaatgcaatccatgttggcatagaaattcttgccgatgaacgtgttgcatccataatcgcagttgaatgggggttccacgaatccaccctctccaaatgcgccgaacagttcgtgaaacagttcgtcacgttctttgaacgcgtcatattcggacgtgttgatggcctgcaccaggcgacgcttgcgcatattcgcttcctgctgttgcggactatcggccacatacagttcgccggagagcatacgctcccattcgtcgcgtgccggatgattggtggggtccaccatgctgcctcctctgctgtattacgtcaatcgattgacgtgacatatcatgttccattcaacggcatcattattcgttgacactgtatttcgttgtattatcgttcttgattttcgtattatttaccgtatccactgatggggtattgcatgggacagatgggattagacgttcgtgacgtgcaggtcggacaaaacgaacaaacggaacagcctgaacttgcgcaagacggtcgtcttccatatgagttcatgccggtcaccaactggggacgcaagcccaacggcgcggaaatggtgcaatatgatgcgccgatgttcttctcattcaccgaacattcgctgctgcatcagtatccgaacatgcgcgcggaatgccattggcatatcgatttcgaattcacccacatcatccgtggacacatgtggtatttcgtgaacggcgaaagcattcgtcttgaagaaggccaaggcattttcgtgaattcgcgccaattgcattacggtttcaccgaggacggcaccgattgcgaattttcctgcactctgctgaacccttcatgcatgtgcatgccgaacatggtttatgaacgctttgtggctccgttgatggcggacgaacggctcccgtacatggtgtgtgatcctgaagatgagcatggatccgcgttgctggaatgcatgatgcggctgcatgatgcgaaattcggtcagatgccggctgcccagaccatgcatcccgccaccgttgacaatatgaaattaaaggatgatacggcatcgttgaccgtgctcagctgtttttatacgatggtgcgtgaactgacggccatagcgggcgaacatggcaagaatggttcttccaaatacgacaggaagaatccgaagattgctattttgagcaagatgattgattacgtgcagcacaattacgttcgacagatcaccctggaggagattgcttcagcagggtccgtcggccgtacgaaatgcgcgcagatcttccatgagatggtcgatcagacgccgattgaattcgtcaatgacgtgcgtatgagagctggagcggaaatgctggacaccacatcgatgccggtttccgacatcgccaaaaaacttggtttctcatcatcgacattcttcacgcgcacgttcaagcagtacatgcatacgacgcccacagcctaccggaggaatatgctcaagtagaccgtggacgtcgtatgcgatcgtcatgcggctgccacagtgttggcgtcgactacttggccaactgcgttgtggcgggggaggccaacgtcgggcgggctcgccgaatgcgtcccaaggccaagcccagacagatgaacgctaccgcgaacattgccaccaatccggttgatgacgcccacgcgccgtagtccacgccgctcgaggaggccgtacccagtccgaatacgtggtctatcgatgagcagagccaccatccaggcagcagttttccgatgatgatcatgggatctggcatcatatccacggggaacgccataccggaagtgaacatgaccagcagagcgaacacattgacgaaaccgttcgttgccatttcattgaaaccggatgaccccaacaggaatccgcaagcgatcgccataagcgtgtagaccatcagcgacacgaacgacaagcctacgttcacggcattcaggccggtaaaggacactccggccagcgccatcaacaggaatgtcaccgcggtatacgcagcacataccagcagaccgaacgtcccgcatgtcagcatttgctgcgcttccaacgacaccagacgcgcgggggacgagtagagcctgcggcggatttcgttgtcgttgaatgtgctgaccacgaggaacgtgcataccggcatgaccagcaacagtggatacaagccggttttgagcgtgcccgcgaatgccgatgagcccggtgtggtgccgtcgtcttcagagtccgaggacaccacggcgatatgcgactgtttcatatcggcggtggcagcatccaacgtcgttgtcatggcggcgtcgagcgtgcgctgtgcctgcggcatgccgagataggcggtacgcgtcagcgaaagaaactcgttgactttcagctgtgcgagcgatccggctccggaagcataactgacgacggtatctatggtcggttgcgtagccgtggcgttatccgcatactgcagataacgctcggcgaaaccttgtggcacaatcgcaatcaaatcaacataattcgatgcgacagcctgctgcaacgatatggaatcgtcatcaatggtgaccatctcaccgtccaaagcgaggtaggaacgcaacgattgagccacatgctcggcgtcgtcatcacggtcgattaccgcaatacgggcggattccggctcatacgtcgtcgctccggcagctgtggagccacgcatgatctgccagctgatggaaaacatcatcgtgccgatcagcaccaagtagataatcacatacaatttgcgcgctttgagaatacgcagtgctgctttacaagtgttcatagcgttgcctcctcaacagaacggtcgccataccaagacagaccaagctcatcgcagccaatacgcccaccgtggcaaagaacgggcggaaactgtcgtaatacagaatgtcgtagaacagattcgtaatctgttgcgccggattcaacatgctcaacaggggcgcatgctgcgctatctgatcgcttaaatccatggcgaacgagccatacaaaccggaaaacagcgacagcgtgcatgccaaggccgtgcacaatccctgcttggcactcgtggaaacaccctgtattgcgccgatcaacgtgccgaacgcgcttgtggcgaatgacgccatcaagcacgcgcccaagccggcccattcacgaccgccgagagaaatctggcagccgaaacgaatgtacagcatggccacggtcagacttaggaacgagcagatccaactggaaagaaaacctgccagcagctgttgcagtttcggcaggggagcgacggaacggcgaatgccaagtgccgacaggtttgcctgggccaacgataccgcgttcaccgcgaaactcatggccatcatcgcggccatgccgagcaacgcgtaatagtagcgtgcggtgccgcttggcttgaaattcgtcagctgcacttccttcgtgaacccactcgacgagccgatgctgccggtgaacgcgtcatccaacaacgcggacggattgtgctgcgcggcattgaccaccacggcggtgttgcgattgtacaagtccacgatattgcccaacaccgtcagggaaatatccagaccactgctcgacgccatcacatccgtggcggatgtttgcgtggcttgggaaatggccagctgcagtttcccactaccgtcgacggacagtctgccctgcgccttggcgtcaagcagtgctcgatccgcggcttccatagatgcggcttccgtgacggtgatgagtttcggcatggcgtcaccgtcatcatcgaccttcgcatgatcgccatcggcaccggtcgcgccagtatcggacgaaatgccgtcgaccagcatctgcgcgcccggagaggcgcgccaatcgtcgttattaaccacgacgacgtcaaccgtgtgcaatgcgtaactttccgcgatattgccgaacatgccattgaacatggtcgccagaatgatgggaaaggcaaacagccagaacagctgcgctttctccctgaaatgcaatttcagattgaccagcaatgtctgcaacataatgtcaaacctttcgaaccatgattccgtcagtcacgcaacgccgtgccggtcagttcaaggaacacatcgttcagcgtcggctgccgggaggaaagatgcccgatattcgtgccattggatttcagcaacgtcaacacgtcaagaagattgtgatcgccccgacggcaacgtaccgtcaactcatgaccgtcataatcggcgctcatcacacatggcagcgcacgtaactgttccaatgcctgctgcgttcccgcctcatgatgcaagccacccagatcgtcggtttccacactgatgcgttcgccggtgtcgatcatcgccttcaactcgtcggcggtgcccaaggccaaatgcctgccatgatccatgatgagaatgcggtcgcagatctgctcgacctcctccatgtaatggctcgtgtaaatcactgtcgcgccttcgtggttaagacgctgaatgccctccagaatcgcattgcggctttgcggatcgacggcgacggtcggctcatcgaagaaaatcagatccggcttatgcgccacaccgcatgcgatgttcaatcgacgaagcaaacctcccgacaatttcgacggacggaacctgcggtaatcgcgcaagcccacaaaatccagcgcatcctcaaccagcgcatgacggcgtgccctgtcaggcacatacagcgagcagaaataatcgatattctcctcaaccgtcaattcattgaacacagccacattctgcggtacgatgccgatgcggcgtttcagcgcataactggtcgggccaatcggttcgtcaaacacacgtaccgtgccctcatcgaacgtcaacaatgcgagaatgcagttaatcgccgtggtcttgccggaaccgttcggtccaagcaaaccgaaaatctcaccttgatgcacgtcaagatcgaaatagtcaagcgccagcatatccccataccgtttgaccagcttcgacaccttgaccgcgctgctggagctctcacctgtttgcctttccatacgctcgctcatcggctctccttacctcacatgttccaacagcgataaccgccgtttacgatagtgattccattgtctccgaccaaacggagacgacatggtgtctgagatcataaacctggcgcaacacagccatatggaagatgacaaatgtcaccttcgtggcaaagatggcccgcaacggcggcaacgtacactacgctgggaagacataaccacaagaagcggcgacgatggaggaaggcatgcggcgattattgcttcaggccatattcctcacgttcgggctgatcgcaaacctgtatatcgtcggagacgtatcggctgaactggtatgcggcgcgttgctggccatatgctgtgccgcggtgggggaatacgcgcgctcgtcggcatggaccatcgccatactgttgatgttggattgcggcgcatgcttcacgccatcatggtgcgcgatgatgccggtcgccgcatacaacgcggccatgctgcccgccatatcacagaacgtcgaacaacaccgtgcgggacggaaccatgccggcttgcgttcgcaattgccgaacatgccgcaatacgatgcgatgcaaatcacgacggtcatcgcacgatgggtgtggatcattcccgtagtggcgaccttggtccgttgccgtaatgcaggcgcgcatgcggatgatatgggagctgcactcatcgccgtactgctggcattgcatgtagtgttgggattcatggttggcctgttgtgcgcgcgcaatgtcacgctcacccggcagaacaggcggcttcaggattccaaacgtgaccagatccgccggctgcgctcgcaattggcggaaagcgaggaagatcgcgccgcgtcggttcgtgtggccacgctcgcggagcgtacacgcatagcgcgcgagattcatgacaatgtcggccatatgcttacccgggccatcatgcagtccgaagcggcccaagtggtggctcaggtttctggtcaggagccggcggctcaagggttcgcgcagattcacgacacggtgggcgaggcgatgacattggtgcggggcgcggtgcatgatctgaaagacgaaggcacggatttcgtggcgcagattgaggcatccgcgcatggtttggacgattccagtacagtgaacgtcaccttgagcaacggcatcgatgcggctccggccgcggtgtcacgctgtttcgccacgacgattcgcgaggcgttgaacaatacgattcgccatagcatggcgcgcaatgtcgatatcaccttgcgtgattttcctgcgttatggcagctgcgcatacaggatgatggcgccctgtggaacgatggctcccaaggaaacatcaacggtatgatgggggagtcttccgctcgttttcgtcagttccatgatgccgcgcgtacggcgacgatgcgtgatgcttcgggcattggattggcggatatcgaggagcgtgcgcgggcgctcggcggtaccgcggtgtgcggcccgtatcatgaggggtggcgggtgttcgtgtccattcccaaaacggacgatgatgcggcagcgtccgcaacaacgaaggagaacgtatgatgcgagtcgcaatcgtcgatgatgatccaatcgtatgctcgtcgctgtccacgattctcaaagcgacaggcacggccgatattgcatggacggcctatgatggcgaaaccgcggtaggtcagtatgaagaagataatccggacgtgctgctgatcgacgtgcaaatgccggttatggacggtcttgccgcgtcgcgaaagatcatcgacgcccatccgaatgcgaaaatcctgatacttaccacattcgcggacgaatcgtacatcgccgaggcgttggaaatcggcaccaaaggctatctgatcaaacaggatgtctcatcggtgattcccgcagtgcagtcggtgatggccggacaggtggttatgggagcgcaggtgttgcggaaactgcatgtcaataaagcgagtcagacgcagcgtcacgtttcgcaagctggcgataacggggaaaatcgtttttccggtcgtttcgcgaatctcactgagcgcgagcgggacgtgatgcaactggtcgccgaggggtacgacaatcgtgagatcgctgcgaaactgtttttaagcgaaggcacggttcgcaatcgtatcagcgatattctcgcgaaaacgaacgttacgaatcgtacgaaacttgcggtcgaatggctcgcatgccaataggaaaccgtcgataaacggcaaactcatcaaaacgaacaacgttttcagcgcttgcgtaggcgataggccttccacacgtcgctaagcttctgaccgttcgacgtgcgcttccacacggtcaatcccgccgaaccgccaccgacggcacgggccgctgcggttggtgtggagtactcgctgccgtcatccagtcgaagcttgccttcggcggtgacggtagccacccaacgttcgcccttgcgcggtcggtcccataccagcgtctcaccgggaatgagcagaccagcggcgagcacctgcgcgatggacacgcgtttggatgttggggaggtggacgtgtccgtgactcgcaacgactcctcactgagcgtggataggtcattgcgctcggcatcgtaacggatattccaataatcggcgatcagacgaatggtttcatcctggcggtattgcaaggtttgtggcgtacagtccgcaatgtcggcaagctcggcggtgagcgggaagcgtttggaactcgccgacagcagcatacggtcacgacggtccgtataggatgccaatcccgcgatctgcttgtcattagcctgactgagcgcaagattgccgatgcggttgacccaatggtcgcgcgtcgcctcagaccatgatgcaaacgatgagtcggaggcgacctgttccggcatgatcggcagcgcgttgaggctgcgtggtcgggcgatacgatgcccggcccgctgctcgttggcccgaaccagaagcagtttcttcatggcgggactggtctgcaggtcgccacgcagatgcgcgagcgcgttgcggcggtcttcgtcggtgatgagtaatcctcggatttgttggatggtgtggtttttatcgaggtcgcgaatggtgctggctgcgcgtgtgcgtcggttgagcggggtttgcctgttgagactgtccacgccggttacgcgttctagggccgcgagtacgtcgtgaagtcgttcaaggtcgtggagttgaggttcctcgaggtttttgttcgacgtgcgcgaggctgcggcagtgtgtgtgcccggcgtggagaatatgcgtgtgtcgggattgccgaggttgcgtatggagttgacgagcgcccacatggctactggtttccagtcggtggtttggtagtcgttgagggatacgagttggccaatgatatcgtctggcaggttggcgtcggtcgggtgttcgatgatgcgccaggcgttggcgtagggtgcgagcaggtcgtcgatgaaggagatgacgttctgctttttgacgaatggtttgagcacgtccttgcggaattcctcaagtagttgtgtgcagatggctttgtgcgagatgatgagatggatgtcgctgaagaattcttcgagcgtctgtgcgtcgtcgccgagtggatccatgatgtcgtcccagcgtgaagcgtaggcgttgcgtgcggcgggggagatttcggcgatagttcttgctttgaacacgtcggatgcggtgaggggaactccgcgcatgttcatgacgtcgaaaatacggtgtgcgccggcgagatcgtcggtggttacgatgacgagggtgacttcgttgacgaggtatgatgcgaatgcgcggcggtcttgtgtgggcattttcgcgagttcgtcgaacacttgtctggtgttgatggcgatgttgcgttgcgcgtgcgattcgatatcgttgtcgcgcagatcgaacagtccctccagatcgccttcctgcacgtacatgcggaagaagttggtgtcgcgttcgcggagtttgagacgtggttcggctttgatgccgcgtagtttgtctcctggctcgacgatgaggtcgttgaggttttccacgagttcggggtcgtcttccagatcgcggagcacggaaatgatgatggaaagtgagatgaggcgttgctgtccatcgatgacttggtatttggtctgtccatcatggacgaggatcagcgatccaaggaaatacggcgtgtccgggtcgtggcatgcgtcctgcagatcggtgaccagttgcgcgatgttttccgtttgccaagtatatgcgcgttggaatgatgggattacgaaccggtaatccgaagtgaagattttgcctaaaggcttttccgttgcactgattgacatggcgttcccctcattgcgttgctctgtgttcaagtgtacgatgcatgatgtcatagtcgtggcggcaggtcggctcgttctaccaaacgggccatctgcacgcggcccatgcagagtttatctgcggcggatgaaatatgcgctttgaccgtgcgttctgaaatgaacattttctcgctgatttccgcattggtgaagccctcggccgcgagaatcaccgcttcgcgttcgcgttccggcaaggcgtcgagcatggcacgggcctcatcgcgccgcgactgaggctggtgttgatgcaaatcgccgatgagctgccgttgacttgccggattgaactgtggctccccttcgcacacgtcggccacacggcggatgatatcttccggagcgtccgttttcgatacgaatccttccgcgcccgcttcgatggcgcgttccaccgtgttgtttggactcagcgacgtcagaataagcacatgcggaggatcgggaagcatgcggagctgacgagtggcttcaatgccatccatgccgggcatggcgatatcagccagcacgacatcaggaggattgtgcgacgcatgttcgatggcgtctgctgcgttggtgcaggcgaaggcaacgctgatgcgtccggaggaataatcctccaaaatcagacgcatcatctggcagatcatcggatcatcatcaatcacgccgacggtgatcggctgctcgtcatggttgcgttcggtgctcacccaacccatggtagtcgtacatcaaggtggaagacgttatgttggtcaaaaccgtattggcatgttccgccagcctgctgtatgcgtttggccaaaccaggaagaccggcccccttcctggtgtctgccatatgcgagggggattgcggcatcgtcggattgctgacgtgcacatgcaccccttgcggggggttcgcatcgacctgcaacgacaccggagcgccaggcgcatgcctgcgcacattggtcaatccctcctgtaccacgtgatacgcaatcacgccgatggactcatctaactgccccagctgttgaacgtcgatccacgtatcaatccgcatattcgcggcacgggcgtcgccaatcaactgcagcaatgagtcacgggtcaacgacgcttcggcatcattcgcagccaactgcaggcgagcatcctccggatgacgaagcatgtcaatcacactatgcgcctcatccaacgcgccggaggcctgcctgcgaatatcctcggtagtgccggcgatctttccagccataccagccacattggcattgcccaactgctcggcctcagccttcaatttcctagactcggcctgcaaagcgctcgcattcaatgcaagcaacgacagcgaatgagccaacgtatcatgcgcttccgcggctatcgcatcggcaagctgctgattgtcaagcgtggtccgcaacctgctcacctgctcgttggccgactgagccttcgcttcggccacgcgcgcaagggcgcgcgagcgaatatgcaatccggccaatgtggcgatcgccaccgcaatcagggcaaccacaacggcgctcgcgatgatcgttctttcgtcgacaagcatcaccatggtattgccataccgaactccggtatatggtttggagaagatcgcatgccagatcgaagcctcggcaggatgcaaagcgtctcgcacctgggaccagatcgtcgttgtcgccgcggcaagcactgatcgaagcgtcactttggttccctgtctccgcgcaagcagagaagtcaacgccataagcgcgatcagcgaatcgtaggggagcgccaccaccagtaggcatgcggtccagaacacggcttgcgggtaactgttgcgagccagaagaatcaaacccgaagggatcgcaacgagcacgcacgcgatcatccacaagtagggggcactatcctgcgcatactgttgggatgcgaaagacacctgcgccagacaggcgaaactcgcgcacaccaccatcggcaccgtgcaccagattctggtgcgcactggcacttcggcggtggaagggtttgtgatcacgctcatgactcccattatcggcatactcatggaaacatgccattgagctatcgggcatgatggcgcaagccgcgcgccccaaagtgcaggcaggaatggactttcgtccaataccgggaacgaagccgatcccgtaggctcgaaagtgttccgaccacttcgagaagaaagaaaaagatcatgagtgagttcaacaatgctccgattcccaacggcggcccggcagcgccgaacggtatgagacccgcgccgatcatgccgtccccggctccgcaaggcacgacggtatgtggcatcgtgggagtggtgttcggcgcgctcggcttggtgctgagcttcattccaatcatcaacaacatcgctgcgatcttcggactcgtcggcgcggtattggcgatcgtggccatcgtgggcacgttccgaggcaaaaagcgtggcaaagccctgtccatagtcgcggcggtgctgtcggtgttggccatcgtcatcaccttggccatgcaatcggccgccagcaaggcgcttgacgacatcacgggcacaagcacgtcgcaatcctcgtcggcggacgccgataaggacgccaaaaccgatgattccaccaaaaccgatgattccaccaaaaccgacaccaaggtgaaaggcgagcaagacatggaaggcgatctcaccgatatgcacgtcaaaatcgtatccgcagtgcgttccggcaacgactacaacaatcagccgaccgtgctcgtcacctacgagtggaccaacactaccgataagaacaactccttcgccatgctggctaatccgaaagtgttccaaaacggtcaggaactcgacaccgccatgtacttggacaatccggaaggctacgattccggctcctatctgtctgaactgcagccaggagcaaccggcacggtaaccctcggatatgtgcttaaagacgattccgaaatcaccgtcgacgtgacgaaccttctcgatttcagcgacaccgccaaagtgacgtacaagttcgccatctgacatggcatgtcccagtctttcgcgtccggcacactccccgtgtcgaacgcgaaacctatgcgggctttgaagaaatcatgagattaagccaatattcatgaaatcgtcaggaaaatgccgtatcgtgatgcgcaatcgagcaaaaaggagcgattatggcattcggtcagcagccccagggtaacaacgcccagaataacggcttcaacaatcaataccagtacaaccaacagtacaaccagtacaatgcgcagccacagtacgcctatgcgcccaacggtaccgccgcagtcaacgtgcaggccacctattcctacgagcaggccgaacgcagttccgtcaacagcgcatacacgcacatgacccttggtttgatcgtcactgccgtggtcgccatcatcacccaaatgagcggcgcgtacctggcactcatccaaaccacgggcatcatcggcatcttcgcccccgccgtcattgaaatcgtgcttgccatctaccttggcgcgcgcatccatacaatgaaggtctccaccgcatacgtcatgttctacgtgtatgcggcgctcatgggcttcaccctcagcaccatcttcatggcctacgatcttggcaccatcggcatttccctcgcattgtgcgccggcttcttcttcgcgctcaccatgttcggacgcaccaccaagatcaacatgctcaaggccggccccatccttttcgtcggcctcatcgtgcttatcatcgccgaagtgattctcatgatcttcgcccccggcaacaccaccctcatgatcgtctctgccatcggacttctgctcttcgccggcatgaccgtctacgacgcccaagccacccgcgccatgcttgaacagtattccgcccaaggccccgaaatggtcaagaaggtttccatcctttgcgcactgaatctgtatttggatttcgtgaacatgttcatgtatattctccaactcctcggcaatcgcgactgaaatccaaatgacggagcgtccccggcattgctcctcagtcggcgtaccttcgtgcgccttccttcggtgcgttttggggacgcacgcgtcatttggctttcagcctttgatgggacattattggcattgctcctcggtcaacgtaacggataaagcctgaccagaatgtggccaggctttatccgttggtcaaagacatgctttacggtgggtgctcatgcagagaaaagagattggcggcatggcatgcctcgtactggcggccctcatttggggattcgcattcgtgtcgcaagtgcaaggcatggactccacaacaccgctgttcttcggagccacccgattcaccctcggatccatttctctgataccgttgctttggtttcgccgcagcaccatagcggaacaagagcgtaaacgccgtgaaacccagggaaaaccgtccatcaccctcggtaacggcgcaatcgtcgccatgccgaaatgggccggcaatcccatcgtggtcagcatcatctgcggaatcgtgcttttcaccgcaagcaccgtccaacaatacggcatcctttactccggatcggcgggacggtccggcttcatcaccgctctatacatcgtcatgacgccactgcttgccttcgtcatattgcgtcgacgagtgcacctcagcgtcatcatcagcgtcgccatctccgttatcggcttctacctgctgtgcgtcaccgacggattcggatccatcaccctggcggacatggtgctgctgttcaccgcagtcctcttcgccgggcacatcctcgtcatagacacctttggacgagacatggaccccatcttgctttcattcgggcagatcaccaccaccgcgatcatcagctggattggctctatcatcgaaggatccatcgactgggccggtgccgcgcaaagctggatcgccatcgtctacgcgggcgtctgctctgctggcgtagcctatacgcttcaggtcataggccaacaacttgtgcctccgaccagagcgtccgtgatcatgtcgctcgaatcgttcttctccgcagtcggaggggcgcttctgctgggcgaaatcatgaccactcgagcctacctcggctgcgcgctcattttcgcgggcaccatactcgcccagctgcccatcgaccagctcctgcatgcggccaaacgcaaaccggcagacgtcagccggccttaggggcctcgccaacctgcggcgcgccattgatatcgcgatgaatgttctgcatctgcgcttcgacattctgcagacttctcgcgcaatcaagcaacgtctgcgaatgctccgacagcttcgcgtcaggcaaatccgtcttataacgcagcgcatgctccaaactcgcccaataatccatggcgatggtgcggaactgcacctccacaggcgtgtaatgcggtccggaagatagaaaaacgggaaccgcataaatcacgtgcagcgaacgatatccattctgcttcggattcttaatataatccttcacacgcaacacctgaatatcgttctgcgcggacagataattcgacaccgaatacacgtcatcgcgataattgcagatcacgcgaatgcctgccacgtcaaacagattgtccttgaccgactccaccgtcaacggcagatccttgcgcctcaacttgccgagaatggaattgatggacttcaacctgcgttccatgtgatggatgggattatgggagaaacgcacctggaactcggaatcgagaatctccagtttggtgctgatctcatacatcgcgccctcatacacctgcatttgatcaatgaactcggtaatctgatcggaaggcaacggaccatcgtcgaaagtcaccgacttcagccgtgcttgcagttcactggtattgatgcggctctgtctatcaagtatcacggttccatagtgtacccaaaaggagcgcggaaaaactgaaaaagcgctgaaagcgccgtcatccctccaattccaccgcatgccacgctgcattaaggtgcatacggcgcgtgatgggaatccctgccgatagcatggaatgctatgaacgaagacatgatgaccgaggcggagcgcgcctcgaaacttgcggaacctgccacagaagacaccgccacgcgaggcaagggcgtgttctacgtacacaccctcggatgccagatgaacgtgcacgattccgaacgcatcgcgggtgtgctcgaagcggatggctatgtgcccgccaccgaagaacaatacctcgatcatgacgtggacctcatcgtcatgaacacatgcgcggtgcgagaaaacgcggcggaacgcatgtacggcaccatcggcctgtgggccgaactgaagcgccagcgtccgaacctgcagatcgcagtcggcggatgcatggcacagctcgaccgtgagaagatcgcaaaaaaggccccttgggtcgatgccgtgttcggtaccaagaacattggctccctgcctcagctgcttgaccaggcgcgcatcgaaggccatgcgcaggtcaaggtcaaagaggaactcaactacttcccaagccagctgcccaccgaccgcgcgtcgaaggtgtcaagctgggtggccatctccgtgggatgcaacaacacctgcacgttctgcatcgtgcctaccacccgaggcaaggaacatgatcgtcgcccgggagacattcttgccgaaatccgccagtgcgtggacgaaggagccaaggaagtcacgctactcggccagaacgtgaactcgttcggttacggcatcggcgaccgtttcgccttctccaagctactgcgcgcatgcggtgagatcgaaggattggagcgcgtgcggttcacttcgccgcatcccgccgccttcaccgacgacgtgatcgcagccatggccgaaacgcccaatgtcatgcaccagctgcacttcccgctgcagtccggatccgaccgaatcctgcgcgccatgcgccgttcgtatcgttccgcgaagttccttgacattctgcgtaaaatccgtgaggccatgccggatgcgcagatctccaccgacatcatcgtcggtttcccgggtgaaaccgaagaggacttccagaaaaccttgcgtgtggtggaagaggcgagattcgcgtccgcattcaccttcatctattcgccgcgcccaggcactccggcagccgaaatggagcaggtgccgcacgacgtggtccaagaccggttcgaacgactcgtggcattgcaggaacgcatcaccgaagaaaatctcaaaaccttcgaaggccgtgacgtcgaagtgatggtcaccggcgcatctggcaagaaggacgccgcgacccatcgtgtcaccgggcgcgagaaaaccggcgtgctcgtgcatgtcggtgtgcccgaaggcgagccgatgccgcaggtaggcgatttcgtgaccgccaccatcacccacgctgggcgtcacaacctcatcgccgatcccgatctgaaggcggggcagacctatgccgttcgacactgaacagacctctgagaaaacagacaaaacaggagacgccgatcctgccatgcagcgcaaggtcgtatccattgtcggaccaaccgcatccggcaaaaccgggttgggcattgccgtcgccaaagcgttggcgcgcaaaggcgaacaggcggaaatcatcaacgccgacgcataccagatgtatcggggcatggatatcggcacggccaaggcaagccttgaggagcaggcgcaggtcaggcatcatctcatcgatatcatcgaaccggacgacgccatgtccgtggcgaggttccaagagctcgcccgcgagaaaatagccgaactacaggccaggggagtgcgtccgatcctcgtcggaggctctggcctgtacgcacgggccgccatcgacgacatctccttccccggcaccgatccgcaagtacgcaaggcgcttgaggaacgggaaaaaaccgaaggcgcgggcgcgttgttcgacgagctgaaagccaaggatcccgaagcggcggcgcgcatggacccgcacaatccgagacgaaccatccgcgcgctggaagtcatcgaagtgacgggacgaccctattcggcaagccttccgcactaccggtacgtcatccccaccgtgcaaatcggtctcgatctgccgcgtgaggaactggaccgtcgtatcgatattcgcaccaagcagatgctcgaaggcggattcatcgaagaagtggaacgtatccgtcccaagctgggcatcaccgcagccaaagcgctcggttaccagcaggtcgtcgactatttggacgggttgcgtgacctgaacgacacgttcatggacattgcgcagaaaacgaagcgtctggcacgcaagcagatgggatggttcggtcgtgacccgcgcatccactggctccaagcgctcaatccggcgctgctagacaacgcgatggccatcatcgaacatgccgatgcaggtgcctatgacgtcatagacgcacaggcggacgcctacacccagcatcatctcggagacctcgcctgaaatgaaactcccgctgccgtattcgtcgaagctttccaccttatccacggtcttctccggcttggcctccagattgacggtgacgatcttggcggaatccaatcagtgaaattgcgtgttcacttaagttagaaaatgtgtgcgattcgaggaagtgccatgtcatggcgcctcccatgggtaaaatcatgaccgttatggcacgaacagcatcttccaatacgaaatccggcggcaaagggtccacgggcaaggcacgttccggcgagaccaaggtcatggacgcggtcgagccgtcgcctgtgatgggtgtcttgaccaagtacggacgtgatatcgcatgttttattctggtgattctcgcggtaatgttctgcgcttcggaatggttccgggtgcagggcgtgttcggccggatgctccacgccttggcttccggcctgtttggtctgatgagcgtcatcctgccggtctttttggcgctggtggcattcagcctcatatatgagaccaagcgcaaaagcggcaatgtgcgtatggtggcggggtggtccatgattctgtggtccgtctgctccatactcgatgcggcgctcgcgtccgacgcccaaggtttcgacatggcgttgctgcagaatgcgggaggtctgctcggctatgtgcttggctgcccgctggcatgggggctttccaaggcgttcgccatcgttattttcgtggtcgtcattttgttctcgttgttgctgattaccaatacaggggttcaagagattcccgacaaagtacgtgcattgaaggtccgttttggattcggtgcaaataaaaaggttgatgacgagaccgagcaattcccgaacgaagtgcgtataggagataccacgctgtcgttcgcagaaggcgtgccggcgcataatggagccgacgatgtggcggctgaaaagaagaagccgatgccgttctccctcataaagcaatggatatcatcgaaatccaagaagcagggcgctcaggacggactcgatcattacgacggtgatgaggcgtttcgtaatgctgccgaacggcatggcgaaacggcggaaaccatgcttgacgaaccataccagagcgtctcgcggccgcgcagcatttcatccgacgaacattccgctcaggatttcggtggaaccgtcgccatgccgcagacgcctgtggtgcgttccctttcctctgacccaatcggtttggcgagcggcaccatgccgcagatcccggaaaccattccgacggttgccggccaggcggcgtccgacgagatcaaatccgttggcgtggctgtaggggacccgtgggccgtcatcgacgaggacggcacgtccaacgggtcgcaggtcatggtcgatgcggcgaccaatgaggtcgtgaacgatctggatgccggatcgaacggagagggcgtttccgacgagtccggtgagattccggagggcccctatcatctgcctgatctcggcatgctgaagcaaggcgcgccgcatgccgtgcacactccggagaacgatcgtgtgatccgcgctcttacggtcacattccagcagttcaatgtcgacgctaaagtcatcggctttctgcgaggcccatccgtgaccatgtatgaggtggagcttggtccgggtgtgaaagtggagaaggtcaccaatctgcagaagaacatcgcctacgcggtggccagttccgacgtgcgcatcctgtcggtgatcgaaggcaagtccgccatcggcatcgaaataccgaacaccgaccgtgaaaccgtggtgcttggcgatgtgcttcgttcggacaaggcgagaaacgatccgaatccgatgctcacaggcgtgggcaaggatgtggaaggccattttgtaacggcggacctcactaagatgccgcatcttctggtggcaggcgccaccggttccggtaagtccagcttcatcaactccatgctgacatccgtgatcatgagggcgacgccggatcaggtgcgcatgatcatggtcgatccgaagcgagtggaactatcggcatacgcgggtattccacatctgctcacgccgatcatcaccgatccgaagaaggctgcgcaggcgctcgaatgggtggtcaaggagatggatgctcgttacagcgatcttgaattcttcggattccgccatatcaaggacttcaatgctgccgtgcgcgccggcaaggtgcatgcccctgccggatcgaagcgcaaggtcgctccatatccgtacattctggtggtcgtcgacgagatggccgatctgatgatggtggccaagaatgatgtggaaagctccatccaacgcatcacgcagctggcacgagctgcaggcgtgcatctggtgctcgccacccagcgtccatcggtcgatgtggtcaccggcctgatcaaggcgaacattccttcgcgtttggcgttcgcgacctcgtcggccactgattctcgagtcattctcgactccactggcgcggaaactctgattggacagggcgatgcgctgttcctgccgatgggacaggccaaaccgttgcgtgtgcagggcgcatgggtcgacgagtcggagatccgacgtgccgtggaattcgtacgcacccagcgcaagccacattaccgtgaggatatcgaggaaatggccaaggaagccgacaagaaggccattgagccggacgaagacatcggcggcgatatggatgtgcttctgcaggcggcggaactggtcgtcacctcgcagttcggttccacgtccatgttgcagcgcaaactgcgtgtcggattcgccaaggctggccgccttatggatctgctggagtcacgtggcgtcgtggggccgtccgaagggtccaaggcgcgcgaggtgttggtgcagccccaggacttgccgcaggtgctcgccttcatcaagggtgagacctcgtcgctgagttcgggagtctcttcggcggcggattccgaagcggcgatgtgactggggaacgctccgtatgaaacgcaaattggtaagcaagtagaagtgtcagggtaacgtgaacggtatggaaaagcaagaagaacgcaaatcatcgttgcttgacggctggaacgtgccgccgaaccttgtcaccttctctcgtatcattttggtcatcgtgtttttggcgctgtacgccaaagccggcgcgtggggcgtggacaacgtcaccatgcgttgggttgccgctgtcatcttcatcatcgcggcatgcaccgataagcttgacggttggatggcccgcaaatacaaccaagtcactgaacttggcaagctgatggacccgatcgccgacaagctgctcacctgcggcacactgatcgttgccgccatcttcaacgaatttggcaatccggtgctgggatgggtcgtgaccgccctgttcctgattcgtgagatcggcatcaccgtcatgcgcttctttgtgatcgacacgggcggcaaggtcatcgccgcatcccaggcaggcaaatacaagacgctctgccagtgcattggtctggccatgctcatgctgcctatgtggagcttggcgccggaaggggtcaacgacaccccgatgtggatgaccgtctactacaccatcacgtatgcgctgatttattttgcgctgattctctgcctgtattccggtggcgagtatctggtcaatacgttcggcggccgtaagaagtccgcgggcaagtccggaaaagaaaccaagtaaggcattcatgactgaatctatggaccagacggctgccgccaaccaatcgcaatgcgatgaattggctgcggccgttcttgcatattgcgaaaccaaccatttcaagatcgcagccgccgaatcgttgacgggaggcctgttggccgacgctttcgtgcgcgtgccgggagcgtcgaaggtttttctcggttccgcggtgacgtatgacattcgtgccaaggcctcgattcttggcgtagatgcggaactgctgcgcagcgagggggctgtccatcctgaagtggcccgccagatggctgccggaacggcgaggctgtatcggcagcagggggatggcgactgcgttattggattgtcgaccacgggagtggcggggcctggacctgatggaaataaaccggcaggtcttgcatatgtcggttgttccctgccggaggggttcggaggtgttcgctctcggcgaacggaggcttttgagcttcgcctgcagggagatagggagagcgtgcgacgcggcgtcgtgcattgtattctgcaaaagctgagggagctttcagcggattcacaggaataatccacaaagatgagtgttgaccatagtggacagacgtacgcacgaaaaaggggctgatgaatggaaatgatgacactcaccaaagagcagagggaactcaaggctatggctcctgcgactgcgcaggctgccggagctcgtgtcagggagcttacgccggctcagcggcgcgctgtgatgttcgcgcagcagcaggtgcttcgtgcgcgcgctgcgaaaaaggccaaggatgagcgtcaggccgcattgacgcgaatgtggcaggaagaggactccgatcgggtacgcacgcatgctgtgccgcacgctcaggaacagcccgatgaggctaaggaggtttcgctgcgtgaagccataggccatgtgctgcgcgacctgcgcacgcgagatcataagacgcttcgcgaggtcagcgaaaaggccggggtgtctttggggtacctttccgaagtggagcgcggccagaaggaggccagttccgaactgctgtcgtccatcgcgcagtccttggggctgtccacagcccagatgcttcgcatggtggctgactatctcgattctgtggctgcctgattcgaatgtaaggttgacgcccggcgattgttcgccgggcgtttttcgtgtctgtacatggattcaagtctgtgtacactggggcacgtgcaggaacgtgaattttggcagttacttgaagaggtgcttggtcgtagctatggtcgagcgctggcgcatgaccaggtgcttgatcgtcttggcggcatgacggcggtggacgcgcttggcgctggtgaggagccgcgagtggtctggaatgtgttatgcgaccagatgggcattcccgattcccagcgttggggcaaggaccataacgcgcctcctatgccggtgcgctgagacgttttccgaacacaacacgcctcttcgaacagatgttcgcatgttgggatatagttatccacagacaacaacctagacgggctgtttccaaattcttcagatcgcgtgaaaacgttgattttccaagaaatgttggttatgactcgttagatcgcatatcctccgaccacaacggccgttagatttgcgggaacgaatgccgtggccttacggtgaagccaccattcgtcatagtcagcaaaaggagtagtcatggcacagacgagcgcggcaaagggagccgcacagaacaagtccgcgaacggcatcgacccgcgtcgtcaggctgcgcttgatacggcgctcgcgcaggtcgagaagagtttcggcaagggatcggccatgcgattgggcgatcgtcccgagcaggatgtcgaggtgattcctactggatcgctggcattggatatggcattgggtatcggcggcctaccgaagggccgtatcgtggagatttatggtccggaatcctccggcaagaccacactggcgttgcatgtggtggccaatgcccagaaaaacggtggcgtcgccgcgttcatcgatgcggaacatgcgcttgacccggtctatgcgcgcaagctcggcgtcgatactgattcgttgattgtttcccaacctgataacggcgagcaggcgctggaaatcgcggatatgctgattcgttctggtgcgcttgacgtgatcgtcatcgattcagtggctgcactggtgccgaaggccgaaatcgaaggtgaaatgggcgacagtcatgtcggtttgcaggcaagactgatgagccaggcattgcgtaagatgactggcgctttggctcaggcgggcaccaccgccattttcatcaaccagcttcgagagaagatcggtgtgttcttcggcaatccggaaacgaccaccggcggcaaggcgttgaagttctactcgtccgtccgcatggatattcgacgtatccagaccatcaagaatggtgatgaggctgtaggcaatcgcaccaaggtcaaggtcgtcaagaacaagatggctccgccgttcaagaccgctgaattcgacgtgttgtacggcgagggcatttccaaggaaggttccgtacttgacatggcgttgcaggtcaatgtcgtgaagaagtccggatcatggttcacctatggtggcgaccaactgggtcaaggccgtgagaacgtacgccaattcttgaaagacaatccggagcttaccgaagagatcgagaataaggtgaaggccgagtttggtctcattgagcccaccgaccaatttgccgaagatggtaatgaggcttctgcgtctaatgccacaagcgaggagaaggcgaaagcggatgctggcaagccggaagcagccaaaggcgcggcaaaggcttccaagtcagccggcaaggcgtgacgtatgatcagcgctgagcgatttcttgaacagcagggcctccagccggtatcatccgaggttgggggccttgccctttcctgcggtggtcggccgcaggccggtcgaaccgaattcgattacgaccgaactccgtccattggcggcaatgacacgccgaggcgtgcgcgacacgcacgacactcagggcgtgtcgcagtcggcgtgtcgcggattcctgacgatccgaatgatttggatgcatgcagggaggcggcccttcggctgcttgatgcggcgccgcgtccgtcaggcgcgatacgggagcgactcatcggcaaggggtatgcctccgaggtggtggacgatgtgatcgtcagactgattcgggtccgtctcatcgacgacgaggcgtacgcccagtccgcggtgcggtactgcgcatcacgactgatggggtataggggagcggtcatggagctcaaacgcaaaggtgtggaccgccagctcgcgcaacgtgtgtgcgatgaggccgaatcccaaggcgtgttcgccgaggctgcatgggagctgggacgtcggacagcaagaaaaactgctggattggatgtcgaggtgcgtaaaagacggttctggagtgctggtgggcggaaaggccataatcctgaagttctgcggaaaatcgcacaggaattgttcgtctgaaacgactgattcgcatagtggttatgcggttttcaaacactgtttcgccacgggaatcggtcggtgtgataaaggagtgagacctcttataccccgggttctgtcgtgcctcaggcacggatggccatccatctcgacctgacgttgccgtcaggctctagcagcctacccgaaggcttcgggcgagcagccctcaaacgccttctgcttggccttgctcccgatgaggcttgccatgcggccgactgttaccagtggcccggtggtctcttacaccgccgtttcacccttacctaccggtcgaaaccgataagcggtctgttctctgctgcgctatctctcaggtcgccctgggcggacgttatccgccatcgtgctctatggagcccggaagttcctcaaccgacggatcggtcgcggccatcaagaggtctcaaatgcactatgctagcaaaaaaacggacgaaaggaaaatcaaaaaaactttatttttcttgcgtcaacttttcagtgaaatcacaatgttgcggctacaatgttgactaccgaacagcgaagcagctgtttggtccgtatatagcgggtaacaccgcttgagtctagggaggtccacatggaaatcgtcgttaccggacgtcatacgcagattaagcaaaggttccgtgacgttgtcgaaagcaagatgaatcgtgtgaccgctatcgccccggatgcgcagcgtgttcagattgtgttgtcgcacgagggcaatccgcgtcaggccgacaccgccaagcgcgttgaaatcaccgtcatcgcaggtcgtaccgtggtgcgcgccgaggcttccagcgccgacgagttcagcgctctggacatggcgctcgacaagctgaccctccgtctgcgtcgcacccgtgatcgtcgcaaggatcatcgtcgtggctacagcgatccggtcccggtcgatcttggtgtcgtcgagccgactccagaagttgaggagccggtcgaagtgccgaataacagcccggccgaagccgtcgccgctgagctgggtccgggagagtccgtcgaagtccaagtaggcgacaccccgattgtcatccgtcgcaagctgcatatcgcggagccgatgaccatcgatgaggcgctgtatgagatggagctgattggacatgacttcttcctgttcgtgaacaaggagaccggtcgtccgtccgtcgtctaccatcgtcacggctggagctatggcgtcttcgagatcgacaccccggagaatgtggcgaagtaagacgtgcaacaggttggatagggagataatctgaccgaacggggctcgcgcagtgtatgtgcgggcctctttttcatgtctgaaggtggtgtgtcgaatggaagaaggccgcaacaagctgaaagttacgtaaaatggacggtgtttttcggaaatcgttaaacagcgactaatctcagatgagataactcgcatacacaaagggagtgattgtggtagatatcgttgacaaagccctgcgaatgggcgaaggccgacagatcaagaagcttgagcacgtagctcaggcgaccgacgcgctggaagatgagattgcagcgctcaacgacgaagagctcaagggccagaccgccaagttcaagcagcgtctcgacaatggcgaatccctcgacaagctcatgccggaagccttcgccaccgtgcgcgaggcatccaagcgcaccttgggcctgcgccacttcgacgtgcagctcatgggtggcgcggcgctgcactggggcaacatcgccgaaatgaagaccggtgaaggcaagacccttgtggcgaccctgccggcatacttgaacgcactcgacggccagggcgtgcacgtcgtcaccgtcaacgactacctggcaagctaccaggccgagctgatgggtcgtgtctaccgcttcctcggcatgagcaccggctgcatcatcaccaaccagaaaccgccggagcgccgcaagcagtacaacgccgacatcacctacggcaccaacaacgagttcggcttcgactacctgcgtgacaacatggcgtgggaaaagtccgatctggtgcagcgcggccaccacttcgccatcgtcgatgaggtcgactccatcctcatcgacgaggcccgtaccccgttgatcatctccggtccggccgaaggcgacgtgacccgttggtaccgtcagttcgcacgtctggtgctcaagctcacccgtgacgaggactatgaggtcgacgagaaaaagaaggtcgtcggcattctcgatccaggcatcaacaagatcgaggattatctcggcatcgacaacctgtacgagccgaacaacaccgcactgatcggctacctgaacaacgccatcaaggccaaggaactgttcctgcgcgaccgcgactacgtggtgactggcggtgaagtgctcatcgtcgacgaacacaccggccgtatcctgccgggacgccgttacaacgaaggtctgcaccaggcaatcgaagccaaggaaaacgtggaagtcaaggctgagaaccagaccttcgccaccatcaccctgcagaactacttccgcatgtacgacaagctgtcgggcatgaccggtaccgcagaaaccgaggccgcggagttcatgggcacctataagctgggcgtgctcccgattccgaccaacaagccgatgattcgcgaagacaaggacgatttgatcttccgtaccaagaaggagaagcttgccgccatcgtgcgcgatgttgccaagcgccacaagaagggccagccggtgctgctgggtaccgcttccgtggaatcctccgaaatcgtgtcgtccctgcttgacgttgccaacattccccaccaggtgctgaacgcgaagcagcatgacaaggaagccgccgtcgtggccgtcgcgggccgtaagggcgccgtcaccgtggctaccaacatggcaggccgtggtaccgatatcatgctcggcggcaacgtcgagttccttgccgatgcgaagctcaagtccgaaggctattctccggatgacactccggacgagtacgagaagcgttggccgggcaccttggccgaaatcaaggagcaggtcaaggacgagcatgaagaggtcgttgaactcggcggcctgtacgtgcttggtaccgagcgtcacgaatcccgtcgtatcgacaaccagctgcgcggccgttccggacgtcagggcgatccgggcgagtcccgtttctacctgtcgctcgaagacgatctgatgcgtctgttcaacacccagctcgtggcccgcgttatggccaagggcatgccggaaggcgagccgatcgaagcgaagagcgtttccaagggcgtgcgcaccgcacagaaggccgtggaatcccgcaacttcgaaatccgtaagaacgtgctcaagtacgatgacgtgatgaacaagcagcgcaccgtcatctacgccgagcgtcaggctgtgctcaagggcgaagacatccacgaggatatcctcaagttcatcgacgatacggtattgagctacatcaagggcgccaacaagggttctgacaagccgaaggattgggattgggaaggcctgttcaaggctctgaacgccgtgtacccgattgccgtcgatccggaagccgccaaggacgctgtctccaagctcaagggagacaaggccatcgtagccctgcaggagcttatcgtttccgacgcaaaggaccagtatgccgacttcgaagccaagcttggtgaagagggtctgcgtcagctggaacgtcgtgtcgtgctcgcggttcttgaccgcaagtggcgcgaacacctgtatgagatggattatctcaaggacggcatcggtctgcgtggtatgggtcagcgcgatccgctggtcgaataccagcgcgaaggctatcagatgtacaactccatgattgaagcaatcaaggaggagaccatccagctgctgttccacgttgacatcgatcgtgtcgccaccaccgaagacgccgaaaccgaatccgatgaggaagaggccgtgaacgcagccgaagcggtgatgggcctggatagcgaagcgcagccgaccggtgaaaccgctcctgccgagccggaaaccgacgatgaggccgagaagaccgtcatcgacgaactggccgaagaacagaagaatgagcctggcatcgtaggcatgcagccgatcagccatgctgagggcaaggttcctgccaataagcgcccgaagagcgaggaattgcgctctccgtgggcggatggccgcaccttcccgggaactggcaagaacgcccagtgcccgtgcggttccggtcgtaagtacaagatgtgccacggacagaacgaacagtgacatatcgtgtgatgctctgatgattcgcgcataatgaaggcggtttgcggatttttcgcagaccgcctttttgtttcatgctcgttgcccgatatgcggaagatagatattgaaaatgtctgtgttgtttatgatgagcgcttttctgcaattacctgttcgtgatatggacgttgaaaaaccatgaaatgtagaacggttacaatggcggcgatatcgtatcaacaacgtgacatgctgaagcgtcaaggagggcatcatggctgaaatcacatggaagtcgatcctcaccaagctggtcggaggggaccatctgagtgccgaggaatccgagtggttcgtcgatgacctcatgaacggcaacgctaatccggcggccgtcggtgcggttctggcaacccagcagcagcttggcttgactccggatgaggtgcgtggagcggccaaggccatggtctcccatgccatcaaacttgatatcgacggtgagaccaccgatatcgtcggtaccggtggagacggcgccgcgacggtgaatctgtcttccatgggcgcggtggtggctgccgcagccggagcgaaagtcgtgaagcacggcaatcgtgcagcctcttccaagtgcggcactgccgattgcttcgaggcgctgggactgccgctcgatctggaaccggaacaggttgctgaggtcggcaacgaatgcggcatcgcattcgctttcgcacgcacattccatccggcaatgcgcttcgtgggacctgtccgtgcggcgctcggcatgccatgcgtattcaacgttcttggacctctgaccaatccggcctcgccgaagcacatggcggtgggctgtgccaatcgcgcaatgagcccgatcatggctgcggtatatgcggctaatggacagaccggcatggtgtacacgtcaagcgagggacttgacgaaatggctccgactggtccggtgtccatctgggagttcagcaacggcaaagtcactgagagtgaattcgatccgactgtggagcttggtctcgacaaggtgacggtggctgacttaaagggtggagagccggagctcaacgctcagctgttccgtgacttccttgcaggcaaggacgttcctttccgcactaccgccctgctcaacgcggcatccgcgattgttgcggacggccatcaggtgccagctgatgccagcctgactgaacgattcaaagcggcctatgccattgccgaagaaaccgttgattcaggcaaggcctcggcactgcttgaccagtggatcaccgccgcccagtccaagaaagcttgatattcggcgaaatagcagatcataagaacgtataaggcgtgtctcgtcaaaacactcaacgacgagacacgccttatacgtatcgcagcgacaaatatcacagagaagagcacaaaagacgtagctgatgcagtcttctccatatgttgctatacgcgagctccatcatcgaaaacatcgcggcgggtttgtgtatgtcccttgtgctgtacgatcaatccagcagcgccaatcaacgtgcacacaccgaaaatcgatcccaaaatcccagccaaagcaggcatgaatgcagatgcgatgataccggcgacaccagcgatcaaaagcacccaaaacaccaacttcgatatcttgacatgaccgatggagggattcggaggagtgaaatcatcaccgtaacgatccattacactatcggtgtccaaccagctggaaccagtgaaatcgcgcggtccacgaccttgcggagtgtcatcagtgaacgtgccctgatccaaatcctgaatcgaaagcaacgcctccttctcacggcgctgcgcatgcttttcaaaacgtttcgcgctacgagaatgctccacggcctgcaaatcgtcggcatgcgaacttgcgaattcagcccatgcggcatccaaatcgtccgcatttgaagaagccccttcgccaccattcggcgcggcatttgggcgttcttcatcggcattgctattgttgaggtcagtcatactgataactgtaatcaagcggatggccatccgctaggaggatcgtgaaaaatgctctactggtttttcgtcaaaggcctaggaccgatcgccatccaccgcatgggaccgactgccaagggacttgaaaacattccgcgcgaaggcggtgccattatcgcagccaatcatcttgccgtcatcgatgacgcgctgttgccgctgacttgtccgcgcatgattcatttcatgggcaaagccgagtatttcgaaggcaagggcatcaaaggcaagttcaagaagtggtggttcacttcggttggcgtgttccccgtggatcgttccggtgggtcgaaatcgcttggcgcattgaaccacgcgcgtgaaatcctcgaagacggccacctgttcggcattcatattgagggcacgcgtagccctgacggtcgcctctataaaggtcataccggagctgcgcgacttgcttttgaaaccggatgcccaatcgttccgtccgccattatcggatctcgcgagttgcagaagcccggtcagattattcctggtaagggcaagaccacagtgatctacggcgaaccgattgccgtggagaagaagcccgccgaccagatcacgcacgacgatttgcgcacgctgactgatcgcgtgaccatggaaattcagaagatgagcggtcaggaatacgtgaacgaatacgctcagaaagtcaaggaacagcttaaggctcagaaagccgccgaacaggcgaacagctgagaaaccaaagagaaaagccccggcacgacactacacgagccggggctttccttatgcctataccatgatgttttggcaaagcaggtaatgcattttttagaacagtgaggaatacatcttcaatgtgatggtggttggtatgccgttctcgtcgcgaagacgcacttcggtgccacctaccggatcctgcgaagcgaccttcttgtcttgattggaatccaacgtgagctgcgaacttaccttgaccgtgaatccgagtttttccaatgcggctttggcgtcagaggctttctgccccacataattcggcagggttatggtttccggtcctttggaaaccaccacgtcgacgctgtctccccagtgcaacgtatcaccgttgttgacggaagcggaaatcacctgcccctgtggaatcttgtcgtcgaaggattccgtccaattggtggtgagtctaagatcatccagcgcctgctgtgcctcgtccttcgtcttgccgacgatatcgggcatagtgactggctttggcccctgcgacaccgtgacggtgatcgtcgtattatgcggcaatgtggcgccgggatccacacttaacgacagcaacgccccttgaggcacgtcaatggaatacgtgtcatcagaagccgcggtctgctcgacattatcgaatccagccttcttcagcgcgttgattggatccttgccggatgcgctggtcgcgtcgagaatatcggcgggaaccgtcgcctgccggactcccttggagaccacgaccttgactttctggctacgacgcttgctgccgcgatcgccgacattcgccgggtcggtggagatgatattgccttcctccacggaatcgctatactcttccgacacctcatattcgatatcggaaatcttgagcagactctcgtagtcgctccacttcacattggtgatggggcatgctgcggacgcgtcgcatgtcataccatccggctggggcatggtccaatagctgccggggccctgatagtaccaccatgcccaaccgccggcgccacatgcaagcagcagcgccaccacgcctgcgacgatgagcggtgtgcgacgctttttcgcggatttgctgtttggagtattgccggattcgtcgctttgcgcgatgggggattgcgatgcagcgctgtcgacggcattgtcaaggctattgacgatgccgtctgccggcagcgagaaacgtgtcgtcgcttctggatcgatgttctgttgctgcaccggcatgacggttgttgcgttcgtcctgaccctgtccagcttgcgtgtgcgatcatcgaattgctgcgtcggcggtgccgggggagcgggaggaacaggattgccgacattggttggcgcaccgttatttgcgggcgcggcaccgtcggaagcgctgacgtctaccaggggaagacgatactgccaatcgctgaccgcaagcgtcgattgcagacgctgcagctcggttaacgcaacggatgcgtctgctggacgagcctcgaccgcgcgagccgtgagatgggcaaggaatgcggccacgccttcattgatgcctttgcaagcggcggcaatgcttggcacatcctcgtgaacatgcttgaataccagtgttactggattatctgaagtgaatggcacgttgccggcgagcatctcccaagccatgatgcccacggaatacaaatccccctgaggtgtggcttgattcttctcaatcatttccggtgctagatatgctgctgttcccagcagtatgccggtggaggagagtgtggcctgcgataccgttttagccaagccgaaatcggtgatctgcacatggccacggtcgttaagcaagatgttttccggcttgatgtcgcgatgcaccacgcccgcacgatgtgcggaagcgaggccatccaatgtctcgccaataatgcgtaacgtctctcgaacgctgaacgtaccctgctggttcatttcgtaacgcaggttcacgccgtgaacatactccatgacgagataatcgagaccgtcgaattcgccggtgtcatacacctgcacgatatgcggattggcaatggccgcggccgaacgggcttcacgatggaatcgttccacgaactggtcccggtgcggtccctgcgccagctgggtatgcatgattttgatggcgaccgtgcgctccagacgttcgtctaccgcttggtacaccgtggccatgccgccatcggcgattctgctgacgacccgataccggccctcgatgacctgaccttcaggggcgtgtggagcttcactcatggttgatcgctacggttccttcttcaaaacaactcacgttcgaacgtgttcccacttgtagtctacaagcagaggtttgcggattgtgcaacgaacgcgcgtcctgtccggatgttggttggaaaacacgcaggtcgcgtgtcacgcgcgtgtttggacgtgaatacttggcacgaaacgtgagcaggcctcgatgagcagtgactcgtggtattcggaaaggctcaatgtttcgatagctgttttcgattcattccacaaatccgcgattctaccgcgggaacgttcgatggctcctgtttgctcaaatagttcaatggcgcgttttacttgagtttcggaacgcgaatcggcctcccacatgtcgatgagctctcgccgctgcgtgtcgttcgccgcgttgatggcgtcggctagaagcaccgtgcgcttgccttcgcggatatctcctccaacgggcttgcccgtattgctgctcgaaccgacaacatccagaagatcgtctgcaagctggaaagccaatccaagaggcaagccgactgccaatgcctgcttcctcgcatcgtctttgcctatacccgcggcaagcatgccgaattccagtggggcaatggtggtgtagctggcggttttccagcggaatacgttcaatgaagcttccaccagttcgtctggatcgtccaacggattgagctctacggccaaatcaagtacttgaccgacttcgacctcgcggtgcatgttgagcaatgccgcgaccacatcggaaccatgagtgagcttggaagctgccttgtccgcgatgtccacgcttgccgtggccaacatgtcgccgagcatgatgcccaagccatggccaatggcctcgctatgcgtaccagtggagaatgcgcgatgcgcagacggcttgccacggcgcagatcggaatcatcgatgatgtcatcatgcaccagcgcaccggtctggaacacttccaccgcgcacgctaaatcgagcagcgcgtcgaaatcacgttctcgcacatcctccgaagcgaatgcgcggaacgaatccaacgtcagcaaggagcgaagccgcttgccaccctcacttgacgtgaccgcctgcttggcgaccatgtcggcaataggcctgcaagaggaggcaaccgaatcgtccgcatgaaggaatgcgaaatccttcaccaacgaaacaatgcgtgattcaatctgttccaaatcggaggagctagtcataccaacagttatccacaggcattcgacaagaccaaatctcaatgattgcaatagttgcggtaccgaaatcattttgcgaaacgccgaagaagccatcctccgaccacaggcctcgaaaaaagcggcatcgcatcggctcatcgggcatagtgccatataagcggcgagcgaggaagccgatagaccatgccaaggagggcagaataatgacaaccaacaaaaccggacgcatcaccgggactgaaatggaagaagccatcagccgattcgaaagggattgcagatccgacggcgtgggcgaaacagtgcgttcgttcattcgtgaaccgcttttcatatggatggacgcgcttgcgcaggcatcggacgagagcgtttcccattcggaaggcgaattccatgccgaatgcggtcttgaccggaatatgatcatgcggactacggtgggcatcaatcggatgctgtccattcgtgacgtatttctcatttccgccatcgttgacgaacgatacgccgaccgagactttctcatgagtttcgccgaaagacccaagctgtctcgtaatgcgcagcgtctggaacagctgctcagcgattcattccgtgatcccctagccagacccgatatgaaacgttgcgatcaggcgatcaacatgctgttcgacattatcgatatgattccgaagacatatcgggcgcagccgttcgccgtgatcagctacatcatgtggtggatgggccaggaaggagccatggcatcagccatcagcgcgctcgcgatagatgatcaatgttcgctggcggcgattgtatgctcggcggttgaacgacgtattggtcctgcctggacgtcggaaacataaggcaacacgccgtaaagtggcgtgacttgcgcgtgaaggcctcattatgcgggaataatcgtccttgcaagatggtttactcacatagttgacgatttgcccttgccagaagtgggtccatgtggtatacgcttcgaggcaggatcaataggaggataagtttggccaccaaggaaacgacggcaagcatggaacaggctgatctgaccgaaaagaccacctccacgaagaaagccgccacgcgcaaggcctccacgaagaagagtgcggcgaagaaaaccaccgcaacgaagacccctcgcaagactaccgcgaagaagagcgcccctgccaagaaggaggagccgctcgaggatgatgcacttgacgatgaggacgctcaggtagacgacgccgatcttgacgatttcgacgccgatctcgatgacgtcgattcggatgacgaggatgacctcgacgacgacgaggaatccgaacctgaagatgatgacgacgaggatgaggaagaacgcaaaaagccggaagagcctaaggaaaagggcgctttcgtggtgcgtgatgacgatgatgatgagaatctgaccccatccggcaatccgaagcgtcgtgtgattgcggcgggtgcgactgctgatccggtcaaggattacctgaagcagatcggtcgtgtgagcctgctgaatgcggaacaggaagtcgatctgtccgagcgtatcgaagccggtctgtatgcccagcacctgctggacaccgaatccgaccagatggacttcaaacgcaagcgtgagctcaagtgggctgcgaacgatggcaggcgggccaaggaccacctgctggaagccaatctgcgacttgtggtttcgttggctaagcgttacaccggccgtggcatgctgttcttggatttgattcaggaaggcaacctcggtttgattcgcgccgtcgagaagttcgactggaagaagggctttaagttctccacctatgccacgtggtggattcgtcaggccatcacccgagccatggctgaccaggcgcgtaccattcgcgtgccggtgcacatggtcgaagtgatcaacaagctgtctcgtgtgcagcgtcagatgctgcaggatcttggccgcgaacccacgccggatgagcttgcacgcgagctcgacatgcctgtcgagaaggtgcaggaagtgcagaagtacggccgtgagccgatttccttgcatacgccgttgggtgaggatggcgattccgagttcggcgatctgatcgaagacaccgacgccatcgcgccgtccgacgcggttgccttctcgctgttgcaggagcagttcaggcaggtgcttgaaacgttgtctccgcgtgaggctggcgtgatcaagatgcgttatggcttggaagatggccagcccaagacgctcgacgacattggccgcgtgtatggcgttacccgtgagcgtattcgccagatcgagtcgaagaccatgtcgaagttgcgtcacccgtctcgctcgcagacgctgcgtgacttccttgatcagtgattgaaacaagaggtgaatgaagtcgagaaattcggtaagaatatcgaatttctcgacttcttacgtctacaagacgttcttatggatgaaaaccgaagcaaaactgcaagtcagaatgaggaaaatggcgaaatacaaggacaattacggcgcaggtagtcttaccgtgcttgaaggtcttgacgcggtgcgcaagcgcccgggcatgtatatcggcaccaccgatagccaaggtctgatgcactgcctgtgggagatcatcgataattccgtcgatgaggctcttgcgggagtctgcaatcatatcgttgtgacgttgcacagcgacggttccgtggaagtggccgataacggccgcggtatccctgttgacatcgagccgaaaaccaaacttaccggtgtggaagtggtgttgaccaaattgcatgccggcgcgaaattcggtaactcttcgtacggagcctcgggcggtttgcatggcgtgggctcgtcagtggtgaacgcgttgagctcccgtcttgacgtggaagtggatcgtgacggcaagacgcatcatatgtcattccatcagggtcatcctggtgtgtataccgatgctgatccggagcacccatctccggatgcgccattcaaacgcacgcgtaaaaaccgtccgactgagcttgaaatcattggcaaggtcagtccgaagaccacgggaactcgcattcgttattgggctgatccggagattttcaacgacaccgcggaattcagctacgagcagctgattgatcgcgtcaggcagaccagcttcctggtgccgggtttgaaaatcactgttatcgatgagaatattccggaaaccggcgatgaatcagtcgacgaaatgctggaagtcgacgatattgcaaatgctgcaggtgatgaaccgcaggaaattgccgaaagcgatgaatctgaacatgacgctgccgggcacgaggaagctgcggagcagatcgaggaagccgatgttgcggcacaacctcagggatcgaagtatacccactcccgtatcgaggaattctgccataccggcggtgtgaaggatttcgtggattacctgtccaaaggcgaagcggtttccgctatttggcgtatcactggcgaagacacctatgttgaggaaacccaagccgttggcgatggcggtgaactgcacgcgcagaaggttacgagaaattgtgccgtcgatatcgccatgcggtggaccaacggatacgacaccaccatgcgcagcttcgtcaatgtggtggaaaccccgggcggtggaacccatgtggatggctatctgttgggcctgaccaagcagattcgcaaagccatcgaagacaatgcacgtaagctcaaagtgaatctcaaagattccaacatgaaagtcgaacgtgacgatattctggcaggtctggttgccgtcgtcactgtgcgtatcgccgaaccacagttccaaggtcagaccaaggatgtgctcggcaccgcgcaggtcaagccgatcgtcagcaaaatgaccgacaggcagttcggcgagatgatcaccggctccaaacgtggctataaggaacagtccggccgcgtgcttgaaaagatcgtcggcgaaatgcacgcccgcatccaagcacgtaagaccaaagaggtgacgcgacgcaagaacgcgctcgaatcggcatccatgccaccgaaactgtctgattgccagccaggcaatgacgatgtggccgaactgttcatcgtggagggcgattccgcacttggcaccgccaaagccgcgcgtaattccggtttccaggcgttgctgccgattcgaggtaaaattctcaacgtgcagaaggcgtcgttgtcgcagatgctgtcgaacaaggaatgcgcggcgatcattcaggtggtcggcgctggctccggagcgagcttcgacatcgagcaagcacgttacaacaaggtcattatgatgaccgatgcagatgtcgatggcgcgcacatccgcattctgctgctcaccttgttctactgttacatgcggccgctcatcgagtacggtcacgtgtatgcggccgtgcctccgctgcaccgcatcgccttgaccggagctcacaagggggagtatatctacacgtattccgacgatgagctggccggcaaattggctgatcttgataagaagcacatcagctataacgaggacattcagcgctataagggtctgggtgaaatggacgccgaccagctggccgacaccactatggatccacgcacacgtatgctgcgtcgtatccgtatggaagacgccgaacaggccagtcagattttcagtctgctgatgggcgatgacgtgccgccgcgtaaagcgttcatcgttgagaatgccgacgatttcgaccgttcgaagatcgatacctgatcgaggttgtcgtcagctcgccttccgctacgtcaagacgtttcggagggtattttttagtgaagatggtatgcgatcccgtgtggtaaagattgaagattctacggtagacagtgcaatcaagtagttaccgattggtagctatatgtgcttacaataatggcggatattgtcttctgcggctaccgatcaagaaggagtagggcgtggttaatcttttgcttgcggtgatttatgtggcgttcatcagccttggcctgccggatgcggtactgggtgccgcatggccgacgatgagtgtcgatttgggtgctcccatttcgtgggctggcggcatttccatgacgatttccgctggcaccattgtttccgcgttgctttccgatcgtatgaccttgcgttttggtgcgggcaaggtcactgcggtttccgtggcgttgacggcgttggcattgttcggcttttccgttgctcctaactattgggtgctgattctgcttgccattccgtacggcttgggtgcgggcggcgttgacgcggccctcaacaactatgtggcgatccactacgagagccgtcacatgagctggcttcacgccatgtggggcattggcgcgttgactggcccatacatcatgggattcgccttgggcgccggccaaggatggtcgtggggctaccgttatatctccatactgcaggttgtgctcaccgccattcttattttcagtctgccactgtggaagaagcgttccgaggtaaagacgggcgaagtttccggcgaatccgacggaacggccaatgatgaaactcgcaaaccgcttggtgtgcgaggtgtgctcgccattcgtggcgccaaagaaatcctggtgatgttcttctgctattgcgcattggagcagacggccatgctgtgggctagtagctacatggcgcttggcaagggcatcgataagaccacggcggctatgtgggccagcctgttctgcatcggcatcaccgtgggtcgcttggcgagtggttttctgaccatgaagtttaatgatccggccatgattcgcctggggcaggcgctggtgctgaccggtatcgtcatcatgttgctgccgctgcctcgcaatatcggcaccattatgggactgatgattgtcggtcttggctgcgcaccgatctacccgtgcgtcattcattccacgccggcatatttcggcgaagacaaatcgcaggcgatcgtcggcatgcaaatggcatgcgcatacgtcggctcgatgtgcatgccgccggtattcggcttgatcgcacagcatatcagtgtgctgtggttccctctgtacatgttggctttcctggtgctgatgatgatcatgcacgagagcctgcgtaaaaagtgcgctggtcagaccatcgactgatacggtgttgtcgccattgccattgcgataccatgagccgcattgtggatttcgcatatatggttcgggttgctgaagccgagcgccacgtaccatacgataagcagtgcggtcatggttgcagccaatggcagttgtcgtattttcaggcgaataaggcatagcagaatcgcgatcgcaagcagggcgataaatgacgccgaaaggtaccgcagccaagtcaaaccgtatgcgttgatgtacagtcctaaccgaagcgccgccgaagctagaatgacggcggttaacgccagcaatgctaccagtgccgcgttgagcatgcgcgtacgtggcgcgagtgcgatcgccaaaccaaatagcgtcacattaatggccgtgactgccagcagttgaaagaatccgccgcgtgcgtattcgctataggtcaatccgtctggcagtgcgatcgaaccatcggtgaacaatcctgcgaacaggaaccggatctgtacgatgcaaaacagcatgtacacagtcaaagtcacggccaataccacgaacgcagttaccgagctgagggagaatcgttgctccggaggcgtggaagtgggttcatcgtcgagtccaataagcagtgagaacagcaaaggccacggcaacacgatgaacatgatgtgcagagtgatcgtcatcgggttgaaatcactgaaaacgttcagcacttcatattgaactatttgatcggctccgatgagcaatggtacgatcgtcagaagtaatggagtggaaatcagtagcgcaatgccgatttcgcgcgctttcgaacgttgcttcgacgcgactgcaaatcttgcgaatatgacggaaaacggttccgcaaaatcgcgaatgtgaataaacggctgctgcaaccagccggtaagccaattccaggcaacttgaagtggacggcgaacatcgtaacgcccgttgaccagctgacagtgcagcataagcaacgccggttgaacgaattgcgtggtgagcgcgtactcgtcatttctcgaatagcaccaggtcgactgagcgagtgtattccacacgccaatggcgacgatgcttcccaaaacaagccaaacaagaacttgttttcgtgcggttttccagtgcagcgcggttacggtaagagcacagatgatccagaaaaccggcagttcatatccgataagccatgtcggaggtatgctgcagatcagacggtcgaatgcgaaagtgatgagaaatgcagcgccaatggtgatgaccgcgcgtttgttgagggggcgttgcgctatttcttcccgcgtgattttgggtttcgccaaaggttgttcctcctgatgcgcggatggttcatgtgttggctggctcccttgtgtttttggtgtttcttgggtttcttgtgcttctggtaatggcgatgattgttgggattgcgaagtctgcgatggggaagtgttggctggttccggcatgataatgattcctttctgagatatgttggacgtcatcgtacatatcgaaaaacgatagaaaaatatcgactaacatactttcacaagatttgcatatcgaatatcgatagattattatcgatattcaggtttattggattgaaggagacggatatcatgccgaattccgcagcgaaacgttccatggtgattggcgtattgcgtgtgctgattgtgataattgcaatatgctgcctcggactgcagttcagtgcgattgcggcatccgctggcgttgcttccaagtatgccgacgctgactcgatgcattggctgtatgcggttgccgcagtgctgattgtcgcttgcttcgagttcgcgttggtgccgctgtggagattgctgaccttggttgaaaaacgtgatgtcttttccggcaaggccatgcgttgggtgaatcacattctcgtatatgcggggattgaaggcatgctggtgctcgccgtgatggtcggtcaaatctggttgtcgccttcacgctttctgatggctgcgatgggggttgacgggcaaatgtttccatacgtcgtgctggcggtcggagtggcggcgcttctactgatcgcggcgttcgaactgttgatggtggtgatgcgctcgctgttgatgcaggccatcgaacagcgtgatgaactggcagcggtgatctgatatggccattcgtgtgaaccttgatgtgatgctcgccaaaaggaagatgagcgtcaatgagctggcggaggctataggcataacgccggtcaatgtttcggtgttgaagaacgggcgggccaaggcgatacggttttccacgcttgataccatatgcgagacgttatgttgtcaaccgggagatgtgctcgaatgggttgccgacgaagatgaataacgtcttgcggtaatgcgatcatcgaacgtatgtacgaatgtttgaacctgttttcagagccgaccaaggcatggttcaaacatgcgttcagtcggcccactgaagtccagcagcaggtgtggccggccatccattccggcgagaacgtgctcgttgtggcgcccacagggtcgggtaaaaccctttgtgcgttcctttcggctcttgaccggcttatggcgggcgggacgcgttccgcaggagtggatgttcatggcgaaatcgcggcagccaagagccatgcggaacaaaaagctgcagggaaaggctcccgcaagaaaacgaagcgtggcgtcaaagtgctatacatttcgcctctgaaggcgcttggcgctgatgtggcgaagaaccttgaactgccattgcagggaatttcccagcagtatgaggcgatggagctgcccatccccgatgtcgaagtggccatgcgcagcggcgactccacacctgaacaacgtcgaagaatcgtcagccatccgccggatattctcgtcaccacgccggaatcactattcctgctgctcacctccaaggcgaacagcatattgacgagcgtggagacggtgatcgtcgacgagattcatgcggtcgcaggtacaaaacgcggcgcgcacctcgctgtcagcctcgaacgccttgataagttgattgggcatccagtgcaacgcatagggctttcggcaaccgttaatcccgttgaggaagtagcacggtttctcggtggttcgcaaccggtaacggtggtgaaccccggcgctgttccggccatggatttaaaagccgtggaaccattgcgcaatatgctcgacaccagcgctacaggcggttcggtatggccggtcattgaacggtccattctcgacgaggtgttgcggcaccgaaccacattgatatttgtcaactcgcgtggactggcggagaagctcaccgcacggctcaacgacatgtatgcggagtcgaaacagggcacggtggcaactgatctgagtgagcaccgtgacttgggctcaccggagggccgcgagcaatttgccgggcactatgactcggtggtaggatccaccaccatgctggttgaatcgcatgaagacattgatgcgattgccatggctcatcacgggtccgtgtcaaaagatagacgtaaacagatcgaagaacagttaaaacgcggcgaattacgttgcgtggtggccacttccagcctggaactcggcatcgatatgggttcggtggatctcgtggttcaggtggccgccccattgtcgatcgcatcgggattgcagcgagtgggccgtgccgaccacaatgtcggcggagtctcgcacgcgttgttcttccccataacccgccaacagattattggcgtaacaaccagcatggaatgcatgagggaaggggctatagaaccattgcatatgccccgcaaccctctggacgtgctcgcacagcagaccgtcgcagccgcggccatggaagatctttccacgaacgattggtacgagcttgtgcgtcgttccgcacctttccaaaatctcgaccggtctatgttcgacgctgtcatcggcatgatgacgggcgcctacaacagtgagagcttttccgcattccgtccaccgctgcaatacaacgaagaggcaaagctgatttccgcacgtccaggagcgcaacgcttggcggtgaccagtggcggcaccatacccgaccgtggcatgtacgcggtggtgcttccagaagagggctctggtccaggtcctcggcgagtgggcgagcttgatgaggaaatggtatacgaatcccgcgtgggagatgtcatcactttggggacttccacctggcagattcaggagatcacacgagatagggtagtggtggttcctgctcccgggcgcaccgcgcgcttgccattttggcatggggatcaggatgggcgtgattatggtttcggattggcgcaagggcgtttgacgcgtgagctcagccaaggattgcataggcgtgaaccagcaaagaatggtgatcagaatacggctcagactgtattggaagcacagttcaaccgtgagaccgcgcaacgtttggagcgagatggtctcgaccataatgccataagcaatcttgccaaactgcttgacgagcaatgtgaagcgaccggtacgattccttcggatcgtgatctcgtggtggagcgttgccgggatgaaggcggagattggcgcatcatcatccattcaccatatggtaggcgcgtgcatgagccttgggcgttagccatcaccactcgaatcaaacagcggtttggtttcgacggtcaagtgtacgcggtcgacgatggcattgttttacgattgccggacggttacggcgatttgcctacacgtgagctgttgctattcgacgtggacgaattgcaacgcactgttgagacgcaagttggcgaaagcgtgctttacatggctcgattccgcgaatgtgcggccagatcactgtttctgccgcgcacacgtcccggtaagcgtgtgcctctctggcagcagcggttgaaggccgcgcaactgttgaatgcggctcgtacttgcaagaacttccccctcttgttggaaactgcgcgcgaatgcctgcaggacgtatatgatttgccggcattacgcacgattatgacaggcctgcatgcgggaacaatacttttatcggaggcaactactgaaacaccttctccgtttgcgcagaacatgctgttcggcttcgtcggatcggtgatgtaccagtatgacgtgccccaagccgaacgaagcacgcagttgctgtccatggatctggaagtgctcgaacggcttctaggaagcacgaatatggcatcgttgttggacgccgaagctattacacaagtggagggcgagcttgctgggcgaacattctggaatgatctcgccgaagaagatatcagcgggcgcgtaacaagatacgccaaaacgcatggaccattcaccgctgacaagatgattgccgaactgggcattgacgcggctcaggcggtgcatgcgcttgatgaactggatgcccgaggagaactcatcaagggaagattcactgattcaggtgagacttccgaaaagaacgatattcagcaatggctccacaaggatgttttccggcgtattcgagcattgtctcttgccaaggccagaaaggccgtcaaaccggtcgatccgagcgtctatcaggcgtttctgcttaatcgtcagggcgttggccctgttggaggtgaacgctacgaaggcgttgatggtctgatgcgtgtcatcgagcagttggaaggcgtgttcctgaacgcttcggtatgggagtccatggtattcccggcacgtgtgcgtgactatcagcctagtatgctcgacgaactcatctcatcgtcggatgtggtgtgggtcggttcgaaagcaagtggatccaacgccaaagaagctggtgagatcgccttctatccagcaggttccttgctgctcaaccagcctgaatcggcggtggataagctgaacgataatgaaacgttgatcatgccggatgccgtgttaacggcgttaagcggtggcggagcatttcctattcaactgctttcagccgtgacaaaaaccatctggcttgagcatgccgaagcgcaggtgaaccccgaaacgggcgaaatcatctttccggcatggggcgagcggcagttcgaagaagccttatggtcactggtatggcaggggaaaatgacgaacagttcgttcgcaccagtacgagcgcttctgcacggaggcaaaaccgttcgcgcaccccgtcgtgccgcgcgtagacgcgtcaccatgcgtcctccaacaccattggcgctgagtggattatggtccgcagtatcttgtggcgacgggcgaaccgttatgccaaacaaaccactagacggtgttatcgagccgggcatgctcgaaaacagcgataccggcattggcatggcgcatacggcaagtgtagaggagcgtgagctggcgctcatcgactcattactggaccgatacggcgtgattgccgctcctttggttgacaaggaacggattgccggaggattttcagcgctctatccggtactcaaacgaatggaagaacatggcacactggtccgaggcatgttcgtgaaaggttttggcgcggcacaattcgcggaacgagacaccgtcgacgcgctgcgcagcgacacgcaatggcacagtcaatcctgcgttgcgctcgacgtgatcgatcccgccaatctcactggttccgcaatcgcctggccagaacaggattacctcaaaccagcacgcagatccgggtccatcattgtgctcaaacaaggcgaaccggtactgttctccgtaccaaaaagccataaaattgtcagcttcaccgcagacgaaacaatattaagaccgtcatgcgccgaacttgcctacgtattgcagcgccaacccagcggcagcatcagcttcagcgaaatgaacggaacatcattgaaagcacgcaatgaataccggcaaatcctttacgccgcaggtttcgtcgatagtccgcaaggcatgaaactttactgttgaaaaagatcatcatcgctaatgcatagtgacagcgcggacgaaaacgcaggaacaacaatgcccgcgtcctacgaacggaatcctaaacgattccaaacttcgcaaaacgcgggcacgtcacattgcaatgggtcagccgacgatggcgattggcgcggaaagttccgtaccagaaccgtcacgacgcatatccggcttcggcaattccacgccggcaccgccctccgtggaagcatgtaccggatatgtgcccacgaaggcgaggatcaacgtatcctgccccttaaggaaacgctgcgaacgcacgccaccggtaccgcgaccctttgtcgggtacatctccaacggggttaccttcgctgaaccattctccgtgcccggcagtgcttcggaatcgccggcaaccgtcaacaccacggctccagacgcggagaacaggccattgtctccctcctcgtaattccaagccaccttgttggcgggaatcaccgcaaacgcggcaaccgagcagccttcagccaagcggatacctgccatgccgcccgcggtacggccctgagggcgtacgttcttcgcatcaaacgtcagcaaagacgagtcggtagaaacaaacaccagtcgatcctcatcgcgcgcttcagcggcagccagcacttcatcgtcatccttcaaatcgatgatgctccatgaatccatcgtggtgggcgactcacgattccaacgcttgatcacgccattacgcgtgcccaatgcaagaggagcaggttctgcggcatgatcaccggaatcatcggcagttggcatggcaatcgcagcaatcacgcgttcgccgcgaatcggatcggtattttccgtcataccgatcaactcttcggcatggacgccgccagtcacatggagcggaccatccgcagacacaaccggcaactccacgacatgcgccacaatcagacggccggcagatgtgatcaaaccatatgaggaacgtgtggtggtagggaaaatcgaaataatctgatcgtccctcacacgtttgtcggcagaagaacgattctcccaacgttccaacgcatcttcggaggttcgcgcgatcaaacccgtggccgacagcatcaccgcacatggttcgtcgtcaatctgcaatgccacagcggccgcattgtcttcaccggccttcgtcgctgccttagcggctgcggcaacatcagctgctgcggaagagaccgttgcggcggcacgggctgcggccatagccgaagcggacacgccatcatcaccatgcgccacaacaggcacaagcttaccatcggcatcctcatccagcaatacggttcgacgaggcgtgccatacgtggcgacggcctcatccatttcggagatcaccacattgtcgagcgcttcggcggaagcgagaatacgatccaactcttcgatacgttgcttcaaatcgtcacgttccgactcaagctcgatgcggctcattttcgtcagacgacgcagacgcaagtcaagaatgtactgtgcctgaatctcatccaaatcgaatacggcaatcagcttcgtcttcgcggcatcagcatcgtcagacgaacgaatcacctgaatcacttcgtcaatgtcgaccatcgcaagcagaaggccttcgaccaaatgcagacgctccaacgccttcttcttacggaattcgctacgacggcgaatcaccacacgacgatggtccacccacacctgaagcatttccttcaaacccatggtgtgcgggcggccgttgaccaacgccacattgttgatagtgaaattgtcttgcaacggcgtgtgcttgagcagttgcgcaagcacggcgttcggatcgaaaccggttttgatttcaatgacaagacgagtgccgttatgacgatccgtcaagtcgatcaccccggaaataccttccagcttgcgattcttcacaccctcggaaatacgttccagcactcgttcgggccccaccatgaacggcagttccgtcacgacgatggctttcttacgggccgtcacattttcgatatgcgtcactgaacgcgtggtcaacgcgccacgtccggtctcatacgcctcacgaatgccgttacgcccaacgatcacgccgccacttggccagtccggacctggaacatagcgcataagctcttccaacgtggcatcaggatgatgcatcagatgcttggccgcggcaaccacctcgcccagattatgcgtcgccatattcgtggccatgccgacggcaataccggaaccgccattgaccagcagattcggaatcgcagcgggcaaaacagtcggctcctgcagcttgttatcgtaattcggcgtgaaatcaacggtattctcaccgatattggcattcataccaagcgctgcctgggccatacgcgcctcagtgtaacgggaggccgcaggaccgtcgtcaagggaaccgaagttaccatggccatccaccaacggcaatcgcatcgcaaacggctgcgcaagacgaaccatcgcctcatagatggcggagtcgccatgcgggtgcaacttgcccataacctcgccgaccacacgggccgatttcatatacggacgatcaggattgagattcatctggcccatctgatagatgatgcggcgttgcaccggcttcagaccatctctggcatcgggcaacgcgcgggcatagatcaccgaatacgcgtattcgaggaacgacttgctcatctcctcattcaacggtgtttcgacgatgttctctttgaccgtacgcgggtcaaaggctggttttgccggtttgcggtgcgacaccatgcggtgaatctcctcacggaaaagtaatggtaatcaacctagcaatgctaccagccggtaccgccgcggtgcttgaatgggaattatgagtgttgaagtgccaagcgtcgaagagctgctcaccatgaccgaaccggcatgctacggcgatgacgtgtcatctgaaggaacccgtgggggagcgttgcacctgtcatcggtacttcctgctgtttccaacgccatcggataccccatgccaacggcagtccatcctgatccgaagcgtttgcagggagcgctcggcattcccgatgcgacttccgtggttgtggcgctcgtggacggtctcggctactggaatctcaacatgaggctgggacatgccccctacttgcgtgcgctgatgaacgacaccgccaatcaacgtcccatcgcaacatgcatgccaagcaccaccgtcgcagccatgtctaccttcggtacgggaacatgccccggtatgaccggtatgaccggttacacgcagctcaatccgaaaaccgatgaaatatgccagctgatttccttcaaaaacgcaattcctccgcttgaattgcagcaacaaccgaccattttcgaacggctgagcgcgcaggatgttcgagtgaccagttctggactgccgaaattcgccttttccgcgttgacacaggcggcgttacggggcagcgactacatttccaacgatgatccgcgaaaacggattgcagccgcggcgcaagcggcaaaaacgcccggactgacgtacctgtatctgcgtgataccgataaggtcgggcacaattacggttgggattccgacaaatggattggcacgtacgagcgtgttgacgctcagctcggccttctccgccgcagcgtgcccaaaggcacattgattgtgattgtggcggaccacggtatgatcaccactgatcccgaatctgtgattgacattgcacaggatcagcggctcatgcagggcgtcgcccatgtcggcggtgagccgcgttgcgtcatgctctacgcggaacaaggcgagaatccagaagacatcgccacacgatggcgcagcgtgctggaggaccgtgcgcaggtgcgcacgcgctcgcaggcaatggatgaaggcgtgtatgggccggtggaagctcgcgtcgaaccgatgatcggcgatgtgatcgtatcggccgccaaagtcgtcactattgtggactcacgtacgcaagcagaaaaggcgatgcacctgccaagcgtgcacgggtcgctcaccatgctcgaatccgacattccctgcttgatcgacgtggcctaacttcagtcgccaaacaggatttcgtcccagcttggcacggcggaacgtccggcacgccgcttcgatttggtggtgttctggctatgcgggtcaagtgtctggttctcgttcgccatgttcgaagcaggctccggcgtggatggaacggtattgcgtgtgtcggtgtttgttgcgctggctgtattggctcctgcagcagggttctccggtcggctcggcagaggcaagtcggatgcgatggctggcgcgttcggcgtgtcaggcgtgtcggattcattagacacgccgccgattggcgcgatcggaacggaaggcgctgccgcgggacgggccgcaggcatggacggctcgggcgtgttccatgcggacaccgtttgctcgatacgcgccgaccgtgcggaatttccgggaagattcagtgacacgagaaaattttcatcggcgtgtttctcggcgtgtccttctttcgacgtgtcctgttctccaatgagttttcgtgctgcggaattcaggcagcttacggcattgtcgtgcatgttccacgaccattccgcgcagacattgtgaccggaggagacgaactgagcgctgattttccaaggctccaagccaagtctggtggccttccaagtcacatcttccaagcgcacccgcgctgccgcaaaagtgcgttcgatcagttcggaaagcgtgcgtacgcggctttccttcggcgctggaacggcgagaaactgctcgatcgcatattgcttttccgtttcgaccgaagccgagaaacgccgaacaagcgcttcgcttaacgaatatctttccgcgacacgcgcgggatcggcgccagcgcgaatcaacgattgaatttgcgaaatcggcagggtgggtgggatgcgtgtcttctgttcctcctgtacttcggaacgaatctgcttggcctccaaaatggctctttcaagcgcttcgtcgatctttacagcgaactttccggcacctgaaacaaagacgagttcaccggtgtcgctgacatgatcgaaccgcgcttcctcgagtgaattcccaggcacaacacaccactttccttcaagaatttctgtttattccattgtgccccacgtgtcggattttacgagtatttcgattcgtgtatcctatgcggggtaaaagtcatgtatcctatggcgcataagcaccatagatgacgaaaggaatctcgatggcacaggattatgattccccgcgcaacaaagacgaggacgaggagtcgctccaggctttgggcaagagctcccagaacacttccaacgatatggacgatgacgagaacgccatcgccgaagattacgagctgcccggtgcggacctcagcaatgaggacgcctcggtgaccgtcattcctatgcagggtgacgagttcatctgctccgaatgcttcctggtgaagcaccgtagccagcttgcctacaccactgacgacggtcagccggtgtgtcaggagtgcgctgcctgatggcgttcgacgaagcatataacgaaccggaaaacgtcgaggttctggtaaagtcgctggatcctgaccatccggcggaattgtattatgcccatgccggtgacgctggcgctgatctgcgcactacggaggaagtcacgctgaagccgttccagcgggcactggtgcctacaggagtggcgatcgcccttccagcgggttacgtggctctggtgcatccacggtccggtcttgccgtcaagcagggtgtgactgtgctcaatgcgccgggaaccatcgacgcggggtaccgtggtgagatcaaggtgccgctgatcaatcttgatccggaacacaccgtgacgttccatccgggagaccgtatcgcgcagctggttattcagcgttacgtcgaagcgaagttcatcgaggcggaaacgctgcctgggtcggatcgcgctgagcgtgggtttggttccacaggcgtggcttcctgagctgaacgcactggcttagtcgcagaggaatcggcaaacgctgacgtctcaatggtttcgggggtatttggccgtgcaacacgcggtcggatgcctcggatgcacggtgaggcgcgggtagtatagggagcattgcgagcgaggaggtggacgatgggtgacgttgagcgtgaggttcattctgcccgaatgttgggctgcgagatcagcacgaatccgcttgatccgcttgagccgatcctgaagatgtgcgaataccatcatcccgatgaggacataagcattcttgagcgcgcttatgagcgtgcggtcaagcagcattcttcgcaacggcgcaaatcgggcgagccgtacatcatccacccgttggccgtggcgcagattcttgccgatctcggcatgggaccgttggttgtggccgccggcctgttgcacgacacggttgaggacaccgactatacgctcgatgagtgccgcgccgagttcggcgataccgtgaccggtttggtcgatggcgtcaccaagctttccaagatggaatacggcgattccgcgcaagccgaaaccattcgcaagatggtggtcgcgatgagccgcgacgtgcgtgtgctggtcgtcaaactcgccgaccgtgtgcacaacgcgcgtacctggcgttacgtcaaaactccgagcgcgcagaagaaagcgcatgaaacgcttgacgtgtacgcgccacttgccaatcgtctcggcatgaacgcgatcaaaaccgaattggaagagctcagcttcaaagtgctctatccgaagatctacaacgagatcgtggtgctggtggcccgtcgcgcaggccagcgagacgtgtatttgaagcagattctcgcggagatcaacgaagatcttgacgaacagaacattacggcgtacgtaacgggacgtccgaaggactatttctcgatttatcagaagatgatcgtacgtggtcatgattttgcgaatatctacgatttggtgggtgtgcgcatcatcgtcgacacgattcaggattgctatgccgcgttgggtgcggtgcatgcgcgttggaaccccgttccgggccgtttcaaggattacatcgccatgccaaagctcaacatgtaccagagcctgcataccacggtggtgggccctggcggcaagcctgtcgagattcaaattcgtacgtgggacatgcatcgccgtgcggaattcggtatcgccgcgcattggaagtacaaggagaacggtcaagctggccgtgcgctgagctcgcccgataagtccgatcgtaaacgtggcgagaaccaggagctgagcgaggctgacaatttcaagtggattcagcagctcgccgactggacgagtgagaccccggattccaatgaattccttggctccctgaaggaagatctgggtgctgccgaagtctacgtgttcactccaaaaggtaagatcgtatcgttgcctgccgaggcgacaccgatcgatttcgcttacgcggtgcataccgaagtcggccaccgtaccatgggcgcccgcgtgaacggacgtctggtaccgctcgacaccaagcttgaaaacggcgacaccgtcgaggtgcttacgtcgaagtccgaatcggctggtccgtctcgtgactggttgagctttaccaagagcccgaaggcacgcaacaaaattcgccaatggttcagcaaggagcgtcgtaccgaggccatcgaagaaggtcgtgacgagctgacacgagccatgcgcaagcgcaatcttccgattgcgactctgctgactcccgaggcgttggtcggtgttgctgatgagctgaatcttgccaatgccgaagccgtgttcgtggcgattggcgaagggcagatttccacgcagaatgtcatctcgcatctggtccgtgatgcgggcagcgacgaggtgaatgaggaggtggagcaggaggctctgccgctcaagcaggtggaacgcaccaagaagaccaccagctcgctgggcatttccgtcaagggcgtgggagacatttgggtcaagctcgcccgatgttgcatgccggtgccgggagacaacatcatcggcttcatcacccgcaatcagggcgtgtccgtgcatcgtgtggattgccagaacatgctggacttgcagaagcgtcagccggaacgtgtggttgacgtgcagtggacgagtaccaagggcgtgttcatggtcaagattcaggtggaggcgctcgatcgcccgcatctgctgagcgacgtgacgcgcgtgctttccgaccatggagtgaacattatttccggctccatttccacgggaaccgatcgtgtggccactagccaattcagcttcgaaatggccgacccccagcatttgaatactttgcttgccgcagtgcgcaagattgaaggcgtgttcgatgtgtatcgtatcaccggtgccaaggactccgccgaacctcgtttacgcaaaatatgacacgatcagtgcggtcgtgagactcatctgaactgctgtagattctctcggagataatgaaaagcccctcacgcgaggggcttttcattgttttgccgtaagtcttgttgatgcgaaacttacttcagcacttcgatggaagtgatgccgaccggctcgagcggagcatcggaacggtcagttgccacggagtcgagcttgtcgacgacggccttggactcgtcatccgcgacttcgccgaaaatggtgtgatggccgttgagccattcggttggcacggtggtgatgaagaactgggagccgttggtgccgtggatcttgccgtccatgccgcggcgcaggccggcgtttgccatggccagcaggtatgggcgatcgaaggtcagtcctggaacgatttcatcatcgaagttgtagcccgggccgccagtgccggtgcccagcggacagccgccctggatcatgaaatccttgatgatgcggtggaaggtcagaccatcgtagaacggcttgtggctcggctggccggtgaatgggtcggcccattccttctcgccagtggcgaggccgaggaagttggccacggtttccggggtcttgtcgtcgaacaggttgatcttgatgtcgccttcagtggtgcgcatgataactgtagtcatggttcctagtgtctcatgggcttgagaccaggcggtagcccattgacgagttcggggctaagttcgacggtcacatgaagtattactgcgaaggcggattcgggaatccactagggtttggatggggccgaatgggtctcgcaggagcttggactatgcgtcacgagcggttcgggaattatatgcccctctacctttatgcagacaatcagcgaaaaccttcaacggcattctcaacagcgcaaaacaggcatagtcataatctgagcaatcaacggcaatggtgaaacacgtgaccttacactgcacatgcagtccccaacacgccagacgcttacgattatgaccacatcaacttcgcagaatactcacgaaacagataccgcaaacaacgcatcatgcaccaccatcagcaccattctcacactggccataccaacattcgggcaacttatcgccgaaccagcattcgtactcatcgacaccgccatcgtcggacatattggcgggcgagcgctcgcaggtctgtcggtcgggtcaaccattgtgctcactgttgtggggctatgtgtgttccttgcgtatagcaccacatcgcaggtgggacgtcttttgggcgccggcaagcggagagaaggcttggaagcaggcattgatggcctgtggttggctggaatcattggcgtggtggtgtctgtggcgctgttcgttattgcacgcccgttgtgcatggccatgggagcccaagggagtgtgctgcataacgcggttgactatgttcgcgcagtggtgttcggtattcccggcatgttgctggtgtatgcggccaacggtattttccgcggactgcagaaggttcgcatcacgttggtagctgctacgctgggtgcgatactcaatacgttgctggatctgctgtttattctcggattcggttggggtgtgtttgggtctggagtggccacgctgatttcgcaatggttcatggcagtgttgcttattgttcctgcgatgttgtggactcgtgcggaaggtgcccgtttacggccgcgtttgtcaggagtgttgaacagtgctggcgatggtgcggtgttgttcttgcgcacgcttgcgttgcgtgcatgcctggtggcgaatgtggtgctggctacgcatatgggcgtggaagtgttggctgcgtatcaggtggtgaattccagttggaatttcgtgttgaacatgcttgatgccattggtattgccggtcagacgttggttgccgcgcagattggtgcccgtcaagaggatgaagccatgcgtttgacgagaatcgctggcagggcaggattatgcggaggaacggtaatcggtattggtttgatgattgccggatggtgtgcgtccccgctgttttctcagtcgattgagatccagcatttgctcactgtcggtatggtggttgttggcgtgacattgccgttggctggttggatgtgggctgttgatggcattctgattggggcaggggattaccgttatcttgcattgacgtgtacggcgacagctgcaatatatgtaccctgtcttgctgcgattggttggatatgcgatgcgatgcaggcgtcttccgcgctgcgtatggcattgctgtggcttgcggtgaatctgttatttgtaggattgcgtgccattttcaatgggtcccgtatcggaacttccacatggttgcatatcgcacattgaaatcagcttgtgatggcagtttgacatgacgtgagatgggcgattcctgcaaaataaaaaatcccgcatgattccggcgaaccggatcatacgggattgttatatgcggacgaacttaggaatgagtcctaagaacaggctctggcaattcaggaacgcttgcgcttgaacacgaacaatgcccctgctgcgacaaccagaacagcgaccaccgcaacaacgccgattacgttggaaccggtgttggcagtgtttgccttcttgtgtgcggcaggcttcgtattctgcttgtcatcatccttcttcggtgcgttcggagtgctgtccttgatagtcacagtgaaacgcacgcgtgcaccctggttgtagaacaccaccacagaaccggtgctgccggtttcgcgaccattgaggaatgcgctgctcaacacgatggaaccgtcatcggtcacggtgtaatccgtgccggcggtcagtgactggtagtcgtactgcacgtcttccacggtattgccattggggttgatgccaacggtcagaccgttggcgttggcgctcttcttatcgctatcatacttgtcgtagtcgaatgcatcgccattcgtcagctcagcattcttgatttcaccatcgttcagcagccacacctgagtgccatggtacgggtttgcggtgccaattgccagaccggaatcggtgacggcgaacacgcgtagaccgtggttgttgttatctccgaaaccgttacggctgatggtctggaagttcgtgccatcggaggagacgatcaggtcaaagccacgagtcttatcgttggagtaatgcaggtagctgagcacgcccacgaagtcggtgaagttctccagagtctcttcggtaagccatttgtcgagctcgttggtgatggattccggcagatactgcttgttcttgttgtacaggtcgagcaggcgctgcagggatgcgaggaactggtaacgatcgtcgagcgtgtaggtttcggcagactgtggagcgacgccgtcaggggagaccacgtcggtctgcttggagctgaggtcagcgcccatatcctccagcagctgctgcatggtggccacgtcagcagccacttcgtcggtcttgccggcttcttcaactgcctgtgcggcttgatcgctttcggacgtttcgtcgccctcgttcagcggcatgatgtcgtcatcgtcgcccggcttggtggtttcctgagagtcggactcggtaggcttggtggcttcctgagaatccgtgtcggtagtaccggaagtgccgttctggtcattcttcttcagagagtcgaagaagatcttgatgtattcgatctgcttcttccactcttccggagttcgcttcagaatgtcgccgttggcgaactgggttgccgggtatgcaagatcactgatgtcgaaggtgccgacgtacagcttgccgctgtaggactgcatacgccacacatactggttcaggtgacggctctgctcgtcgctgtcgcccaagccggacagcatggtattgccatcgatggtgcctttggaatcgccgaagtacttgttgttggcttcgccggcgagcatttcgaagttttcgttgccgtcttcgtcaacgtccatacgccacaggttgaccgggctctccagatccttgtacagatcggagaaatccatttgcatggccttctccaaagcgttcatcggatcgttgtagccgccgatgtacaggtggcccttgtataccaccatgttggctgcgccggaacgactcgctccgaaaccccactcgtacttggcgccatctgccggatcgccgaccagcggcttgaaggtccacttgccggtgctctcatcctgcgtgccacggagcaaagcgaaggactgcttggtgtttttgcccttgccggtcaccacggtgacatacaagttgcccttgaatccgaccatatcccatacgcagccaccgaacacgttgtcggtcacagcacatgccggatagttgtacaagcccttatcctgagtggcgatggtggcgaaagaatcctgacctgcggacgggttagaggaagccacgatagcggcaccgttgtcggtgatcatgctggcgataagctgattgttgaccacggtcaaaccacggataccagcagtgtagcccttcttcagaccagtggtcatggcagcggaacgatacacgatttcagtggcatcaccactgttcggatcaacttccagtaggtacggctgaccctttgcggcggcagcaaagtacagtttgtcatggaattcaacggctgcacgatagccgttgaccgcatgctctccgccaatcgcattgacgatgatcttcacttcaccggtcttgacgttgatcttgagcagcaagctgtggttctcgccattgtcgaggaacagctcgccgttaaacgcaacatccaaagcggccttgatgctggcatacttggtgcccatggtgttagccatgtatttcagcgtggaacccattgcggaatagcaggtgcccacatacatccagtcgccgtagccggccgaagcccatgaatagttctgaccacgctcgggcaaaccctgcgtgagatcatcaatggattcaccgttcaaaacgtttacgataccgtcatcttcgcccagccctgcattggggtgcgaaatcttggtggccgtatagccggcaccaagtacggcggtatttgaggattcattagcattggcgctgcctactaccggcagcaacatggcgcaagtcgcaagcgttgcgattgcagcattaatcattttatggtggttgaccatattttccctaatctcgtataccccgaaaagatatcccatcgtatggcatatccaatgaaaaaataccaaaaaggggtgacctaaggtactatacggaaaacatcgggaacaaatctcgccaagtagtgctgcgctaactagtatttgcgtgactttgcggatgtgcgcatgcgaaatcaggctttagaagcgcgtgcgacaagccgcttctgcacgtaaagtccaatggacattgtgcaatggcggaatcagatcgttaaccgtcaacatgcataacgaaatcagcggcgtagccaatgaagcaatgtgaaaatgtttgacgagtgcgaaaaaacaggaatacgaaacccgcaaatcccagaatatcggacgcaaagatatcgtatccaaacgtgtcgagagtactggggtggccagtcaatgcaacgactacatcgggaatcccatcgcgcacgatattcaacagaagaaaagcgatgagcgtggtgcagcctcgttttacaatcttgcgagggttggcgtcggagaagaccagattcgacccgagactgatcatgaacacggatggtccaagaatgtacagatacagaaacactcgccccactagctgatttcatcttggaagaaagtaccgtcaagcacttcgtagagatgcgccgagggaagaccgagaggggcggaacgcgcaagatcgaagctgccgtagttattttgtctgctctctcatgattacgttatgctcactccagtgcccgaacattccctccatacccgaaagggaggaatacgcaatctgtcaagtggacttccgtcgacaacgaatgccagagaaagcccgtatcgcctaccttaatcagcaagcagaatcggcgtggttctaccttaaagccactggcgtcatgcttcgagtgtggtgtttgcgggctgtgttttctctgtgcatatgaaacgtgccaccaggcggtcggatgacgcttgcggagggatgtcttgtgcacaaaaatgtgtcgtacgagcgcttaagcttggttatcccgcttacgtatggtagattccgtgctttatcctgagacatctcgcttatatatggcaggtcaggttgtcatgacagctgttctcataccccctaagtacgcttttccgaggtgtatctgccatacataagcgagatagggataaaagggggtatcgatgtccgagagaacgcgtcttcattatccaacggtgtatgtggttcatacggaagataagaacaggtataaaagcgttcctgactatacggtatacgtgggggagacgaaggtcgccgcggcgcgcgaccacgtcgagaacggtctgaccaaggcggaggtcatggccatgcacgggatcgcgagcgtcacacccctggaacgctggtgccgcgagtaccgggccggaggtccggggaggcgctcgggccgaggcccaagggcaggcccagaggctcgaaatccaaaccgaagcccgaaccgacgctcgagcaggagctcgccgaacaggtcgcctatctgaaggcgaaggtcgcgtacctggaaaaactccgggccctgcgggcgtccaagtcacgcggcgcgagcgaagcgccgtccgagcgccgtggcgttgatcgacaaggtcttcaagcggatacttgagttggacggcaacccgcgcaacaggggcgactatggcggcaaggcgtatatccgccattgcatggaagaccacaacggccaggtcccgttgtgggtgctggccaaccatctttctttcggccagacggtatggttcttccaagtccagtccccggccgtccgattggcggtcgccgaaagtttcaccggtttgtatgcggacacgcacgacgggccgcggcgcatcaccatcaagcggttggacagcatcttcaacagactggtgttctaccgcaacctgtgcgcgcatgacgagcgctgctattgtgcccggtacgatgggcgcgctaacgagaacgtgtaccaggccatcggtgatcttggctatttgcttgacaaggacgattacttggaattgttcggtcgcttctccgcattggtcgcacgggcgacctccgccatgccgtcgcggagacaagcgatcctgtctgctatgggcgtgcgcgaacgggaactggccgacagggcggaaatcatactgcgcagctgaccgttcctgccattgggacggtggcgtcgcaggcggctttggactatgagccagctgatctgggctgtctgcaataggcctgtgggattcgggatggatttgggatgtcattggcggctgggacggttgtatgggccgcgtatcgttctgtctattgtccgccatggagacgtgctgccgggcgaatgcttctgggcaccacccaggcggaacatcatgaaaccacagggggtattgcacttttccgtgccggtcggcgaagacgctgagcgccggcagggtggtggaacgttcccggattattttcgggtgtctggaggtgcctcgtggaaaacgagggtgatagtcaggtttcccaaaaaatgaaaaccttggaacaaagccaaaaacgaccacacgcgattatcgtcagaggtgcgcatgatagctatagtcatgattttcatgcttatgcccctgtgaggcctgctcggtcgtgaggactattctcggagagacgtgatgtccggggtggttatttccagttaaacgtgtagctctggtccgattgttcctcgccgtgggtggtgacggtcgggatgttgccgtgccaggttacggtgaagttgtccgagtccaatgatttgccgtcgttgtgcaggtccgtcttgatttctgtgacgttctcggctccgatgacgttggaatcggtgtcccaggagactttgatcgtgatggtgcttgggccgaagaacatgggcgagcctagttcgccgatggccacttcgcaggtgccgtcagaggatgtcgtgttcacgatgctgtggggcatgtctatttgcgtccatatgagggtacagccgccggcccagaccagtgcgagtacaaggacgatatgctcgataatgcgcgccgctttatgctgttttggtaatgttcctgtcatcaatgcccctgcaatcgtgccgcgcctcttttgtctttgaagtagtttatcgatgttctggatggttcgaggttatacggtgttttgagattaccatacctgacatggcagtgggattgttccttcttgtctaggcgccactaaacaagatatcgccaaacggctcggaccgagcgagaccactgtgcgcccctgcatatccgagtttttcacggcgctcgggtacacgaaccgtggcgagctgaccatcaccgccattaaagccggatactgattggtttctgacttgaatttcggtgcatggtagagtgtccttgccgtgaatcccatcatctcccatcgagtcggggaaatgcggagcaaaaacaggttatatcatagattgagttgctgaactcaacaagtaagcgcaccacgtagcagtgttttcgcatacaagaatcggatccgaacacaattattcagacccgattcttgcatataggagcatgaaagcgtcggtttagcgctcgtgatggtcgatgtggtcggacgccacgtcgccgatggtctgcacgatctgtacgaggatgacgcacagaatcacggccacggtcatcacgtcgtactggtaacgctggtagccgtagcggatggcgatatcgcccaaaccgcctgcgccgacggtgccggccatggcggagaagccgaacagggtgatgaacgtcagtgctgcgccgcgcaccagcgacggcaggctttcgaacagcagcactttgaacacgatctgcagattgctggcaccgaagctttgcgcggcctccaccagacttccgtccacttcggcgagcgactgctccaccacgcgtgccacgaacggcgccgcggtgatgaccagcggcacgatggctcccggcacgccgagcgaagtgccgacaatcagtcgggtcaacgggatgatggccaccagaagaatgatgaatggtacggaacgcacgatgttcacgatccagccgagcacggtgttgagtgtcgcattcgggcggatgcccttctttgctgaggtgatgagcagtacgcccacaggtaggccgatcacatacgcgagtagcgtcgctaccgcggtcatgatgatcgtgtcacgtactccctcgaccagcagttcgccataatcggcgatgaattgcgagataatctgtcccatttcacttcacctcttccttggtcggcgagtccgtctgctcatcggacgaagcggaatcatgcttatggcgatggttctccactttcgcatcggtgatcagtgttttcagaatgtcgctttgcggattggagaacaattcctccgtatcgcccatctccacgatgcgtccgccatcaatcatggccacacggtcgcagatgttgcgtgccacggacaacgaatgcgtgatgatgaccagcgtcacgttgagctcgcggttgatgcggcgcagcaggtcaaggatctgcgcagtcgtggtggagtcgagtgcgctggtggcctcgtcgcacagcatgatggacggattgttggccaacgcgcgtgcgatggccacgcgctgctgctggccgccggacagctggctcggatagcggtcggccagatcggccaatccaaccaggtcaagcagatagcgggcacgctcctcgcgcttgtttttcggcgtatggttgagctccagtgggaacgtgacgttgcgcagcactgtgcgctgctggaacaggctgaaattctggaagatcatgccgattccggcacgcacgtccgccagctccttgcctttcgcgtcggtgatgtcctcaccatcgacgcgcactttgccggaagtgggacgttccagcagattgatgcagcgcaccaacgtggacttgcccgcgccggaggagccgaggatgccgaagacttcacccgaatcgatggtcaggttgatgtcgtgcagcacctcatgcgcttcggcgccactgccatagcttttgtgcagatggtcgatctgaatcgtcataatgtcctgttcctattgatgttccataacaagaatgccgcagggtagtatacctgcggcattgaattcttgcagccgaagcgggtcttagaagaccggcaccacagcgcccttgtagttcttgttgatgtagtcgcgcacctcgtcggacttcaaagccttcttgagctccttggtcttggcggtgttctcgttgccttccttcaccacgaggatgttctggtaggttttcgcggccaggccgtcggccttttcggtgaccagtgtgtccttggtcgggtcgaagccggcttgaatggcgtagtttccgttcagtgccgcgatgtcgacatccttgatgacggtcggaaccacggcggcctcaagctccttgaacttcaggttctttggattggaggtgacgtccttcggagtggcgttgatgtccttcggattcttcagcttgatcagaccggcatcctgcagcagcagaagcgcacgggcctcgttggtggcgtcgttcggcacggccacggtggcgccatcctgcagattctgcaaatccttggtcttgccagggtataggccgaatggctcgaagtggataccctccacggacaccagatgcgtgcccttctccttgttgaagttgtcgaggtacggcttgtgctggaagtagttggcgtccacttcaccatcctcggtggcggtgttcggctgaacgtaatcggtgaactccttgacttcgagcttataaccatctttctcgacgagcgacttgacggccttgtttaggatttccgcgtgcggggtcggggaggccgccacggtgatggtcttgtcatcctccttggaggcggagccgttggagccagagtcgccgcagccggccagaccgaaggtcgcgagcgtggtgacggcgagcagcgcgccgagaagcttcttgttacgcatggttgagttcctctctcaattcgttatacgggccgcccgtttgccacgcggcggacccaacgattgaccaatatagaggaaccatcgacggcaacacggcgttcacttattgaaaatacttataaagggcatgaaaaacgcagaaattcgcgaaaaccgtcttataaaatcgcaagaaaactcttaaaaaccttttctacagaatttcaaaatgatgcaatgcattcgagattccggcatcgtcgacactgtcggtgacgtaatcggctacggtcttcggttcgtcagtggcgttgcccatagccacgcctatgccggcgaaacgtagcatatccacgtcgttgccgccatcgccgaacgcgatcgcattgtccctcgaccaaccaaaatgctcaagcacgacctgcatgccgaccgccttgccgccatccgcaggaatcaggtcggtgaagtcgggatgccacctcacaccgcgcacgttgccgcacatgccggcgatttccgcttccgttgccttatccacatatgggctgatctggaatgtgcgatggtttcctatacgttgctgcggattgcatatgtcgattttcggcgcggttttgccaaggctgttccacgtacgttccaaagcggcgttgatgcgattgaaatacccgtagttgctttccgcgtaattggcgacgacatcggtatgcgattgcagccagtcggtgatgatctccacatcgtgcaggtcgattggatgacggtaatcgaggccgtcgcgtgttgtgcagaactggccgttaaggccaacaatgccatcaaattcgacgggaatggtgtcaagcaccacacccatataggagggtgcgcgccccgaacagatgaacaccttcacgtcttttttctgcaacgcatgcaatgcgtcgatggtggatcgcggcaccacatgcgtgacgaaactcgtcaaagtgccgtcgatatcgaaaaacgcagccttgatgtccgatgacatgccgatctccccgtgaatccgttcaaaacgtcatccagcttacggggaaaaactgcggaaaacgccattgtcggcacgaaaaacgaacacgaaaataggaaaaacgtccggttgcgcctacaatcgtcaaccatgagcgaacatattgagatcacgccggagatcatcgagatccgtcattatctgcacgcacatcccgagcgcagtttcaaggaatacgagacaagtgcctatatcgagaaactgctacgcgcgcacgacatcgaagtgctcaacaacccgcttgaaaccggcgtggtcggcctgatccgcggcgagcaaccaggcccgcgcatcgcattgcgcgccgatatcgacggtctgcccatccaagaggatactggcctgccgttctcgtccgtcaacgacggtgtgatgcacggttgcggccacgacctgcacatgtcttacatgctcggagccgcattctggctcgcaaaacgccgcaagcgcatcaaaggctccattaaactgctgttccagcctgccgaggagctcggtctcggcgcgaaagctatggtcgatgcggggttgctcgccgacgtatccgccgccatcggcgcccacaacaatccgaattacgcgcccggacagatcgccgtaggccccgacccgatgatggccggctgcgtgaaattccacgttactctgcatgccgccggctcacatgccggatatccacacaagggcactggtcctatcgaggcgctcgccacaatgattctcgccttgcagaccatcgtcagccgcaatgtctcaccattccatccgctcgtgctgtccatcaccgaactgcacggcggccacgtgtggaatgtcgtgccggacaaggccagcttccaaggaaccgtacgctacttccataagtccgacggcgaactggtcgagaaacgcttcaagcagcaggtccaatccatcgccgcgggctacggcattaccacagacatcgactgggatgactttcagaatccgctcgtctccgacatggaactatccaaaatcgtcgctgacaacgtgcgcgactatgcgcagctcgagccaatccatccttcgatggcgggggaggatttctgcgatttcatgcccgtcaccatgccggtgttcgccttcatcggttccaatggcgagaaaggctgccccgattggcatagcccgcatttcgtcggtctggatgaatcactgcaggccggcgtggaattctacgccaacgcggcgctgacggtgctcaacgaactttcgtgacacgcgtgcggtccgctttcaattcgcgatcgtaagaaaataaaacgttcaacaaatcaacggtaggttaggcagctatgacagacattcgcttcgcactcgctcaaatcgacacctgcgtcggagaccttgattccaacgccggtaagatcatgcgatacgtccgccgcgccgcgcaacagggcgcgcaagtcgtcgtattcccggaaatgacattgaccggatatcccatcgaagacctcgccctgcgggccaccttccgcaaagccgcgtggaacaaagccaactggctcgccaccgaactggctgccgatgggcttggcgacctgtttgtggtggttggcacggtcggcactgatcgcgagacatccaagccacgcaaccgactcgtcgtattgcatgacggcgtggtttgggccggctatgacaagcacttcctgcccaattatggcgtgtttgacgaattccgcattttcagtcctggcaataagtccatggtgcttgatgtgaatggcgcacgtattggtgtggctatttgcgaggatatctggcaggatggcggtcctgtggcagaacttgccgagcagcatattgatttgctgcttaccatgaacggttctccgtatgaggagggtaagactgatactcgactcgatcttgcggtacgccgtgcggctgaagtgaacgcgccgatggtctacctcaatcaggtgggtggtcaggatgatctggtgtttgatggcggcagttttgtggttgacgctgacggtacactgctggaacgttctccgatgttcatggaggatttgagcttctttgatttggatactgcctccgaacatcagcaggttggtgttatcgcggccaagcctgatccggatgaggaagtgtataccgcttgtgtgctcggcttgaaggattatatggccaagaaccatttcaagggcgtgtgccttggcctttccggcggcatcgactccgcattggtggcggccatggccgcggacgccgtgggaggagctaacgtgtatggcatttccatgccgagcatgtactcgtctgacggttcgaaagatgatgccgccgatctggcgaagaatattggagcgcactacgacattcagcccatcgaaccgctgttcgtctccttccagaagcagctcgatcttgaaggtgtggccgctgagaacctgcaggcgcgtattcgcggtgtgattgtcatggcatattcgaattccaaggggcttctggctgtcgccacgggcaacaagtcggagcttgcctgcggttattccacgatttacggcgatgcggtcggcggatacgctccgatcaaggatctgctcaagacccgtgtgtgggagatctcccgctggcgcaacaaggctgccgccgaaggcatgggcattggcggactgcatatcgtgggcaacgagcaggggtctgcggggacgccgttgccggacggcgtgatgattcccgtcaattcgattgaaaaggctccatccgccgaacttcgcccggggcagaaagactccgattcgctgccggaatatgagctgctcgatcaggtgttggcaatgtacattgaacatgcgcatggtcgtgaggatcttctggcagacggtttcgatgagaccaccgtcgacacggttatgcgactggtcgatcgtgccgaatggaagcgccgtcaatacccgcttgggccaaaggtgacggcattggcgttcggccgtgaccgccgcttgccgattaccaacgcgttccgcgaatagaacagcggcggactattgtttcgttacgcgcttcgtaaggagtgatatggaaaagcaatggtatttcaatacggttaccgaacagcctgaactgggcatgatctcaccggcgagccatcgtatgggaccatacaaaaccagggaagacgcgctcgatgcatggaagatcgtgcaggaacgcaacatcaaatgggaagaacaggatcgcgaatggaaacgctggtcttccgatgaaaagtagttgatgcgatataagaaatcgcggtgtctggattacggcaccgcgattttttcttatacttcgcaagtgtgacatatgtcacttttatttcctctcaaactcaggttctttacaggttcgtgcagctagaatcggtaactagcgacgacgtaacgatgcgtcgccaaaccaacacccagaaggagtggaaatggcagcagttgatgcgacggcagtctccccggaagagcttcaggctaaggcttgggaaggcttcgctgagggcaactggcagaaggacattgatgtccgtgactttattcagaagaactacacgccttatgagggcgacgagtccttcctggctgacgccactgagaagaccaagcacctgtggcagtacctcgatgacaactatctggcagtagagcgcaagcagcgcgtctacgacgtcgacacccacacaccggctggcatcgacgcattcggcgccggctacatcgactctccggaagtcgacaatgtggttgtcggtctgcagaccgacgttccttgcaagcgcgccatgatgccgaacggcggttggcgtatggtcgagcaggccatcaaggaagccggcaaggagccggatccggaaatcaagaagattttcaccaagtaccgcaagacccacaatgacggtgtcttcggcgtgtacaccaagcagatcaaggttgcccgccacaacaagatcctcaccggcctgccggatgcctacggccgtggccgcatcatcggcgattaccgtcgtgtggcactgtatggtgtgaacaccctgatcaagttcaagcagcgtgacaaggactccgtgccgtaccgcaacgacttcaccgagccggagatcgagcactggatccgcttccgcgaggagcatgacgagcagatcaaggccctgaagcagctgatcaacctcggcaacgaatatggtcttgacctgtcccgtccggcacagaccgctcaggaagcagtgcagtggacctacatgggctacctcgcttccgtcaagagccaggatggcgcagcaatgtcgttcggccgcgtctccaccttcttcgacgtgtacttcgagcgtgacctgaagtccggtaagatcaccgagaccgacgcacaggagatcatcgacaacttggtcatgaagttgcgtatcgtgcgcttcctgcgtaccaaggattacgacgcgatcttctccggcgatccgtactgggcgacttggtccgacgcaggcttcggcgatgatggccgtacgctggtcaccaagacctccttccgtctgctcgacaccctgaccctcgagcaccttggacctggcccggagccgaacatcaccatcttctgggatccgaagctgccggaagcctacaagcgcttctgcgccaagatctccatcgacacctcggcaatccagtacgagtccgacaaggaaatccgctcccactggggcgatgacgccgccatcgcatgctgcgtctccccgatgcgcgtgggcaagcagatgcagttcttcgcagctcgtgtgaactccgccaaggctctgctgtacgccatcaacggcggccgcgacgaaatgaccggcatgcaggtcatcgacaagggcgttatcgagccgattcagccggaagccgacggctccttggattacgagaaggtcaaggccaactacgagaaggctctcgaatggctgtccgagacctacgtgatggctctgaacatcatccattacatgcacgataagtatgcatacgagtccatcgagatggctctgcacgacaaggaagtgtaccgtaccctcggttgcggtatgtccggcctgtccatcgcagccgactccctgtccgcatgcaagtacgccaaggtctacccgatctacaacaaggacgccaagaccactccgggccatgaggacgagtacgtcgaaggcgccgatgacgatctgatcgtcggctaccgcaccgagggtgagttcccgctgtacggcaacgatgatgatcgcgccgacgagatcgccaagtgggttgtctccaccgtcatgggccaggtcaagcgcctgccggtgtaccgcggagcggtcccgacccagtccatcctgaccatcacctccaacgtggaatacggcaaggccaccggcgccttcccgtccggccacaagaagggcaccccgtatgctccgggcgcaaacccggagaacggcatggactcccatggcatgctgccttccatgttctccgtcggcaagatcgactacaacgacgctcttgacggcatctcgctgaccaacaccatcacccctgatggcttgggccgcgacgaggatgagcgcatcggcaacctcgtgggcattctggacgccggcaacggccacggtctgtaccacgccaacatcaacgtgctgcgcaaggaacagctcgaggatgccgtcgagcatccggaaaagtacccgcacctgaccgtgcgcgtctccggctacgcggtgaacttcgtcaagctcaccaaggagcagcagctcgacgtgatctcccgtacgttccaccagggcgccgtcgtcgactgagactgaacggtaccgtgtgaagcggtagagtgcaaggggcggagcgtgaaagcttcgccccttggttttccctgtacaatgtgggaaaaccattggagagatacaacgaaaggacaccgatgtctgagaacgtacattttcgctccacaacaaggcatatgctcagagaatcgcaaaactacgtcaaccaaacgcttatgggagggttgtcaggcttcgaatcgccgatcggactggaccggcgtgaccgcatcaacgcgctgaaaagcggtgatatcggcttcgtgcattcctgggacatcaacacgtccgtcgacggtccgggaacacgcatgaccgtcttcatgagcggttgcccattgcgttgccagtattgccagaatccggatacgtggaaaatgcgtgacggcaagcccgtctattacgaggccatggtcaaaaagatcgaacgctatgtggatcttttcaaggcgacgcatggcggtatcaccttctcgggcggcgaatccatgatgcaaccggcgtttgtttcccgcgtgtttcgtgcggccaaggagatgggtgtgcacacctgcctcgatacttccggattccttggcgcaagctataccgacgacatgctggacgacatcgacttgtgcctgctcgacgttaaatccggcgatgagaaaacctacaagaaggtgactggcggcattctgcaaccgaccatcgatttcggacagcgtctggccaaggccggcaagaagatctgggtgcgtttcgtgcttgtgcccggactcacctcatccgaggaaaacgttgagaatgtggcgaagatctgcgagtcgttcggcgacgcagtggaacatatcgatgtgcttggattccaccagcttggccgtccaaaatggcacatgctcaacattccctacccgttggaagaccagaaagggccgtccgaggcaatgaaacagcgtgtggtggaacaattccaatcgcacggcttcaccgtctactaaacaggagaccacgcacatcccgtgacggcgatgcttaggcaaatcaaccatatgaaagcacctcagcgatcgaagaacaggggattcttgcgcagtttatgaaaccagcattcgccacgcggaaaaatcttcacattcgacgcgtggcgaaatgctgtgaaataccgcaaaaccggcgactctgccgtagccttgaatcatggtggacatctatgcttttcctcaaggcacgcccaacgaagcgcgtgccacaggtaggggatcgtgcgcctacgccgaccctcctgaacaaatgttgacccgaccttccggtgtgccagacaaggtatgggacgccgtgctttccgtagaacgcatgcctcgattaccaagcgtgtcgtatcgtgagattccagtgccgtgcgccatggcgagtttcggcattggagttgagatgcaatgcgacgaggcgcgttccacaggctggatcatgatgttgtattcgcacaaataccgaaatgactggcattctcattggcgttgcgtcgctttcgccgcgttgccgttgtctggaggcgaaggcgattgtctgataccgtccatgtattgggatgcgatgatggaccgtgttggttcgtgcgatgccgaacatgtttcgggaaccgtcacagtcacgaaaagcacgacgtttggcactcagtccgacgctcccgaaaccgggtgtgagattcgtgtgtcttggacgccactagactatgccgatggaggccttgacgcgggcgcccaagtgggcgcgtgggctaggttcctccggtccatgacgcaatccgaggaggattatcccgttgactgacgagccaaggttgcaggccgagccgcgtgagggcgtgcccgatgtgatcgacaccctaccggcattccgcgagtactgcagcgcattggcgtcttcgcatgggtctttggctgcggatgcggaacgtgcgtctggcttccgatacggtcatgacgattggttggtgcaattcaaaagagacggtgccggcataggattgcttgatccgcaggcattggctgcggaaggtgccgattggaacgatttcaatcgtgcggtgggcgatgcggtatggattctgcatgattcgttgcaggatctgccgggattcgttgatttgggattgcagccgaaacgtttgtttgatacggaaatcgctgcacggctgctggggctcaaacgtttcggattagctgccgttaccgagcattatctgggactgacgcttgcgaaagagcattccgcggccgactggtcgtacaggccgctgccccgagactggcgtaattatgcggcgctggacgttgaattgctgatcgagcttgaaacgaccatgcgcgccgaactgcaaaagcaaggtaagatcgaatgggctgaggaggaattcgattacgcgctgcgcgaaggaactgcgccacgtaaggagcatcccatcccatggctgcgcatctcgcatatcaccgaaatcatgagggaccgccaggccctggccgtggcgaaagcattatggaccaaacgagatgaactggcacgcgaatacgatatttcgccgacactgctgctcgccgacagcaccatcatcgaagtggcggaacgcaagccgcataacgccgcgcaattcagggcggtccgttccatcaacgagcgtgtacgcatccaagccggtgccgaacaggagaaaatgttcgaacgttacgcgccgatccaacgtaaaatcaagccaagcatgtggaagagaataatccaacaggcgcttgatctgccggaaagcgaatggccggtcatcgaaagcggcaatccccaaaaccaggaggcgcagagcatatccgctccacgagcgacgcgagtctggagggaacgttatccggaacgtctcgcaacgcttgacaaggcacgcaagatggtggcgcagatagcggaagacacgcgtacccccgcggacgtcatcatcaaaccgcagtatctgcgcaacctgtgttggaccgacgaaccgcaaaaacgtgacgttgcgcaattcctcaccgagcagggcgcgagggcgtggcaggtcgcgctggttgcagagtccgtgagtcgcgctatcatgtagaggttgcctaacggcagaaatgtgaagaaccgtatttttcaggagcgcaagcgtgaaaatcagcgtcaggaatcttgagccgaccaaggtgaagctcaccgtcaccgttgatccggaagagttcaacccgtatctcgacaatgctcgcaaggaaatcgccaagcaggtcaacgtgcctggcttccgcaagggccacgtgcccggcaagatcatcgaccagcgcatcggcttcggtgccgttgctggcgaagccgtgaacaacggtgtgccggagctgtactccaaggctctcgaagaaaagggcatccgtccgatggcccagccggaaatcgacgttcaggaagttccggaatccgccaaggacgagaccaagctgaagtttgtggccaccgttgagcgtcgcccggacatcgaactgccggaaatcgacggcatggagatcgaggtcgccaaggccgaaatcaccgacgaagacatcaacaaccgtctggaagccctgcgccagcgtttcggcaccctcgtgggtgtggatcgcccggccgccaagggtgactatgccaacatcgacctgaccgccgaaatcgacggcgaagtggtcgactcccaggaaggcgtgagctacgagctcggctccgaaaccatgcttgacggtctggatgaggctctcgaaggcctgtccgccggtgaagagaccaccttcgaaggtaccttggaagcaggcgagcacgaaggcgagaaggctcaggtcaaggtcaaggtcaactccgtcaaggctgaagagctgccggaactcgacgacgacttcgcttctgaagcctctgagttcgacaccctcgacgagctgaaggaagacctcaagaaggccgcttcccaggatgccgaaggtcgtcaggccaccgcagctcgtgacgctttcatcgccaagctcgaagagggcctggagattccggtgccgaagggcgtcaaggctgaaatggttgagcagcagctcaagggcgtgaccgctgatccggccaatgccaccaaggagcagaaggccgaagctgaagaaaccgtcgaaaaggaactgcgcgaccagatggtgctcgacgtgctcgccgagaagctggacgtcaaggtctcccagtccgacgtgttcaacttcctcgcttccatcgcccagcagtacggcatggatccgaacgccttcatccaggccatcatgcgcaacggccagctcggctccgcagtgcaggaagtcggccgttccaagggcctgctcgccggcatgcgcgccgtgaccttcaagtccgagggcgaaaccctggacctgagcgccttcctcggcgaagccgctgaagatgaagaagccgagagcgttgaagctgcttccgcagccgccgcggtggctgacgaactcgcttccgaagagtgagcttctcttaatgcctgactcgtaagagtcatctttctagggcgctgaggggtggaatccagtgtggatcccacccctcaatttatttcgtattcggatctttaaccagagcaaagagattgctgaaacgtgagctacagcaggaatttgatttcggcgaaaaactcacgaaccatattgttgacgagcatatccgggggagagccggccgcaatgccttgggcgttgtctaagccatatttgtcggcaatctgcaacgcgcgaaacatgtggaaattattggtgatcacgcctatggaagcattatcgtcgttgatcatcttcttgctgttgacgatgttttcctcagtggtttttgaatccggctcctcaagaatgcgctgttcggcaataccatgttccttaagatagtcagccatgccttgggcttcggggaacggttcattcggtccttttccgccggaaacgatgcagatggtattcggattctcatccaaatactcaatagccttgtcgagacggtaacgaagcacaaggcttggcccggacttgcgcacctgagctccaagcaccaccacataatcgagatttggttcaccttgcgcatgcattttgctgacaatgcaaccttccaccgtgccgaatgcgaccagaccgacgcatgcgactgcgattgccacacctctgaccagtcttggcagcatcgcccaccattggaagagcactccgaatccaagcacggcgaacagcgccgcgaatgctagccagacaatccagaatactgtgccggaatgcgtgttacgcactgcgaaagagtaacaaacacataccgcggcgagcactatgcatagcgcgcccgcaattcgtctaaccaacgttgccatatgaacctctcattcattgcgcgtcacacgcaatcctgtctcatcctaagcgcgtgaccccagacccccaagcgtcacacgccaatgccaacaaatcctacgcattcctgttatttcaataccatgcgcattatgtcatccgtgagcggagttttggtatggctgcggctaggatgggggagcatgacttcagaaatgattatgctccgaccgatgcgtcgcacggattttcccgcgcttgaagagcttgtccgtcaggcttggtatgtggatgatgagtcggatgataatgggaacgttccgaacgatgagcgcgggttacgtaagtataagctgcgcaaggcgattcacttgcgtaatatgcatcgactcgcggccatcgacatgcatgattttctttcccgcaccaccgaggctacggtcgctgaacgtgatggtcgggtgcttggcgtggtattgggctcgttgagatcccgtgttaccacagcgcagaggatacgtcatgctattacgcgaaattgcttggcgttgcccttgttggcaagtaaggatggccgtcgaggacttgccgatcagattgcgattttgcaggtcgatgaagtgttgaaacgagatgccggcaaaagctatcaggctgagataacgttgtttgtggtttccccggaagcgcggggcatgggcgtcggacgtaagctgttcaaccacatgcttggcgtgtttcgtaatgccggaatgaacgagtatttcctcttcactgacactacctgcgattacggtttttatgattaccgtggtttgacgcgcaaagcggaacgtaccatacgcagggattcctttactcaaggtggtttggaagacggttcgctttccttcttcctgtacgaggggcgctgctgaacgtttctgcccatcactgtgaaaggcgagtgattgaatcactgagttcatcggctatccgatttggtggggcggagccgcatggccggccaatcactttgtgaccgaccatgacttcatcggcaagaaagtcattctattcgccgcttcttcgtcatcaccgctgggcagcagcggttctgacttgacgaccatggtcggcaccggtgattggcaggaaggacaacggctctcgtccaacgcctcggccggtgaagtctcctcttgggtggagagcctcgacctctaactcagcatatatggcagatactgccccgcggagtcaagagaatctagtttcgagtggtttccttgagtgtgggagccaaagtgccggccaaggccttctctcctgggcgggaaagcggaccgactagctcatgcgcggtatacggctcttcgagatagtcggtgtctagacgcttgagcgtgccgccgatctcgtagtcgatggtccactgatggaagtccggtgaggttttgccgaagctcatgccgccaaggcatactttggatactttgatgccggaccagcctagcggcgcgtacttcatgtcggtcatgatcagatggagctcctttgtcggttggatgtgtgaaatgttgctttctatagcaccgctcggtccgcgaatgaacctaatgcgtacctcttgcctctattatacgtatatgcgtttgctgtatggaaaagcatgttcgtcactcgttatacattgacatggcattttcgtcgaggttcaatgaacgcgtattacaacgaaaggaccattatggaaaatccaagcgcattccccataggagagccgaacgacggctttgcccagtatttcgtaggtcaaagctatctcgcgtcggtgctcgactctcctgaattttccatccacaacgtcaccttcgagccgggatgccgcaacaactggcatatacatcacggcggagcccaggtgctcatcgcagtgggtggtcgaggctactaccagatcgaaggccaggaacccaaggaactcaaagctggcgaagccgtgtgcattcctgcagacaccaagcactggcatggtgcggctcctggcgaatccttctcccacctggcgttcatggttccggcaggagcccctggcgcgatgagcaacgaatggcttgaaccggtcgatgcgcaagcgtacgagtcccttgcctgaacagacgggcgcatacatgtgattcagccggggtcaagtcagactcggctgaatctattcgccactcatatgtgaaaggcttatctcatgtctgtcctaaggtgggatgggcgggaatcgagaataatcgcaaacttatcgtcaattgcctgccgttgacatcatccgaacaagcgcagttcatgcgtgcagccaaaagcgtgccgcaagaattcgtaggcgatccggcgcagcgtggcaacatggcatggacggccatcatccccgaagagctcaaagctcaagtcaccgccatcattggcaatgttgatccgggaatatgccgacagtgtcccaaactcgaatggttgcaaacctggagtgccgtcgtcgacaaataccagcgacccggcatcctacagcccggatccatgcccagggtggaattcactttgattggtcggcgcaccgggatgcaagccaggcgaggatttgctgttcactgacgggcttgaaatcccatgcgtcgagtcccacgttcacacttcgcggatcggtgccgtcgggaacgtcctgatgcgtatggccgtagagcagccagccttcggtggtgggcgccatatcggcgaactcgttccagttgctcggccagtcgccgtgttcttcggccaatgccgagagtctggggaagtggctcatggcgatgctttgctgcgtggtcgccaccgttattttgccggattcatcgagaacgggaagttccatgtcgatttcgcggtagtcgtcgatggtctcgaacacgtcttcgtatagcatgtcattgaatcggaggcggaagttgcggtcgtggttgccgatgatcaggtgcagatgttggcagttgattcggcgcaggcattcgagtgtgtgctcgacggtgcaacggtaggagaggtcgccgagaatccacagttcgtcgtcgtgcccgacggtctcgttgatgttgccgatgatggtgttctcgtggcgtgtgatgtcgcagatcgttttgaacgatgtctgattgtcgcgcacatattgtttgatccacgtgtgtgcggcggcacgcccctgcgcctgccagacatcacggtattcggtgcggagcctgccattgttcaggaatccgcgcagtgcggtgaccagagggtggccgaaatgcgtgtccgaagtgaaatagcgcatgtggttccttacggtatgcgattgctggatgcctttatcaatgatagagcgcaacattacgagaaaagccttccccaaaatgcttgttggcttgtttgtggcactgtttggcgattatggcgagtgtgagcgttggaattccaacgctcatacttcgggtttcggcgttcggatgccacaaataagacaagtagcgaaaatcaagtagtgaagacgggctgggccggcttgatttattcggtagatatcagtgaataattacacgacgcggcaagatcgatttaccaggaagcgcaatagtccgagcggtttcccgcccatcagtttggatgaggagagtacggcccgcgatcatgcggcgcatgtggggctgtgaggggctgaagcattgcggggcatgcatactgatggaggctaatcagaggaattccgtgaaaaaacaaaaaactgatgtttccgcagctgatacaccgcgtatgttttgtcgtatcctttaacgaatatctggggggcgccaatcaggtgcatgttcatcagatgggttcgaaagtgagcgagaagcctcggtctttgccaatggcttgcgatgaggattattacggataaagttcgtccctgtttgacgctctagacggtaattagcttgtaagctaatatatcggtatgggaacaatacatgagcttaacgaaaagcgcaagcgattaggtttctcacagaaaagcgtggcggaatccatgggcgtgaccgctcctgtgctgtctcgcgcgcggtgaggggaaatccgacacaggcttttacccggcgttatcaggatgcgcttgacgcgatttcgcgggacaccacgcctcagcagatagcggagattgctcgtcctatcgcgctgcggcatcatgtcaatgaactgtacctgttcggttccatggctcgaggggagggacatgcggattcggatatcgatttcatctatcagtttgacggcaccgccaatccaatgattgatgagtgggctttgcgtgatgatcttgcatcgacttttggtcgggagatcgacttggtgaaaaaacgatacattaccactgaactgcaggacagactggctgaaatgcagcgtgtgatattcgtcaattccataacctccaatccgatgttccgcattatctgaggtgtgtcatatttatcatttccttcgatactgggctttctcatgacaatgagattcggggagctgacaaatattggtcaggtggctgtgtctaatgccaccgtttaggatggcataatccccagaaatagtcatcattcgactcagcttgctttataagcatggatgaatatgtggaattcttttttattccatcgattaaatccatgagaacaataagagatttccagacggagcggtcttcataagcatatgagccatagcgctcagctgtggcatcaaggactgggggaggaaggacaatctccctgttccaaagacggcaatggtgcgagcaaatgttgcgtagatacaccatgctgtgaatgatttgcgcagcacgttgacgatttttccctagagaaagcgactgattgagttcgtcaacagctgttgtgttggtatgcaatgaaatcatttttgagagagtgtcaaagggcatcgcctcgaccgccgcccatatgggaataggctcgttgttattccgataatggcgaatgcatacttcgctggaacgttcaagccatttgtgaatgttctcaattagaacttctctggcttcggtgccgtcaggatatttgattgttttatatgaactgagatcagtgtaggagtaggcaccttcattttgggcaaggtagtaagcaaaatgggcccgaagcgtttgttctaaggatgatgttccacgaaggatgagtagacgtagctgttcatccatcaaataaggaatcatgaaatccttaatgtgcgttccatttcgaaagcgattattgccatgagaaggatcaatctgaaaggctcggaagtagccggacaatctgtaatagttgcaatcaaggaggacggtgctgaattcggagaatccggtgatatccaagccgcgttcttcgactaaaagcgtcatcatttcctgtattgtttttggctgcttcgtcatggcgtatccttgtgcgacttgataaaaaaagagcccccggatttgagcattgttaagaggcttggaggctactgttattggttacgatagcatagttggttcgcttggtcgattcgagcgtgtctcaaggaatgctctaccgttgttacagagaagaagagacccaccgcgtttcaggacgtaaacgtagccttggataggactgtacattctttggcgatttgaacatgccgcatatcatccatcgaacgaatgaaggagcagataccatgggcattaaacacagtgcgtcttatcagagtgaggagaacatggccaagaactcgagtggtcgattggccgatgtgctcgtgcgcaatctaaatggtgagttcgatgagaccggtatggaactccgcccggaattcagaaaagctaagtcctcggaagacgacgaagtcacgattcatgcgattgagatagatgactgaaaaaaaccgatgggttggagatattaaaaaggagaaggcgacgcatcggctcctcctaggtgtcgcccgaaggcttccaccgcaattaaattgttaacctagcatgaaaacgaatgccgcacgtcgataggacggtttttcaattctctttttgcaattcgccagaacacgcgatgccgttatcgcacagatgctgcataagttcatccagtgttttcgttgcacctctatccgtcgaagtcataagagctaattgtaacttgaagcatgccgtaacagtgtggcatctgctggctcatggtgttggaggaatcttttcattacagccatgttttcggacactacccgatcatgacgggattatgacgggattcggattttgatgacgcgattatgacgcgattgcgacgcgattcggattacaatgacgcgattgcagcttgcgtattccccgattcaatatctcgttgtgcgttttactgccaaggagtttcatgggagcatcgttggtttccttggcgattgaacatgccgtacgaatgacgaagtatgtgatcaagatctgagtgcgcgcatttgtgcgtgcaaatacgtgcaaatgcgcgagtggccttgattgattcgttgacttgaacgcagaatctatctgctggaagtccctcgcgctcgcgaagaaaacatggcttatggtaaatgcgcattgttcgcatatcatccatcgaacaagtaagtgagcagataccatgggcgttaagcgtagtgcgtcttatcagagtagggagaacatggctaacccggattcaatggatggaaagtggaacaggctacactttgatgggaagacaaagaaatacgaatgaagagggttggctctatgacttccgatgattcgctgtttgaggaagcgaaaagtgacaaggacacacgtaaggcggttcaaaatcaaattgcggatattaagaatttcgtcaagggcatcaatattgatgaattcaaaaatggagaatggtttgcgaagttgctgaccttctctcttgataagtatgtccagaaggtgaatgctgactattttaggggaaaatatcccaaccttcctcctgatgcaattgtccaagcccgaataaaattagcggccaaatatgcggggatagaggggtctttgactgcagcggcgtattccacagctgttattgcgaccctaggatcagctggtggtgcttcccctgttactgggccagctggtcttactgcgttcggtgtggatttagtttatgcttctcagctgcagcttcgtttggcatatgatattgcagttttatatggcgttccactggatttggacgatcctgaagatttgtggaaactgatcagaatagcttttgccatacaggttggagaggatgccggtaatgctgttctaaaaggggtcccggctgtggtccgaccagtggtaaaagcgattttttcaggtcccagactcgtcgcagccaagagccttccggttatcggcaagtatttattgcagcgcaatatcatcaaaatttcaattccggtggtgagcataccgctgtctacgggtgtgaattattggatgacgaaggtaacggcaaataaagcccgtgaaatcatgcgcaaagaggccaagatgattgaatccgcaaagcgcatggtgaatgcttcggagcattgcttggatgaattattatgggccgcttggatgattattgctgcaaatggtgcacagccggatgaggctgaatatacattgtttcattatctgactttgatcagtagcgagtcaggtgtctcagctaagacgttagatgaaatacgcaacactgtagaagtggattattccaaaatctggagcatgctgagtcaaattagtgacgctgctccgatttatcgtgcatgtactgttatggcagcggtcgatggcaagattacaagccaagagattgatgtgcttcggcgtctggcagattgctgcggtgaggcttttgatgagcaggaacttcatgaaaaagcgaaacagtggcgtagatgattcctttgcagtgaaagatgaagtcgcgacttatgcgattgagataggcgactgaaaaaggtggggctgggagcggcagctgaattgtctgctgctcccagccccatcgctcaagtagattacttgtagtctaattggttaatggactcaagtattggctgcaaggttacttatcgtgcttgaagaatccgttccagagcttttgatctcgtctaatcttgattaaattttcctcatcgatttcttcgatctgcggtatgagttgagacttccaattgcatagagttttaataatctgctgattttcggcagtgtttggaaggatgatgcacttgctattaggatcagtgaatttcagatagtcacctccgactttttggaaaaattgtttcatgtttttaacaatctcattttctggttgatcctgggcagtcacatattcaagagcataggcaaacatgacgattgccgatttaggctcaagcccggcatcaaaaaggagcagggtattgactaatccatcgtcatattcggcaagcttctgaagtgttcctctgtcgatggcctttccctttttgattagggtagttgatgcattgaggagatttggctcgtcggctccttccgtgtagtcgcggaaattgttcataatggcttccgcggatttctttaatcgtgaatccttattgcagacgatgtagcacgcttcattggggtgaagatccgcatcaccaagataattagcgaattcctgcgattccttgatccaagcttctcgcacgggccatggcagtccatccagggccttgaaggattctgccgtatcgacaacgagcccattcttgaggagttgggcatatatctcagggcaatgtgcaaggtcttgcttatccggctcgatggatgagatggggataggaccttcgagttcgagttcttggagaaggtgtattttcctatcgctattcagaatggtgggtggaagattgattgtatcttcagcgagtttttctttatcaagtttctcgtctgtatcgccctgttcgaaagagtcatgtttttggatccacgtggtcattgaggattcatgttcggtgagcgcgtcatgggcgaaagcccactgtaggttcatcggagtgaaatgaactgcatcgcattccatgagtgcatcggtataatcctcaaaatgatcatcaaaaaggggaagacgggcagctgacgaacatttattcaacagtgtatggataagcttttttgtatcttcttcatcggtttgttgacgaatatcgtcaaggatgtggagcaggtcatcggcgatattctgattagaagaacaatccaatgcatattcatctttggtcagaagatcaaaatatttctcaaggtgcccaagcgcattcgcatacactgttctgctgatatgcataatcatgttgagcgcaggaagtctattgcaaacgctatatgaaccatcctgattattatctgattggcttatggtgtccaacgcggtttcaagattacctcttgaaaatacgtataggttctgttccacgcaggggtatcgcaatccagaacttgaatccttataacccagctcggagagggagtctattctgactttcccatcgttgagaatctggactataggttcaacgagtgccggagcgatattggaatccctgaagattgagatgcttcgccaatggttctgaagaaaatcagctaggttaccgtctacggtgtattggatttctcttgatagatgatggaacgccacatcaagctgctggcaaagcatgtcagtgcctgttgttcctcgttgagctaggaagctaagtaacttttggctgcggcttgccatcttgtcgagcaatgagttagctttatcgtcaagacggtccagatatgctgaaacgaattcagaggtctcgttgtccaatggggatagcatctcgatgatttgattagtgtcctggactacttcagaatctttattctgcgacagcatgtaatgcagcagatcaatgttcagtattctccgctggctgaaaatcgttttgtctcgatttttgattcgacggaggacgtctttagtgtccttgttgtcaagtttgaattgatagtcaggattgttgccatcgatatgatgaagaataaaattcagtgcgttcctggttactccttcatctgtatatattgtggaatagagcatatagtcctggccgatccatccgtgtgagatgagtcggttcagcagagaattgtctccacctagtaaagcataaagttcttgattgtgacatggtttcgccgcttcatagtgggtaataaattcccagtctcctgaccgaagtttttcgatcgtcagtgatgtattattcttctcatctataagatttttttctttatcttttcgccagtcggtgtctagtgatttacccatgatccttttaaaagtctttattgtggagctgaaatcaaatgatggattatcatagtaactattgtgaaaagaaattcgaatgttgattcgatcggtttctttacagcgagaaatgtcgtcccagagtttcggatcgtcggcagcatatgtattttgactgttgtttggaatatttatattaattgattggcatctatctgcttgctgattattcaaatcggcaagcagatagataaggtccgttcgaagctcgctagcgtattcttcagcggctctgccatttgagatttcgttgattttatattttagatttttgtttttgtaatctaatgcggaaatatcttcctgtattatctctcttatttccttatagatgtggtcaagcctgctccggccgtcctgtaactttatggcatcatcaaggtaacagttcttgtatataaggattgcgagcatcttgacaggggacagtccaagattggtccttttcgggttaagcagctgctctttataaacaatgaactcattgcgaatattgatccaagtgcgtttatcgggaactgcatctgcaacgagctcaagaagattgatcatttgagggtcattcgcatcaagaacatcttccaatgtttctagtgcgatttgatatgaattgcttgccgagacgaatggcaccactggaatgatgaggtcaaagaacttcgcgcgagagaaagaatgagacagagattctttattactcacctgttcgtcagccaaaacatattgattgctgaatatcgcatcatgaatagcgtatacgaactgtataggtgtactgggctgagaattcttttcttctgcggaaggagagaaatgcaatcgttgactgattttctggattgtcgattctgtgtgtcgcagctttgggtcgttattaagaatctgatttaattcgcgtaatgaatcaaagatttgagcatcttgaaaacgatcaagatcttcgaaaaatacagttcggatgcctgtcttttcaaagatatatatgatctcatcaagatactgatcgaaataagagtccgagttctccccaagggtaatgcctgctgttccaacatctattttggctagatggatgcgggtgccgaaataatggaatagtgcgaacgttgctattagtagcaggccaattatgacgatttcagcaagaattttggtaatgcttgttgggattggtagccaagtcaaaagttcttgaatacgattataaggccatttatggatatcaagaataaacagtaaaagtgttccgcaagcaagggaggaaagtagctgcttgcctagtccgatttcatttatcctatggaaatgcgatgccggaatctttccggggtctgttccatatagaagttgcttaatgatctctttttgaatgagattggttgtggatgaaggtttggaagattttgggggaagtgccccgggtgcttctttcaaagtgggatcatccttatccgagacggaatcggttttcttatcatcctgttccttaagctgtgcagccaaaggcgccagcgagatcgttctggtcgtataagggcgtttttcctcaagatcttcgacgactttctcaagaatgctgctttttccggaaccatagacacctgatagagctatgttgtgtatcttcgtatcctcgccctgcaacgccttttcaagcctctttacatagggtgagtggctcgattcgtcatattgggggtatagaggcttgagctctggtatttcactttcagctgctgcattgctcttctcggtcatgtcgtaccagtgtagctatattaaatgatttactctcttctgtcggtagatttgttcggcatccgcatttgttgcattaagctgcgatggggaggtgaggattcgggaagtgataatcgaaagatatagatgattccaagtatcaatgcacgaaaacatgcgtgtatctaacattcatgcgggaaagcagaaggtttcaacccctaatgacatacaatatatgcgaaaacattgggattgagagcatatggggagcacacggcaatgaggcatggcgcacattcggaacgagaactgctttctcccggcatgagagttctgatccgcggccaagaatggcttgttgataaagtcgaaccgaacagccttgggaatcacgccgtctcatgtactggcatctccgctctggtgcgagatatgacggccacgttccttgatgatttggacacaattacacctgtcgatccggtgaagacgcgtttcattcccgacacctcggcaagagctgcgaagtcgcatctgttcatcgagagtctgttacgtgccactgcgccgaccgatgcgagggttcatgtcggcaacaaggctgccatggactccctgccgtaccagctcgttccggcgaagaaggcgctcgcctgtatttcgtcaaattgaggtggacgtgttcggcacttaatctggacaccgtcgcgaacacgaacaccaacgcgaacggccacatgaacttccaaccacgccaatccgcacggtgacggttgacgcgaacctggtccgcaggcgtatgcagcgcatccgccgcgactgctgcttgctgagacatgctttcttctttctgtatgctttttgctctattgatcgcacaaccatgtgcaattgttaatccgcaaaatcttttattgtttgaattacaggattgctatttttttgaaatctttttctattgtaagatttcgtttttaaaattatttttacgaagtgaggcaggcgggtcacgtcagacgattcccacctgccgtcgatcttcatggttgcgatggtgcgttgcgtatgtcggatcgcattatcgcgtttttcgttgtgccgcacggcagcggctgggcgccgtcagtccttgctggtgacggtgtagccctgctggttgccgtgatcggtgagcgccttgctgtagttgacgaaggcttcctccagagtgatgtcctcgctgtaggccttggagatctgatcgccgaaggtggactgcgcgtacgggttgtacggcaggtactggaaggcggagaccttgcgctgggcggcttcggagagaatctcgttcacgttctgaccgccgaagtagtcgttgaccttcttgttggcttcagtgttcggatcggtgaaggagtcggaggagaggatcttcttcaggctcgggaaggtgccggtgtcggccatggtctgggcgccgtcgccgtgggtcaagtattcgacgaacttgtaggccgcggcctgctgcttggactgggagacgaccgcgagtgcggagccgccgtcttcagcggagacctcgtcaccttcgttccactgcgggagctgggccacgcgccagttgccggcctggtcaggagcgccgttcatgaggttaaccggcatccatgcgccgatggtgagagtggcgatgtcgccttcgttgagcgcacggttccagtcgtcggaccagttggcgatcttggtgtcgacgaggtcttcgtcgatgagcttctgctggaattcgatgtacttcttcatgccggaatccttggtcatgtcaatggtgatgttctcgccatcaaccttccacggctgcgcaccggcctgccatgcctgggcggtgaagggctggtattccatggaggagccggaattgttggtcatgtaggcgccgatggccttgaccttcttggctgcctcgtaataatcgtcccaagtcttgatctgggagccgtcgacgccggccttcttgagcacggcatcgttgtagaagaagacttccgggccggaatcaatcggcagcgcatacggcttgccatcatactgtagcttgctccacgggcctgcggagaagtcgtcttcgagcttgtcggcaccgtaggcggtgaggtcaacgaggtcgccggtaaccgcgaactgggtgacggtcgggtcttccagcatgaccacgtcgggagcacccttgcctgccgcgacggcgttgctcagtgcggtctgggtgtcggatgcggtgccggtgttgttgaatttgacggtgattccgggattggccttttcgaagtcggcgatcagggccttcatggtgttgccggtgtcccagccccagaaaacgagatccgccttgtctgcgtctccggcgttggccttggcgtcgttgccgccgtcgctgccaccgcaggccgcgaggctggcgagggttgccactgctgctaccgctgcgagagccttcttcatgttgcgcatgttcttttccctttctgccatccgcttcgcatgctgattgcatgtcggtcgcatatgtttcggaacatccgccgcggaatgcacatgccgtgctttccacttggtgatgtttgtatgttcgcgacctgccaaacaatacccccgtggtgatgtttggactggtaggatggctttgtttcctttctgatacaaccgtgtaccattagctccgatgatacacggttgtatcaaggtgtcaagcaaaccggttcgatagcccccctgcaactgttgtgcgctattgaagcgccaacgaaatcatcggcgtttcgcacaaacagaatgacatcgtttgcacaataatctgcgattgtccgcgcatctcaaccaaaaaatggatcgcaagaaagctacctcacaagagaaaacatataaagaacatataaaaaggaggtctgcgaatcgcaaacctcccaaaacaacacatacgacgaagagacggactccgcaccgctcgatgtaagcctacaaactgaggaacagctcgtgaatgcgggtatcgtcggtcagttcggggtggaacgccgtagcgagaatcttgccctgacgcaaaccgaccacattgccgtcgaccgacgtttcgaccgtggcccgctcgccgacctcggcaacgaacggtccgcgaatgaacaccagagggaaatccttgagcaccaccgacgtatccgaagcctcggaagtcccctcctcaccagcagccgcggaaatcgcagaagagacagactcccccgacgcaaccaccacagcatccgcatcgtcggaagcgccgaaatcggcggacgcagcgaacgaaccaagctgacgtccatacgcattgcggcgcacgaccgcatccaacgcgccaaaatagacgttctcgtcgttatcgagacgacgagcgagcaaaatcatgcccgcgcaggtgccgaataccggctttccagcggcgatatgcgcggcgatcggatcgaacaagccggtcgaacgcagcaatttgccctgcgtggtgctttcgccgccaggcagaatcacgcggtcgatcgaatcgtcgaaatcctcggcggcacgcagcagtttccacggcgcaccaagccgatccagcatcgccgcatgctcggcgaacgcgccttgcaccgcaaggatgccggtcacgccatgctgcgcggaagccgcaccttcggcaacgtcagtcgattcttccttcgaaatgtattcaacggcaacaaccatcggatctccttacccaaaccatcgcgaatcatgcgaaacgggctgcgcgcggcgcatcgaacagacatgccgacagccgcgcacagcgcacagcgcacgaaatgacagcgcaatcactcgccgcgagcggccatgatggtttcgatctcgtcttcgttgatgccgaccatggcctcgccgaggttctcggaaaggcgtgcgagcaggtcggcgtcctgccaattggcggtggcctgcacgatggcggcggcacgcttggccgggtctccggacttgaagatgccggaaccgacgaacacaccttcggcacccagttccatcatgagcgcggcatcggccggagtggccacgccaccggcggcgaagttgacgaccggcagacgaccgttgtcgtgcacatacttggcgagatcgtacggcacggccagctgcttggcggcctcatacacctcgtcgtcgcgaagggagacgagctcgcggatctgcttgttcatggtgcgcatgtggcgcacggcctggatcacgtcgccggtgcccggctcgcccttggtgcggatcatggaagcgccctcggcgatacggcgcagcgcctcgcccaggttcttcgcgccgcacacgaacggcacgtcgaactggttcttgtcgatgtggtacacgtcgtcggcgggactcagcacttcggattcgtcgatgtagtcgatttcgatggcctgcagaatgcgggcttcggcaacatggccgatacgaacctttgccatgaccggaatggacacggcttcctgaatgcccttgatcatggccggatcgctcatgcgggaaacgccgccggcagcacgaatatcggccggaatacgctcgagagccatcaccgcgcatgcgcccgcgtcctgtgcgatcttcgcctgctccggggtggtgacgtccatgatcacgccacccttgagcatctgcgccagattcttgttcagttcgttcctgttgttggccatcgccagcctttcgtcgaatcgtattccaccctgctgcagagcggatatctcttgacacagatactaacgatttttcgttacaaaatcatgtgaactgaatatttgcacgtcttaaaaagttgcttttcttaaattctgactatcattttcatgattgtttcattttcttacgatttcgattctgccgacgattccgcaatttcattcgcttttcttgcctgatatgcgccattcgctttcgattcgcgcgcacggctcctttcgaccgcactttcgatgcacgctataagaaatacgaatgacgcatgattttcatacgaccacattgcggacgggggtgcagatggattcgcgtattgcgcactacatacgcagtatgcgatcagcgatgcgcatggtggaatcgcggtgcgacaccagcacgacggcgctcccccgctcggcaagatcattgatcgacccgagaatcaccgactcgttataggcgtcaagacggctcgtcggctcgtcgaacagcaccaaatcggcgtcgcgaaggaacatgcgggccaatccgatgcgttgcttctcaccctccgaaaggcggccacccagctcgccgacccgcgtatccaagccgttcggcagcgcatcgaccagttcgagcgcggacgccttggcgagggcttcgcgcaatacggaatcgggaatgtcgtgcgcgagatccgaatcggaggaatcagcggaattaccaccagcattactgctggaattactacagaaattactgccagaattactgtcagaatccgaaaaatcggcgtcattgcaggcaatagcgagattttcgcgaatcgttccgtcgaacagatacgtctcctgccccatcatcgtctgcacgcgccgacgccatccggcgtcaacctgcggcaatggaacatccgacagcgaaatcgtgccggaatccggatcccagtagcgcatcagcagtttcaacatcgttgattttccacgcccggacgggccttgaataccgagaatgccctgccgtgaaacatcgagtgaaacatggtcgagcaccggttgcgaggcgatgccggcaccttgttcgccggaggattgcgcttccgcggggcgtgccggactcatgccagtcgcatgctccgaccgcccgtttggcgtgcgttcgacggaaatacgggcgccggatccatagccgaatgtgacatcgcgcattgtcatgccctgatattccgggcgttcgctcccctgctcgaccacagcgggagcctcatccatcaacgcgaacaggcggcgtgccgaagcaaacgtttgcgtcagattcgccggcaacgcactcaacgcaagcgtcggcccaaacgagctggcgagcagcacgaaagccgcaaccaacgctggggcgttcgatcccacggaacccatccacatcaggccttccgacatatcggcggcagtggaaaccgcagtgcacaacgtcatcgcaaggaaagccgcaatcgccgtgaacagcatcaccaataccgcgccaaatcctgcaaaatcgccatttttcacgctcagacgcacacgtttgacccacagcgagcgcgtgcgacgctgaatggacgcaagccgggcatcgccttggccgaagcggatgatttcgccgatgccacgcatatcgtcaagcatttcgtcatcgagggcggacgactccttgcgcagttccggaccgatgccgcgcaccgcggatgcaaaaagtttcggcagtatgacgccgataatgaggtgcgcgatgatgagcgtcgccgcgaggggcggactgagggtgagtagcgcgagcgcgtagacgacggtagtcacgatggcgatgacgaccgggctgatggtgtgtgcgaagaagatttccagcagttccacgtcggtggtgaccagtgcgatcaggtcgcctttgcctttgcctgcaagcttggcgggggcgagacggcgcagggccgcgaaggctttcgcacggaatagcgcaagcagacggaacgccacgttatggttcatgaactgttcggcgtaacgcatgccgccgcggatcaacgcgcatacggccatggctgcgagcgccgcgagaacgctgaggttccagaccggcgagccgactgcagcgaaggccgccgcgatgccgaacaccggcaggaaagtggcggcgagatggccgagcgtgccgcagacgcacgcgacgatcatgtacttgcgctgcggcccaacttccttcaacaggcgcgcaataaggcgagacgtgggtattgtcttcgcgtccgattctgccgaatcggacatccgaacgcccgttttcgcaccctgtgcgtccgtttctgcagaatcggacatccgagacgtagtttcggcacgctgcgtgaccgattcgggagaatcggacatccgaacgcccgttttcgcaccctgtgcgtccgtttctgcagaatcggacacttggagacccatttccgcacgctgcgtgactgattctgcagaatcggacgctttaagtgcgtgggatgcagaggtggaatgggttgcgttattgcgtagacctatgttttccacggtttgttgggcgtggaacagtttggcgtatgttccgttggcacgcatgagttccgcatgcgtgccttgttccgccacgcgcccgtgttcgaataccaccacatggtcggcgtcggctgcattcgccatgcggtgcgtcaccatgatcacggttttgccccgatccgcaagcgcccgaatggtttgcagaatcagggtttcgctttccacatcgacgctgctggtggcttcgtcgaaaatgtagacggcaggctcccgcagcaatgcgcgcgcaatggcgatgcgttgcttctgccctcccgacaggttgcttgcgccctgttcgatggccaggtcaagttcttgcgattgcgcacgcacgaaatcgctgatatgcgccgcttccagcgcttgccacagttcgctttcggtggcatccggcttggccatcagcagattgtcacgcaacgttcctgcaaaaaggtggctttgcgccgccactatggcgatttccctcgtaagggattcgatggaaagatcgttgatttggtaccgttgcgtcgagttgtttcctgtgtttccggattgcagccacatacatccttcatatccggaaagatttccggagagcagttcgacggcggtggatttgccggatccggacggaccgacgatggcggtcacctgcccgcgccgcgcagtgaaagagacgccatgcaatgcgacgaccgaaccatcatcatctttcgacatgcctgtttttccagcaccaaccacaccggactttcccccgatttgtccagtttttccagtttccatatccgccgtcacagccgtatccgcagccacactcacagccgccgcagcatccgtattcacgtccacatatcggaacgacacgtcatcaaagcacacgtccacaccgttatcagaagcgccgaattccggcatttcctgcatcccatgcgcaggaatcggcgtatcaagcaatgcgaaaatacgcttggtcgaagtcatgccgttcatcgcaacatggaagaacgaccccaattggcgcagcggaatgaagaaatccgcggaaagaagcactatcagcagcacgccggcaagcggcaatgcggcaccactcgcatactgccagatcgatacgcccacgccggccgcggcacccccgtatgcgacgacgtccatggcggtgagcgagcgcagctgaatttgcagaacattcatggtcattacgcggaattgttccgcttgctcgcccattttcttggcggcatgcgcatccgcgtcaaaagttttcagcgtttcaagaccttgtacattgtcaagaaacacagatcccatgtcggtgtattttccccaatattttttgaatactcgggctgcgcgcattgcgaccatgccaacaatcaatacaatcaaaggcgcgcatacaagcaatgtaacagccgtcggcatattaatcggcgcaactataaaaaataatgttaccggtgcgagaatcgcataaaacagttgcggtaggaataattcgaagaagctttggatttgttcgatgccttcaccggcagattgcaccacgtcggcagtgctgatatgttgcgaatatgatggtccgatcgcaagcattttattaaaaagctgttcacgtaacgcgagtttgacacgctcagccgcttccgcgccgaaataggccgctgcgcgcatcatcagaaaacgcagtaccgcacagaccacgatcgccagcacgcatccgacgtatgtttccgcactgaatccgccgtagccaaagccgatgaacaggcgggaaatcaggccactatcacccatggagaacatggggtcgaacgccgattccaccacggcaagcgccggcgaaagcatgaccaccaccgtcaccacgaacacgacgttggccagcagtccgacccattggcagagcactttcgccgcaaccaaccgccccacgccgggagcgagggaaaacagcctcttgtcaaacataaacaccttccgtccaatgagcgcactcgcgttgccagctcgcctacggcccaaagcgcaatcgccatgcatccaacaaacgaatcgcaacaggccaatacgggaaaaccggtgcgtggcaaaccgttttcagcctatccaaggcagctcgcaatcgtcaagggcgcattgcatacagcgaaccgtcgcaatcgaattgccataatcgacctcaaatcagcaacgttgaaaagagaaaggctggatgttcgccgttgagcaggcagccctctgacgcaaggggtaaattgcgtcactcgtgagtgtactcgataaaaaacgctcgcaccaccatttcttcgcatttcgctggttttacggtcctttcggggatatatgggaagcatggcggttcccccgcaaccgttacgtcaagcctttttttcgaacggatacagcgcgacaccaaacacttgatttttgacggaatagcaccatttgtcagttcatacaaagttgatgaaatatttcttgtcgcttctcacaatgcagacttacggccccgtaacttagaatgtgcaaggtgcgcaaggggtaggaaacgcggacacacggtttgtatcgctcccgcacgcatcacaagcagaaatacgcggaaacaacgcaaaaaccgcgagaaagagaacgcttcatgctcaccgagtacaccaccccgggcgaatccgttgaggtgcgcgacgacgaatccatctattccctgcttactggacgcatagcgcgcactggcgaagataccgtgatcgcggaacacaaaaccgcccccggccaatggacgaaggtcactaccggcgaattccacaatgccgtgctcgccgccgcaaaaggcctcatcgcattcggcatcaacaagggcgatgccgtcaccatcttctccaccacccgctacgagtggggcgtgctcgacttcgcactggccgccatcggcgcggtgaacgtgccgatctacgacactgattccgcggcgcaggccgagcgtatcctcaacgattcggatgtgaaactggccatcgccgacaatcgcgagcgcttcgaccgtctcgactccgtaatcgaccgctgcccgtctctcaagcacattctgatgctcgattccaacgccatgggcgcgttggaaggcttgggcgtcaccgtgtccgacgaggagctggaagcgcgcatcgattcggtgcatgcagacgatctggccaccatcgtgtacacgtccggttcgacgggagctccaaagggtgccgagctttcgcaccgcaatttcatatcgatcacgcgcgcaggcagtctggcgttgcatgagatcgttctcgaagatcatccgcgactgcttctcttcctgccgctcgcccactgtttcgcacggttcatccagtacgcgtcgattgcttccgacgacggcgtggttggttatctgccggacacaaagacgctgctgcccgatttgcgttccttcgaaccgacatatctgctgggcgtaccacgagtgttcgagaaggtgtataacgcggcctcccgcaaggccggcacgggttggaagggacgcctgttcctcaaggctgccgaagccgcacgcgattggtcgcgcatgcagcaggccggcgaacgcccgaccgccaagcagatcgcgcagcatctttcgtatgaggcttccgtataccgtaccgtgcgtagcgctctcggcccgcgcatccgctacgtggcatgcggtggtgctcctctggacgtgtctctggcgcatttcttcaacggtatcggcctgccgatgattcagggttacggtatgacggaaaccgctgcgccgttcgccgcgacccgcgtcaccgacaatgtgatcggcactgtcggccaaccggctccgggatcgtctgtgcgcatttccgatgatggcgaacttcaggtgaagggcccgaacgtgttcaggggctaccacaacctgcctgagaagacggcggaagcgttcaccgaggatgggtggctgaaaacgggtgatttggcgtcgattgacgacgagggacgtattacgatcaccggccgtaagaaggacatcatcatcaccgccggcggcaagaacgtttctccgattccgatggagcaggagattgtgaaatgtccgattgtggagcatgtggtagttgtcggcgacaatcgtccgttcatcggtgcgctgatcacgttggatccggaaggattggaggcttggctgccttccattggactgtctgccgatacgccgttggatcgcgtggctgcgaccgccgccgttcacgacgaaatccagaagtacgtcgacaaggcgaacgcgaccgtttcccgcgccgaatccgtacgtaagttcgtagtgctggatacccagttcacgcaggaaaacaagtgcctgaccccgtcgctgaaagtggtgcgtccggcagtgaaccgcgtgttcgcacaggtgatcgatcagcagctgtactccggcaagcgctgaatcgcataatacataaaagcgtggggtacgagagaacgtttgtattctctcgtaccccacgcttttgttctgtctgtacaactttcaaggaatgcaaacgagcgccggtgatcggaagcgatccgacccgccggcgctcatatggcagagattagtgatgaatccagaatggctaacgacactccatcagccattgtcagtaaagcgacaatcagtgacggttccgtcagtgcataacgcgtgcggtaacggtgcgacagaaggcgaacgagggtacgtcgagtcttctgctgtgccgttaacgctccgttatgttagtgacggttgttgaggcggtggtacatttcggagatctcaaggtcgcgctcgaattctgcggccttggtgttcgcgtcgatggtggcgagttcgacaccggcgatgcgggcgaagtcttcccaagcctcgcgaccgacggaggtggtcatgcaggtgtggtgggaggcgccggaacgcagccagcactcggcggaggtcttgaggtccggctgcggcttccacaggccacgggcgcacggcaactgcttgagctctccgagcggctcgaccacgtcgaccaggttcatggtcaggcggaaacgttcgcgcacgtcagacatggacacgacgacggcgtccttcttcggggcgacagtgaagaccaggcgcaccggatcggccttgccaccgatgccgagcgggtggatttccagcttcggcttggcgatggtgccgacggacggggagacttcgagcatgtgggagcccatgatcatctcgttgcccggggtgaagttgtaggagtagtcttccatgagggaagcgccaccttcgaggccgtagcccatcactgcgccgatgcgcacgagcactgcggtcttccagtcgccttcggcggagaagccgaagccgtactcggacgggaagcgctgcgggccaacgcccggcagctgcgggagagcacccaagtcttcgaagttgtcaacgccggcggtgcaaccattggcgcgcatcatgttgaccatggcggcttcttccttggccgcgatgaacagggaatcgtacttggcgtcgagcagagccggatcaacgtcgtacttaaccttgtagtcttcgatgatgctcttgacctgatcgtccttgacggcttcgtaggctgcgacgagctcgttgacggcccaagtgttgatggatgcgccgaacacgcgctcggcttcggtcttgtcgccttcggtgacggccacgttgcgcatgttgtcgccccaacgcatgaccttcatgttgttggaagcatcccagccggcgcaggcgcgtgcccaggtgccgatttcttcggcaacggccggatcggtgtagtggccgaccacgatcttgcggttgatgcccagacgggtcaggatgtaaccgaactcacggtcgccgtgtgcggcctggttcaggttcatgaagtccatgtcgatggtttcccacgggatttcgaagtggtgctgcgtgttgagctgcagcagcggcttggtgagcacttcgaggccgcggatccacatcttggccggggagaaggtgtggcaccaggtgatcacgccgatgacgttcgggttggcggaggcttcgaccatgaaggccttgacgccgtcggaggacttcagggtcggcttaagcaccaccttgaccggaatcttgccggttgcgttgagcgcgtcgacgatttcgccggactgctcggccacctgacgcagcgcttcttcgccgtacagatcctgggatccgacgccgaaccagacttccttgccttcaaacgggttttccattgccatgtgattgttcctttacttcgttgtttatggagtttttaattatttattgcgattgcgaactcgcgcttcgcgttgttctgttgcgtagcgcgagttcgtacgattgtgaaattatgtaggattacggaatcgtaggattgcagctcagtgctggccgtagacgttggtgtaacgatcgttcagcttcgcgatatcctcatccgaaatcggaatgatctcacccaactgcctcgccgcccacatcgtatgagcgacctcctccgtcatcgccgcggccttcaccgccgactccgcgtccttgccgatggtgaacggaccatggttctgcatcagcaccgcaggagacttcggatactccctgagcgtctcgaccacgccctcgccgatcgcctcggaaccgatcagacggaacggacccaccggaacaggaccgccgaactcgtcgcccatcatcgtcagaccgcacggaatgttctgccccgtcgccgcccacgccgtcgcatacgtcgaatgcgtatgcaccacgccgtacacgtccggcatatgacggtagatgtacgcatgcgacgccgtatcggaggaaggagcctccgaaccgtccaccacgttgccgtccagatcgcacaccaccatgctcgacggcgtcaggtactcgtaacgcaggcccgacggcttgatcaccatcagatccgccgtatgcagacgctgcgacacgttgccagccgtccacaccaccaggttccacttgatcagctgctcgtgcaaggtcgccacgacctcgcgcacctgcttgacctcggcacgaacctcaggaccataatcagccaaagtagccataatcatttcctttcaaattgaaataagtttttaaaatatttatttacttggtttccagcggaatgctttcgattgcaacatgctcaatcggcagtcccttgcggaagcgatcgaagaattcctcgaatcctgcgacatcgccttcatccggattttccgtggtcgaagcggcatcggcgaacacacgagcgtcaaggaattcgtcgagcggctggtcggcgtgccacaggtagtcggctagcacggccatgccccatgcgccgccttcggcagcggtggacattaccttgatcggcgtatcgaatgcggctgcgagaatcttctgggcaaccttcggggtggtgaagatgccaccgtggccgacgagggagtcaacggcaacgccttcgtccttggtcatcacatccatgccgatcttcaccggggagaatgcgctgaacagctgggcgcgcatgaagttgccgaggctcatgcgggcttccggaccgcgcgcgaacagcgggcggccttcgggcagtcctgcgaggaattcgccggagcggaacgggtagttgatgagtccgccgcagttggagtcaacatcgtccgcgatggcggcgcggaacagcgtgccatacagggtgccggcgtcgaccggagtgccgattgcagctgcgaactgtccgaacagaccaacccatgcgttgaggtcggaggtgaagttgttggcgtggctcatgcctgcgagatcgcctgccggagtggtgacgaggtccacttccgggtgcaggcgttccagcttgcgttcgagtacaaccatggcgaagatggaggtgccggcggaaacgttgccggtgcgcacgcgtacggagttggtggccaccataccggtgccagcatcgccctccggcggagcgaatgtgattcccggctgcagcgtgcctgtcggatcgagcagcttggcgccctcttcggtcagcgtgcccgcaggagtgcctgcaaccagcggttccggcagcaggtcggcaagcttccacggctgggctgcgacttccggaatcgcattgaacttctcaatgaattcggtttcgtaggtgtgcgtggtagggtcgatcgggaacatgccggatgcgtcgccaacgccgagcaccttcttgccggtgagcttccagtgcacgtagccggcgagggtggtgaagaaatcgaccttgccgatgtgctcttcgttgttgagcacggcctggtacaggtgtgcgatggaccagcgttccggaatgttgtactggaacagttcggaaagcttctcgtgtgcttcggaagtgttggtgttctgccaggtgcggaacggcaccagcagttcgccatctttgccgaaggcgaggtagccgtgcatcatggcggagaagccgatgcgtcccacgcgggtgagcttttcgccgtaagcgttttcgacatcttcggcgagcgccgcgtatgcggtctgcagcccggtccagatttcttcctgcgaatagctccacaggccgtcttccaagtggctggcccagccgtagtcgccggctgcgatggtggtgtacgtgtcgtcgatgagcacggccttgattcgggtggagccgaattcgatgcccagactcgtcttgccagcgcggattttctcggcggtcagcgcgatgcgatcgtcaagtccctgctcttgcgccatagtttcaaactccttgcatccgagcgcctcacaaccacattgtcgacggaatgttagcgctcactgttaacgctcactattctaaacagaaagtggcgactatacaagttcgacgtgtcacgcaatcgtcaacgtactaccggcagatcgtcagccgattttcttgatataccggcattacgaaatccggcaatcgcagcacatgcggcaaaaagagatacgagaatcacaagaaatacaaaaatcgcaggaaatattcagcgacggctggcggtgcccaaagaagtgcggccgatcaccttcgcgggaatcaggccgacgccatgctgcgacgaggcgaacgaattctcatcgccctcccccagcaaaaacagcgtctcacgcatggcggcaacgccaagctgttcaaaatccgggcgaaccgtggacagcggcgggtacatgttgtccatggcgggcatgtcgtcgaaaccgaccaagctcacatcctgcggaatacgcatgccatgttcatgcagcgcacgagacacaccaaccgcctggctgtcgttcgcacacaccatgcacgtcggcagatttccgccggtacgaccgatgttttcgagaatatggttcatcttgccatacgcttcggtcgattcccaggtttcgcattgcacggtgacggaactcaccgcattggccgcacacagcttattccacgccatcaaacgcgtggcggcgtcacgccattccttcggacctgcgaaataaagcacggaacgatgcccatgctcgaccaccaaatgcatcacgtcggccatggccgaccattggtccactcccactacggatactcggcgacggtcggccggtttcatcaagcgcaaaccatcctgcacgctgatgctgccgtgcgtggaggtgacgatgacgcgcggctgcgtgatctgcgcacggcaggcggcggaaaacataacatccgtcggcgtgaggaaaatgaacgcgtccacgttcatctcatcgaacgttgagcacaattcgtcgaattccgcctgcgagcagagcgcctcgtgcaccatgctcaccgacatgaacagtccatgctgcctcgccatcgcctcaatcgaggaaatcgcggaaatcggaccataaaagcgttgcccgcccgcaaccaagccgatggtgcgggagcgatgcgaagcgagggcacgcgcggaattgctgggacggtatccaagcgcgtcgatggctttctgtactttttcgcgggtggcatcagacacgtcgggggaatgattgatgacgcgcgacaccgtttgatggctgacaccagccattttcgccacttcgaacatcgaggggcgtttgtttgccgcattgcgcttgcctgccatgctccgtcgccttccgcacactaccgttgttactttcgactattctacacgcaacttcggttagcgctaacagacgctatttttcagccatttgagcgagtcgcgcagcgaaattcggccagtcggtacgcatggcggtcaacagtttacgattggggacttcctcaatcggcacccattcgatttccatgctttcgtcgtcgttggccttcggctccacgcggtgccccggcttttcgaaagcgaacacggtggtgtaggcccacggtccgtggtcttcgcagtatgatccgaccacgtcgatatcttccggcgtgatgttggcttcctcgtacgattcgcgcagcgcgccctcgatcgggctttcaccgtcggcggtggcacctcctggaatgccccatgtgccaccttccgcgctccacaccgcgcgatgttgcatgacaacgtgcgtcacttcgccggtctgttcgcttcggcgggccaagagcacgccggacgcgccgttcgtgccccaatgcttgcggccgcaatcgcaatcaatccaaccatcacccggctgatgcacgttttccttgggaggaagcggcttcgcggcaccggttcgcgaatcgtgttcgacgttcggttcttgatcggctcgcgtcacattccacagatcggtccattccacgccgagctcggcggccaaacggcgcgccagcggaaggctcaggccgataatgccgtgcggatcgccttcgatggagtcgatgaatgctccgccgaagccctcaagcgtgaaggaaccagccacttccaacggttctccggtggcgatgtaccgttcgatatcggtgtcggaatattcgcagaagtgcagcgttgccctgctcgcgcctcgcgcgatacgcccggtggcgaagtcgatcaggcaatggcccgtccacaattcaccggtggcgccacgcatggcacgcagtcgttcccgagccacctcagcgctatgcggcttgccgtaacattcgccgtcaagcaggaacatggaatcgcagccaagaatcagcggaccgactttcgcacgggtcaggctcggcttgccatcaacgaaatcagcaatcgattcggtgatcgtaggaatggtgactcccgaaaaatcgcgggtcttcacatcggaggcggactgcacttcgtccgcacgcaacgtaacacgatgatgttctaaagatgcggaatccccagtattttcagcattatccgaatgttcggaagattcggcaactgctttcaacggaaatccgaccacacgatcgccgtgcgccgccgcagcggtggcggcaacgttccgatacgcctgatgtacggcttcggctttggccgtagcgagaatcatcacccgctgttccacgctcagatcgcttacggcaacgcccatggcggccgcctcacgttcgagcgccgccggctcgtccacgttcgatacgcgaatcgtggggcaaatgcccgccgagaaaagcacgtcacggcgaggcttggatttggaagcgagaatcagcggaatggagttgttcatgcgcgttccacctgcacacccttggtgtcgacgcccaaatgcagcacacgccaatgaccggaagcgagctcttcggaagcaagctgtcccagctgttcgcgagcgtcgccatgatgcagcacgagcacgcatgggccggcgccggaaaccatggaagcaaaaccatgggaacgcagcttttcgatcaacgtccacgacggttccatcaaaggagcgcgatacggctgatgcagacgatcctgcgtggcggcgaacagcaacgcgttgacgtcctgacgctgaccagtcgccagcatcgcaggattcatggcggccggcagcaggctcacgcgagacacattgtgcacggcatccttgaacgccagctggcccggcagcgcctggcgtgccttttcggtggacagctcataatccggcacgaacacggcggcggtcagatcgtcggcaacgcgatagttgatggtatggaagcccttatgcagcggttcgccgcccggaatcggcacggaaccgacaccttcgggggtttccatgtcccaagacatggtgagcccgccgtacacggccggagccacgttgtccggatggccttcgatggccgcagcaagctcaaacacggcatcacggttgagttcgtcgtcctgcgcgaaggcggccgcggctgcgatgcccgccacaatggcctctgcggaagagcccatgcctcgtgcctgaggaatgttgttgtgagcctgaagaatgaagcccacacggcccagaccaaaggtctggcatgcgcggcggaacgtggaaaccaccaagtgggtttcgtcacgcgggagagtatcggcgccttcgccttcgatcatcacctgagccgcagtgttcaccggatcggcgctcagcgtgaattcaagttcgtcgtggtagtccagagcaagtccgaccgtatcaaagccagaaccaagattggcgctggtagccggaacacgcacacgcactttacgagtaactggagtcatatctcgtcgtccttcgtcacatcttctttacaaatgtagcaccgtatacccgaaagggtacaagagtcaaattcaagcccataatcagcgggcgattgagtaaacaatcggcaagcaattgcccaacacagcagccggaatatgaataaagagacggccgcccaatcgcaacgatttgagcagccgtctcataactgttagttgagcacgcggaggatggaaggctcgccaaccacgcagtcgagtgcgcacacgtctttcacggtttcacgcagggtaagctcgtcggtcatgtgcgtgacaaggcgcagctgctgcagttcgccgtcgtagcccggatccttcagcgtgggcttgagatcctggttcacaccattgatggacacgccatgctcggcgaacttggccgcaatggccgcaagtacgcccggattgtcgtgaatcacgaaacgcaccgcgaactcggccttggaagcctcgatcggagccttcttcaaatccttatacaacggaatggtcgggccagtgcagccctgtgcgatgtgacgcgcctcggtcaccacatcgccaaccaccgcagaagcggtcggagcgccgccagcgccacgaccatagaacatcagatcgtcagccgcttcggccttcacaaacaccgcgttaaaggaaccatgcacggaagccagcggatgctcgttggaaatcagcgccggatacacgcgggcagacacaccggcctcgccattctccaccacggccagcagcttgatgaccttgttttcggcggttgcggcagcaatatcgtcggcggtgatcttggtgatgccctcaacggacacatcatcgatggtcacgttggtgtggaagccgagcgtggccatgatggccgccttgttggccgcatcgtagccttcgatgtccccggtcggatccgcttcggcgtatcccttggcctgagcgtccttcagcacgtcgtcgaaatcaagacccttggtggtcatttcgtcgagaatgtagttcgtggtgccgttgacgatgccgagcatgctcgtcaccttgtctccgacgagggattcacgcagtggcttgaggaacggaatcgcaccgcccacggaagcctcgaagtagatatcgacgcccttggcttcggcggcggcatagatttctggaccatacttggccaacagcgccttgttggcggtaaccacggaagcgccggattcgatggccgcaagcacgaacttgcgggccacgccggttccaccgatcagttcgaccacaatgtcagcattggtggccacgctcatggtgtcggtggtcaccacggacttgtcgatccacgggaacgggtcggtttccgacggatcaaggcaggcaacgccggtcagttcgatcggtcgtccgatgcgtgcggcgagctcatccttctgctccaccagcaggcgtgcggtctgagagccgaccgtgcccgcgcccaacaatccaacgcgaatcggcgcaacatcttcctgtaccaaggcatcctcccttgaatgtgaagtattggtgtaaccctgcctattgtacggtcccgatatgacgtaagaccgcgaaatcatacgaaaatggacggtttccgagctttgccccgaaaaccgcccatactgcatccacgctgcatccgtaatttgagacgaatcgccatgaacaatacgaaacacgagcgaaacgccacgaatcgctattcgctcacatcccaatccagcagatcatcgaccgtctgacggcgaatcatcacatgcgcgtcttgctcggatacggcaacaaccgcaggaatcagcgcctgattgtagttgctggccatcgtgcgaccgtatgcacccgtaacaggcaccgccagcacgtcaccacgctgaatatcggcaggaagacgcacctcgttgacgatgatatcgcccgattcgcagtgcatgccgaccacacggcacagcttggtttcgctggaaccctcacgattggcgattctcgcagtgtaatccgatccatacaatgccggacgaatattgtcgctcatgccgccgtcgacagacacgtacacgcgttccgtaaccggattgccagccttgtctttcgcggttccggcaagctgcaccggcttgaccgtgcccacacgatacagggtgacgccggtcggggcgaccgtccaacggcccggctcgaacgagatgaccggagcgggcatgccgagcgcacggttcacggtggtgaccgcatcggcaaggcggacaagttccgtatcgagatccatggaatcctcgccatcggtgtaggccacggaatagccgccacccaagtcgacctccggcagggtgtatgcgtcggtggcgtagaaggtcttgcgcagcagcatcatgcgcttcgcggcctggataaaggcgtccgcatcgtgaatgttcgatccgatatgcgaatgcacgccgaccagttcgagcacgtcctgatggcggtagatctccttcaatacggcgagcgcggggccatcagccaccatggtcatggcttcggcgagtttgcggtcgccttcggaaaccttctcgtggctcatgtcgtacgggtatttgatgtcgtactgcagttggcgttctgcgctttcgcccggagtggcttcgctttcgcctaggcgtgcgttcgaccctgcgggggtcacgtcagccaaatcgtcgagcacgttcagcttgcttgcatcggcaccaaccggcagcaaggcgacaccgaacttctggtcctcatgcgcggtagacacgaattcgtggccgcccgcatgaatgccggacgtaacacgcaacatcacgcgagcgcgcttgccgagacgcttggcgatttcggcgatgcgggccggctcgttcggctcgtccaccacgattttggcgaagccttcggtaatggcgagttcgatttccgcatcggacttgttgttgccgtgcagcacgagtcgccgtccgggaacgcccgcggcgagcgcgatgcgcatctcgcccatggtgcaggtgtcgatcagcatgccggattcggtgacgatacggcagatttccttggaaagcagtgcttttccggcgaagctgacgtgggttacggtgttgttgaacgcatttgccgcggatttgacgaatttggcggcgcgggctcgcacgtcatcggtgtcgatgacgtagagcggcgaaccaaattcgttcagcaggctttcggcagtgcggccatggaacgtgatttcaccttgctcgttcacgttggagccggccggccagatgggggtgactgccatggcgatcacatcctgtctggggctgcgacgccaagcaggtcaaggccttcggcgataaccgtcttaacggcgtcattgagcttcaaacgtgcggctgcacgagccggttccggagccttggcgatgcgcagggcttcagcctgttcgccgcgagcttccggatcggtgagctccataggcaccacgcgttccacgttgtaccacttgtggtaggtggcggcgaggtcttccaagtaatgggctacgcgatgcggggcgcgcaggtctccggcttcgcgcagcagggccggccactgggcgagcgcggcaagcacttcgccgtcggcggcggtgtcgagcaggctcacgtcggcaccctcgtaggtgatgccggcagcagccgcattgcgatccacattgcaggagcgggcgtgcgcgtactgcacgtagtacaccggattctcgttggaatgcgaagcgagcaggttcaggtcgatgtcgaccggggaattgtagtcggtgcgtgccaacgaataacgggaggcatccacgccgatagcgtcggtcagatcgtcgatggtcaccacattgccggcgcgcttcgacatgcgcactgccttgccgtccttcagcacgttgacgagctggccgataagaatctgcatgttttcgccaggttcgtcgccgaatgcggcgcacatggccatcatgcggccgatatagccgtgatggtcggcacccagcatgtaaatggcgatgtctgccggatcgttgtcacgatgacgcttgttgcgatagtaagcaatatcagctgcgaaatacgcgtagttgccgtcggacttgataatcacacgatccttgtcgtcaccatgcttggtggattcgaaccaggttgcgccatccttttcgtaaatgtcgccgcgttcacgcagatcggcgatcgccttgtcgacttcgccatcggaatacaagctgttctcatggaaccacacgtcgaaattcacacggaaatccttcatggatttgcggatttcgtcgaacatcatcggcactgcacgcttgcggaattcctcacgctgttcggaatcgccctcacccagcggattgccatcgttgtcaacgccaccgtcgacgcgcggcaggtcgagaatcgcaataccgtcggcttttgcctcatcgatgacgcgacgtgcgatctcatcgatataagcgcccttgtaaccgtcgatcggggtttcctcaccgtgggctgccgcgaccagcgacttggcgaaacggttgatctgctcgccgtgatcgttgaaatagtattcgcgcaccaccttggcaccgttcgcctcaagcacgcgggccatggagtcgccgaccgcggcccaacgggtgccgccgatatggatcggaccggtcggattggcggacacgaattcaagattcagggttttgccggaaagatggtcgttcttgccgtagttcgcaccctcgttaagcacagtgtcaaccacggctgcggcggacgcggaatcaagcacaatgttaatgaagccggggccggccacttccacggacttgatgccatcggcattggcgagttccgcggcgaacagttcggcgaaatcgtgaggcttcatgccggccttcttggccagctgcatggccgcgttcgatgcccaatcgccgtgtgcgcggtccttcggacgcatgacggcgaatttggcctgcggagggatgagatcggtggtcagggtgccagccttgccttcattcacaaggttgttggcaatattgaaaatcagttcactaagcgcttctggactcattcctccaagtctaccgattatgcagacagaatcagccttgcgtatcgccccgcgtatcatcctgcagttcgccatgcttcctgcgccaagccaccgaagcgtaatagccgatatagcagatcgcaacgaacggaatcatatacagcaatgtggaacgctgcgacgaatcgcaaatcaccaaaaccaacgcgccgatgcacatcacaatcgcagcaatcggcacgaacgggaaaccgggggcacgatacttcaaatcgtcagccgaatgcccttgatcaagccactgcttgcggaaacgcaagtggcagacggaaaccgacgcccacaccaccagtgtggccaagccggaaaccgcaaccaacgccaaatacaccgtcgaagcggcaaccacggaagacaacaacgccaacagcgatccagccatgctgaacagcaccgcgaacacgggcacaccatggaaattcgtcttgccgagcacgcgcgggatcataccctcctgcgcaagcgaccagaccatgcgcgagcacacgtacaagccggaattcgcagcggaaagcactgccgtcaacaccacgaaattcatcacatcgccggcaaacggcatgccgatcgactggaacacgagcacaaacggactcgtgtcgacgcctgaccgatgccacggaatcagcgcggacatcaccgcaatcgaaccgatgaagaaaatcgcaagacgcaacaccgtggtatgcacggccttcggaatcgcctgcgccggatccttcgtctcccccgccgcgacaccaacaacctcagtgcccgaaaatgcgaacaccaccgtcagcagcgtcgaaaaaatcgggatcacaccattggggagccagccgtcattatagaaattctcaaacagcggtgcgtgatcgtaaccggcaatcggaatcgcaccaaacatggcaagcaagccgatcacaatgaacacgataatcgcaaacaccttaatggatgcgaaccagaattccgactcgccatacagcctcaccgacagaatattgagcatgaacaccaccgcaatgaaggcggcggaccaaatccacgcgggcgaatcaggaaaccaacgttgcatcagcagaccggctgccgtgaattccgaagcgagcgccaccgcccaattcagccagtacagcacggcgatggtgaacgcggtgccggggccgatgaaacgcttcgcatacaggtgaaagctgcccgcatacggcatggccaccgacagttcgccaaggctgagcatcacaaaatacacaagcatggatccgatgccatacgcgatgatcgcgccaagagggccggcttggtgaatcgtgtagccggagctgaggaacaagcccgtaccgatcacaccacctagcgaaatcatggtcagatggcgggtttccatcttgcgttcaagaccgccctgctcggcttcagcggattcagcggcgtcagtgtctgcagtggatgcgttgacttgcgattcggccatgcgcgactgctccttcatatttggatgggcgcgttcttgcgttcttgcgtttgcatgcgtttgcacaatacccaatcgcattactatacggaaatcggtggaatcatgttgcctgccgttcacttttagcggcaatcctgagattgcataaacaaaaacaggctcgcatgcagcgtaagaaaccgcatacgagcctgaaaaaggattttctggagatttgcaatcagcgcactgaaatcagagcacagcgatggcgtcgatctcaacgagagcgcccttcggaatgttgttgccgccgaacgcgacgcgggccggcttcacggagccgatgaaggtctgcgcatacacgtcgtcgatctcgtggaagtcttcgacgttcttcatgtagatggtggcgcggcagacgtgttcgatgccggtgcctgcggcgtcaagaatatgcttgatgttcttcagtgcctgggctgcctgctcgccggcggtttcgccagccagttcgccggtggccgggtcgatgcccagctggccggagacgaacacgaaaccgttggccttcacggcctggctgtatgcgcccagcgccgccggggcttcagaagtcgcaaccgcttccatcttctcgctcataatgttctcctttgaagaatgtgttatgcatgttgcttgcgttcaggccgcggcaaaccacgacaacgcaatctcaagcaatcactgtacccatggaatcgacacgcatcgccccatgttccaaataccggctccctgccccggctcttcacttgtctttgtggtgggcttgatggggatcgaacccacgaccttctgttccggagacagacgctctatccactgagctacaaacccgtgcgtcaaactactttacactgccttgagatgaaagcgacactttttacggaaaaacgatcttcgaatctcggatcattattgcgaaaacatagctacggcgggtctttcgacagcacacccaaccctagaggggaaataacgggcatagaacggggaaggaacgagagatagcgtgcgccacaacgaaatttgtagcaacataacaccatttgaagcgtcttttccactaaactgaaaatatggttgaggattcaggcagaaatataggcgatttcgaatacacgcgccgttttttctgccgtgccctgccgacgcagttggatgataacgacagtccgacgctgatcatacaaagttattacgtgcatcaggataattacgcgctgcgcgtgcgattgaaaacaaagtccgtccgcattgccatgactccggacctcgacccgctggctgtgctcgaaaagtatcgcgacgaattccggcttggatcagtcaccgtgaaagggccgtccgtgggaggcacgcgatatgaggcgagccgcgatttggattcgcgcatcgcaggggagctcatcaaacgcggcggacacgtgaccatcaaaaaccgtttcaccgactggatcgatgaggacggctggaacatcgacgtgttcggaggcaccaacgctcccctgatcattgcggaagcggaacgtatcgggccggtcaccaatctggtgatcccgaaattctgcaccaccgaaatcaccgaccaatcgcggttcagcaatgaagggcttgccgcgaatccatattcacgatggaaatccgaattcgaagacgaactggaagcagacggaccgcaattcctcgactatttcggcaccaaccgtatggaataagtctttttttaaaaaaaacaaccgtaggccgtaaagaacgatgtagttgcgcagcctacggttgagcggtacctaaacggtacctaaagtcaataaacgagtcagtacatgagcgtggcgaggcgacggcgggcgcgcttcaaacgctcgtcggtcggctcaggaatcgtgaaatattccagcagacgcttgcgcaccggttcaatatcggccttatggccggccgcaacgaaatccagcaaacgatcgaacgcatcctgaatctgaccgccgatcatatcaatgtcagcgacggcaagctgtgcttcaacatcatcgggattgtcggcagcggcggcacgcacctcacgcacgttcgcattggcggaacgggccaacagcaacgccttcgcacgctcgcgggcggcacgcgcatcgttcggatcggcttcaagcaccttctcgtacgcggctgcggcgccagcgtaatcgccctgctgtgccagcatatacgcctcctgatgctccggaggcacctgctcctgggcgccggcagcggaagccgagtttgccgcatcggaattcggatcgccggaatacggcgcggaaccggtcacaccggcctgctgcgcggctgcgaccagattcggaatcaccgtatccacgatctgctgcatttcctcagcggacggcaagccctgcaaaatcggcatcggacggccgttgatcaacgcgaacaatgcaggcgcgccctgcacttggaacgcctgcgcgatcgacgaattcgacgcgatatcgatacgagacagctgaatctggccgttcagctggttcacggcatcgcccagctggcgtgccatgtcgaacaggcgatcatcggtcggcacccacagcagcaacaggatcgggaacgtggccgacgtctgcaccatggcctggaacgtgttctccgtggtgtcgatcacataaccgcctgcggccggagcgcctccagcctgccccggctcagccttcacctgatgcttcaacgcttcaagatcgacggctcccgccaaggaaactcccggattaaacggcctttgacctgccatgcttgcctcctagatatcaacaatcaacaacattaagcgcccggcgtaacacgcattgcaaacgttcgccccaagcttacgcgcattcgtgcgactgccacgatcacagtgcctcaacacgaaccggctggcgctcggaaccgactgcagtgatcttcgcgtcagaatttgccggaggcacgtacagcgcgaccacattcacatacgtggttttcatggtgctggtggcctgaccgtcgccaaacagcgctttttccgcatcggaagcgggctgcgactcacggccggagccagctgaacgcgtccattcggaattgatctgcgccaccaccagatcgccaccatccgcggaacgcataacgctgatggcatcgtcaaccggtgtgaacacctgctgctgcgatccctcgttcaactccatggccttctgcacctgttcggtcagatcggcaagcttcgtacgcaaatcgtcgtcggcaaacttctgcgcatactggctggacgcaccattctgcaacacgtcggcatacgcggcgaccgcatccttcggggtcatgaccagaccggtgtctttttccgttccctgctcgctaccggttttggaaatctcaaaactcggcattttcacgcccgaaaacagtcgtgccacaccccacaacttgtagttctgacgtgcggaatcctggcggaacaccagcagacgcttggactgctggtcatccgtggtggaagtgatggaaaacaccgaacgcggccatccactgtccgtggaaatcacggcctgcgcaagatcagttggaatcgtggtcttgcggtcaagattgcccgtgacctgcgccacatgaagttcgctagtgcgaatctcaagttccggcccctccaaaatcgaaccgagggcgtcgatattgcgatcgttattgcactggtcaagcgttttgagaatattcgtacggatggttttctcttgcttggcggtcagattcggcgcatcttgacgttgcgtggttttcggctgcggcagctgtccctcgcatccgcacatgccaacgaccattcccaatgcgagtacggccgccgcgattacgttgaaacgcttcttcatcacttggcctcctcgttgtcaggttcgtcggacttgtcgttgtcggattcgtcgttttcggatgtttcgttggatccgaccgactcggtcgttacggccatttcgtcaacttcgttgggcacgttgatttcatcggataccgcgaattctacagatcccgaggccgctgcggccgcactgctttcctcttgtgcgagacgtgcgaaatatgcggcaagctcgtcttgcgaaatcacggaagtctgttcgaaatcgtcgttttcttcaacaccatcagcggcagcgttctgctgatcggcaacgagattgcgcgcgccgggatcgacaatcgtaggctgcgcaacttcgttttggctattttccgaaccactcgcgcgatgcccagcatgacggcgacgcttacgcttcggcccgctcttttcgctacgggcggcactcgcttcggcgttcttcacccatgcggcaacctcgtcatcgtcaccctgcgtggaaccgatgccgtcaaccatggcaaacgcgcgcttgttgcgacgcttatgcggaggcatggcaaacacggaagccgaaagcaccgcaagtattgccagcaatccgccggaaagatagaacggcatggcgaaattcagcatcgaacgacggttccaatcaagtgtgaccgaacctcccttgcgattgccataatcgataatcgcaacggaatcctcggcattattcgtattagcacccttgaactgcatatcaacggaaccggcattgcatttgacggtgcgccacatgtcggaatcctggaaggcgacctggccttcggaattatcggcggtgccctgagccgtggtcttcagtgtagacagggtggaccagtcggacagtccggtgacgcgcgtgtatttggatcccgcgatccatccggcgatatcgcgggcggaaccgatggcgatgcacacgttcgcggatttgtcgcgcgacttcgccgaaatggtgacgcgatcgtcaaccaattgcagcacattcggatcggtgaccacatactgcgatcccgtaaccgaggcggacgccgtgacctgtgccgagggcttccaaatcgtcgcgttcaagacgccaagcacgatgcaagcaatggcaagcaagccgaaaataggcgtgacaatgccgcgcataatcttggcgtgtcgcgtgggacccgccttggactgcggcttttcctgttcttcctgcaataaagtcatagcattcactattctacattgcctctctgcaaaagcctgaaaaaactatgaaaatcaatgattgccactaaagtggaacctatgcgcaaatctactcttttcaaagccgtcgcagccgcctgcacaacgatcatgtgcttgggtttcgcggcatgcggaagttccgacacgaagtctgattcctcctccgattcatcttcgtcttcttccgattcctcgtcgaagatgaatcagatcgccggtgtgaccgccacaggtgagcccggtgagaagccgaccgtctccttcaaaacccctatgacggtggaagacaacagctacgtcgtattgcagaaaggcaatggcgaccagattgaagacggcgaccgcatatgcacgcagggtatcgccatcaatgtcaaggatggttccgaactcatgagcacctgggagaaaaacacccccgattgctctacgatggtcacctccgacaccagtcagatgactgaggattattacaacattttcaaggatcagaagcttaacgccacgcttgcgttcggtgtgaacgattcgaattccgctggcacctcctatttgatggtgctcacgatcgtgtcgaagtcgaaggatctgacgaaggcaacgggcacgaaggtgcttgacgttcctgccgatctgccgaaggtgacgcttgcgaaggatggcaagccgtcgatcgatatgaacggatacaagggttccgacacgttgatctcgcaggatttgatcaggggcgaaggcgccgaggtcaaggatacgcagaccgtgatcgcgcactataccggctggctgcttgacggcacacagttcgattcctcgtgggatcgcggtgcttcgtcgagcttctcgcttgatgaggtgatcaccggttggaagcagggcttggcagggcataccgtcggctcgcaggtgctgctggtcgtgccgccggaccttggctatggagacaaggattccggcaagattccagcgaactctacgttggtcttcgtagtcgacatcctcgccgcctactgatctacatcacgattcgcttataaaaaactccctgcataacaacagggagttttttataagctagaagagtcgtagggagtcgtcttcggcacctttcatttcgtcatagtcgaggatcaggcagtcgaagccgcggtcctgagcgagcacgcgggcttgcggcgtgatggtctgcgcggcgaaaatgccacgcacgggggccaacagcgggtctcggttcaacaactcgcagtaacgggtgagctgctccacgccatcgatgccgccgttacgtttgatttcgatggcaacatgcttgccactgccgtcgatggccataatgtcgaccggtccgatggcggtcgggtattcgcggcgcaccaatgtcgcaccttccccgatgcgttcgatctgttcggccagatacttctgcagatggtcttcgacaccgtctttgatcagccccggatcttcgcccaaatcgtatgtttcgtcggaataaatatgctgcaatgtcacttcgagcacgtcattggatttatccgccgaagcacgaatgactttctgcggaacctccgtagtcacgtcgtcgtcggcatgttccggagtgatgtctttgatggtgcagggcgccgccatccagttgagtggcttgtacgaaccaagttcggagaaaatcagcagactgttatcggctttgataagcaacacacgcttggcgagcggcaaggacgcattcaaacgcccggaatattcggcagagcaatcagcaacaataattcgcacgaggcactaccctaccatgattgtcgtaagccatgaatcccacgatatgtacaatcctatttttgttttgattaatcttttttttaaaaaaaacagtccgtctgctgcaactacagaatcgcaatcatatgcaattgctgcaatcgcaacagacggaccgtcagaagtatgctaccgagtgctactctgccatcttgacgtcacgtccacgctcaaccgcaacggtgagcttgttcgaatcgaaggagatgaaaccgtcggtcacttcgaaggagcgacggctgccatccggatccaccacaacgatggttccttccttgattacggtcaatacaggctcgtggttgggcaggatgcccattccgccttcagaggcaggaatggtgacggacttcgccgtaccgtgccacacggggtggtcggcggcgacgatgttcacctgcattgtcaatccggccatcacgcaccgtattccttctgcatgtcgtgccacttcttctcgagatcgtcgatgccgccgataccggagaatgcctgctccggaacgtcgtcgtacacgccgtcgcaaatgcgggtgaacgcttcgatggtctcatcggccggcacgtaggagcccggacgaccggtgaacttttcagcgacgtagaagttctggccgaggaactgctcgatcttacgagcgcggttcacggtggtcttgtcttcttcgccgagttcgtcgataccgatcagagcgatgatgtcctgcagctccttgttacgctgcagaatcgccttgacgcggttcgcgcaatcgtagtgagcctggcccacgtaacgcggatcaaggattcgcgaggtggagctcagcgggtccactgccggatagatacccttggaagcgatgtcacgggaaagctcggtggttgcatccaagtgggcgaaggtcgttgcaggagccgggtcggtgtaatcatcggccggcacatagatggcctgcagcgaggtgatggagtgaccgcgggtcgaagtgatgcgctcctgcagggcacccatttcgtcagccaggttcggctggtagcccactgcggacggcatacggccgagcagggtggacacctcggaaccagcctgggtgaaacggaagatgttatcgatgaacagcagcacgtcctgattttgcacgtcacggaagtactctgccatggtcagtgcggtcagcggcacgcgcagacgggtacccggctgctcatccatctggccgaagaccagtgcggtcttctcaagaacgccagcctcatccatttcgccgatcagatcgttaccctcacgggtacgctcgccgacgcctgcgaacacggacacaccgccgtggttctgggcgactcgctggatcatttcctgaataagcacggtcttgccgacgcctgcgccaccgaacagaccgatcttgccgccctgcacgtacggggtcagcaaatcgatgaccttgataccggtttcgaacatctgggtcttggattccagctgatcgaatgccggcgggttgcggtggataggccaacgctcggtgaccgtgatggtttcgtcatccttcttgttgaggatgttgccggacacgtcgaacacgtgacccttggtgacatcgccaacaggaacggagatcggaccgccggtgtcgagcacggtggcgccacgaacgaggccgtcggtcggcttcagcgccacggtacgcacggtagagtcgccaaggtgctgttcgacctcaagcgtgatcttcttcgtggtttcgccctcttcgttggcggtgttggtcagctcaacggtaagtgcgttgtaaatgtcgggcaggtggcccaccgggaattcgacgtcgataaccgaaccctggatacgcgtgacgcgtccagtggtcggctctgcagccgtctcgggagccgctgtggtctgattctcagccatatgcgttcctactcttccttcttattcagcgcgtcggcgctgccgatgatttcggtaagttcctgggtaatcgaagcctgtcgcgaagcgttgagcttgcgggtcaggtcgtcgatcaggctgcgggcgttgtctgtagccgtatgcatggcgttctgtcggcttgcagtctcggatgccgccgcggtgagcaggcattcatgaatacgggactggatgtacttcggcagaatcgcgtcaagcacttcgtcgacgctcggctcgaacgcataaagcggggtcgcggcatcggcatcggattcgggcacagggccggagtcctgctgttccggaagcacgagttcaacgggcagcatacgcagcacgcgcaccttctgaacgaccatattcacgaattcggtgaacacaatgtagagttcggaaactccaccttcgctcgccggcttcatgtaggcgtccatcagtgccttcgagatggactctgcgacttccacgccgggctggtcggtatcaccttcccaagtaccggcaacatcacgattgcggtacttgtagtacgtcacaccgcgacgaccatacacatacagttccggctgcttgcctgccgcatcgaggcgggccagcagcgattccgtttcgcggatgatcgaggaggtgtacggacccgccataccacgatccgaggtgagggcgaggacagccacgcgagggttgtcctcgtccttcttcacgatcggatggtcgatatgggtgtgggccaccagcgcttgcacggcgtcgaaaatcgcatcggtatacggcttcgcgttcaaggcgacgtcacgtgccttggcgatatgcgaagacgcgatcatctcctgcgcgttgaagattttctccaacgacgcggtggaggcgatcctagatttcaatgcgagttgcgagcccatggatcacttctctcctgcgacgatcttttcctgctcgaccggggtggcgttcttgacgttaggcttcttctcgaccagcggcttgcccgcgctggtcacgaaagtctcacggaacgcttccacagccttgtcgagggcagcctcggtgtcggcggtgaaatcttcggtctcgcggatggtcttgagaatatcggtgttgtggtccaggtagtccagcatggccttctcgaacggcagcacgtcgttcagcggcagatcatccatcttgccatgggtgccggcccacacggagacgacttcctgttccatggaatacggggagaactgcggctgcttgagcagctcggtcaagtgggaaccacggttcagctgggccttcgaagccgcatccagatcggaagcgaacatggcgaaggattccagggaacggtactgggccaaggagatcttcagcgtgccggagaccttcttcaacgccttggtctgtgccgcgccaccaactcgggacacggagatgccgacgtcgacagccggacgctggttcgcgttgaacaggtcggactgcaggaagatctgaccgtcggtgatggagatcacgttggtcggaatgtatgcggacacgtcgtttgccttggtttcgacgatcggcaggccggtcatcgaaccgccgccgaggtcatcggaaaccttggcgcagcgttcgagcagacgggaatgcaggtagaacacatcgcccgggtatgcctcacgtcccggcgggcggcgcagcagcagggagatcgaacggtaggcttcagcctgcttcgacagatcgtcgaagacgatgagcacgtgcttgccgttgtacatccagtgctgtccgatggcggaaccggtgtacggtgcgatgtacttgaagcctgcggaatcggaagccggggaggccacgatagtggtgtactccatggcgccggactcttcgagggactgcttcaccgatgcgatggtggagcccttctggccgatggccacgtagatgcagcggacctgcttcttcggatcaccggattcccaattacgcttctggttgatgatcgtatcgattgcgatagcggtcttaccggtctggcggtcgccaatgatgagctggcgctggccacggccgataggcgtcattgcgtcgatggccttcagaccggtggacattggctcgtcaaccggatgacgatgcataacgtcaggtgcctgggcctcgagaatacgacggccttcggtcttgatctcgccaagaccatcaatcgggttgcctagcgggtccacgacgcggccaaggtagccgtcgccgacgggcacggagagcacttcgccggtacgacgcacttcctggccttcctcgatacctgcgaagtcgccgagaataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcagtcgcgacataaccgacttcctgagtcggggtatccgacggcttgtacgactcgacgaactcatcgagcgccttgcgtatcgtggtgggatcaatggtaagttctgccatgatcactccttattgttgtttataaattcagtcaagtcttgtttcaggcttgttcaccgtgcggcgaaccgtcaggcggttgccttcaccgtgcgctgaagatgctgcagctgtgcgaccaccgtgttgtcggtgacctcgtcgcccacctggatgcgcatgccacccatgacggtcggatcgaccaccgagttgatgtgcaccggatgaccggtcttcgccgagtaaatggcgatgagcttttccacctgctccttgctcaacggcgttgccgtggtaacagtgaccatcgattcgcccatatggcgggagaatttgttgatcagccactgaatggtctgcaagtagcggcgattgcgcagattgcaggtcgcgtgttcggccagacgcttggtcaccttggtgaaatccgcgtctccaatcaggctgtacagcagcttgacacgggcttcactggaaacggttgcgtcatacagcttggtacgcacgaccggaaggttgagcagtgcggaatgcaactctgcgagctcgatggagacctgcaaagtcgtattggtgtaatccgcgtagtacatcatgccatcaacgccgaaatcctcaacggcattggcgatatcagacacgcggctccaacggcgagacaccagatcggacatgatctccatcacgagcggatgggcctggtctccgatcagagtcttgactaccgcaaccttgtcttcgactgggcgcgacgggtcggtgagggcacgttcaagctggatattgtggtcaagcgcgctggtgatcgtgaacagttcgttcccgatacgccatgcgtcctcaccgctgtcacgcagcttgggggccagcgagtcacgcgatacgcggtctgcgatacgcgatgcttctcctcgcattggtcacctccctttcttgaaggtttcgatcacttcttgtcgctgtccaagtcggcgatcatctggtcgatcatcgacgactgcacatcgtcattctcgagcttgctacccaggatcttgccggccagtgccgttgccagcacgccgacctcacccttgaggctcaccagagcctgctgctgctgcgattcgatggaacgctgggcggtggcggcgatctgcgccgcatcgttttcggcacgagtgcgcgcgtcagcgatgatatgcgatgcctccgtacgtgcgtcgtcacggatcttggatgcctcgacgcgagctttgctcagctgagcctcatacttcgccttggcttcatcggcatctttctgggcctgttcggccttggcgatgccaccttcgatcttggcagcgcgctcatcgaacacggcctggaacttcggcaggaagaacttgtagaagaacacggcgacgatgatcagaatgaccaacgaccagaaaatgtcgtagcttttcggaaggaacaattccatttcgctagctgcggtcaccatagtgtcttcctcctttcatgttcgtttgcgtcttcggtgttaccttgaatcaagtcttacttgatgaaggcgagcacgaagccgagcagtgccagcacctcgacgaatgccagacccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacaattaaaaagccggcggtcagtcgatctccggatagctcatattgatgtatgcggtggtcaggatggcgaagatgtaagcctgcaggcaagcgaccagcgcttcgaacaggaacatgaacatgccagccgcgaaggtgacgacgccgaatggcatgaacaccttgttcaccacatcaatgaggaagtactgcgtggccgaaaggcacagcgcaagaatcaagtggcccgaaaccatgttggcgaacagtcggatcgtcaacgagaacggacggataatcagcagctcaagcagctgaatcggggacagcagaatgtagatcggggccggaacacccttcgggaagatctcatccctcaggaagtggccgaggcccttttcacgaatgcctgcaatccagtattggcagaagcaccacatggcgaataccagcggcagcgtaatggttgcgcttgccgcgatattgaagcctgggatgatgccacacagattgaagaccaacaacgtgcagaacacggtggtgatcatcggcacataacgcttgccgcgcagctcgcccatcacctgatagacgatgttgtcacggacgaattcgatcaaccattcgactgctccctgccaacggctggggatgagctttgcacggcttgccgtaattccgagaaccagcaacatgatgacggtcgcaaggatgcgaacgaggatgatgcggttgatggcgaacggcgtgccctgaaaaacgaacggatcgggaaggaagtcatcgacactgggcatttcgggaccatcagcgatggtcagcatgccctttcccaatgcaccaatcattcacgcctcctgctcttgtgtcagctgttagtttaacccaacaaccgagtcgaatgtgacgttctggttacttaaccaaagcgtacttcgaagtgcgcgtcgacgcgaacggagtcccgtgcgacgcattcgactccgaatggctggataggattattagcccgtgtctagacaacatccacacacttgggcttttccatactcccatttggttttcccggcgtttcgcagcaagctgtactaactagacacagctttgtgaatcgtcggatagccgacgcaaccaatagtttgttttacgaaaacagcatattgataaaacgtttcaccaagtatatcacatataacacaggtgctgcatataaagaaagaggggccgcatacgcaagcccccaccagtaaacagccgtaaagtcacgcgccaatcacggccgcacgtcaatcacatcaatatgcggatcaatccacaaatcaatcgtgaatcacgccataaccgtcacgcacgaacggcgcaaacgcgtcgacacgcggcgaacccggctgatgacgaatcgaacgatccgtgccaagacgcttctgcgcacgaagctgcggaacctcgctcaaatcgtatggcgtggtctgatacacccaattcagccaattgcgccacaggagattggcatgggcgcgccacgcgaacaccggctccaactgcggatcatcatgcgggaaatagttttcggggaacggcacattcgtcatgcccttcttcatatcacgctcatactcctcggccaaggtgtacttgccgtactcccaatggccaagcgcgaacacttccgaaaaatcacgagtggcgatcagcccaggaccggacttcggaccccacgtgagcacctgcaactccggattgcgcgcgatatcaccctcgtccacccccgcaaggcgagaatgcggctgcaggcaaatctcatcgaagccgttcgtcaaaaagcagtattcatcctgcaaatactgcggaaacacgccaaaaatcttctctggcaaattctctttacgcacgttatagcgataattgagcgcacccatcgcaccccagcacaaatacatagtggagaacacatgcgcggaagcccagtcaagaatctgcttgaactcatcccaataatcgacctgttcgaaatcaagatgctcaacaggggcacccgtcaccacgaagccgtcgtaatagttgtcttggaacgcctcaatggtctcatagaacttcaccagatggtcggcgctcacatgcgtaccctcgtgcgtggaggtcttcatgaaatcgatctccacctgcagcggacttttcgagatcaaacgcagcagctgcgtttccgtctcgattttcttcggcatgagatttaagatcaccagcttgagcggacgcacgcgctggcgctccgcttcaggcttttcaagcgcgaaaatacgctcggagtcgagaatgtctctggccggaaggccgctggggatcttgataggcatgcttctattatggtgcgggctcggatatggcgcacttccctgcccccacgatcagccgaaaccgttataggaaaaatgaataacgcgctatttgcaacgcggttttgcatggccggactgatgcgacacgccgatttgacatatttggaagtaatcgtaaagttaatagagctgtcttaaagacaagccgacgcggggtggagcagctcggtagctcgctgggctcataacccagaggtccatggttcaaatccatgccccgctactgatgaaagctaggaattgcaacaattcctagcttttttgttttccgtcaaatctcaccaaaaccaatttccggacaaaatctggacaaaatccgacaaaaaccgggtatatcagccgagttcatcaatcgcatgtgccgaaagtatggagaaaatgcgccggatccgccaatcgcatgtgccgaaagcgaagattgccgctcaaggctgaaaatccaacgttctccaaggttgcacgcgctacgttgacctcgccaaccacatatcaccagatataaggagaacaaggcaatgcattatatgaatcaagcgaacgcgcacaacgcgacgcaggacaccacaatgcaagacagcgcaacgcacgatacggcaacaaaggcaacgcaggacaccgcgccgctgaaaggcatcaccgtgattgactggacgcaggtgcagtccggcccgtcgtgcacgcagatgctcgcatggatgggcgccgacgtcatcaaggtggagaaggtgcagggcggagatccgacacgtaatgaaatgaacgacgtggatggctcgtactccctgtacttccttcagctcaatgccaacaagaaatccatcacgctgaacatgagagatccggaaggcaagaaaatcctcgccgaactcctgaagaaagccgacgtgttcgtagagaatatcggcccgggagacgtggaaaagcttggtttcggatggaatgacgtacatgcgatcaatccgcgtctgatcatggcgtcgctgaagggcttcaacaagggcagccggttcgagcatgtcaaggcgttcgagccggtcgcgcagtccgcgggcggtgccgcttccaccaccggctggtatgacggcgagcgcaatgtgcccacgcagtccggcgccgcattgggcgattccaacagcggaatgcatctgctgatcgccattctttcggcgctgttgcagcgcgagcataccggtgagggttgctatgtgtaccagtcgatgcagaatgcggtgctgaacttgtgccgtgtcaagctgcgcgaccagttgattctcgaccgtttgggcaagctttcctactatgactgctacccgaattatgagtggggcaagcaaggcaaagccattccgcgcgcagcgaatgcggagggtggtttggtgcttggctggtgctaccgcgcgaaaggctgggagcatgacccgaacgcttacgtatatatagtggttcaacagtccaagaagggcttcgagaatttctgccatgcgatgggattcgaggattggctgaccgacccgcgtttcaataccgccaatgcgcgtgacgagcataaaaccgaggtgtaccagcgtgttgaggcgtacaccatgcagttcgacaagtacacgctgaccaaggaattgggtgcgaagggcgtgccggtcggcccggtgttggattggtatgagttggagaacgatcctgatttgaatggggatggcacgattgtgaccattgaccagcaggatgcgcgcggcgatttcaagacgatcggcatgccgtttacgatgagtaatttcgtgccggattaccagcgtgcgccgaagctgggcgagcataaccgtgagattctgcatgcgttgggatatgacgacgatcagatcgcttcgctgcgtgattccggtgtgatcggcggcaacgatggcgtgcaggctgatttgaagtaacgcacgttagcgcgcactggcgcacgaataagggcggatcacaagattcgcccttattcgttatgcgtcacatccattgcagttcacgccccgcacttccgcacacaatcccatgtcttacgtcttacggtttaccgtcacaaaaagcgcatgcagtaacggaacgttggaatttcaacgttccgttactatatgcgcttcgtgagctacagtgaggatactgaatcagcccacgcagaaggggacgagccagatccacagcagacaggtggccgcgaatgccaccgtggcgacggccgtggtcgaggcgccttcttttacataaatgttgtaacggctggaaataatgatgcctgagaacgccggcggcaacgcgaccgccatcaccagcatcgaaatcttgttcatgtcaccgcccatgccacacaacagcgccacgccaaggaacactgcaggcgtcagaatcaggcggaagaacgtgttccagatggtttcccaaccgagcgagaatttcaccgtggaaagcgcgaggcccgcggaaagcacggccacaccggaattcgctttggcgatcagatcgaaggtcggcgccacctggcttggcacatgaatgcccaccaacactaggaaaatggccaataacgacgcccagcagatcggttgcttcagtgcgtcgagcaacgcctgcagattgccgttgcggttctttcccgtattcgacgtgccatgcaccataagttcggcggttttgtcggttgcggcatctcgcgccgggtcaagcgtgatatcgccttttgcattggcctttgcattgaccgcgttttcggcctgcacgctaaacttcgctcggtctttggcctggccgaggttgatcagatacatgccgatcggaatggtcaccacgttgaccacgatggaaataatggctatgacgagattcgtgctgacggtgttgccgtaaatcggatcaagcacagcgaatccaaggaaaccaatcgtcggagatcctgcgatcagagcacagacggccgcctcctgaatgctgcggtggaacagcaaccggcacagataatagctcaccataaacatgacgatgacgccgatgaaactgatggcggtcaatgttgcgtctttcgcaagcattgcacgggtcgatttgatgatggacacaaataacgccgcaggaagcgcgatattcaacacaagtttattaagtccctgccgctgatcgtcatcaaaataactgaattttccacaaatataccctaatgccataatgacaataattggcacgatgtcgtcaacaagtatgtttatcactgtcgttctttctttatattttttctatctgcaatcttctgcaatattgtttgattgctgatattgcagatacgttgatcggatcattggttttcaggcagaaaaagtgggcgcacgcattccaccgttcgcacgcccacatgtcataccgacaaccgatgcgctacatgcgagcgccggtcgcgtagtcgtacatggtgacttcggaatcaacgagggctccgaccaccggcttcggattcaacgctccgatattgccggattccttgcccgcatactgcgcgatctgcacatgcacgaagcttggcttgcctgattcgaccgcctcgccgaccatgcgttcgacttcttccggagtgctggcatagtaacctttacccccgaacgcttcgaggaccttctcgtaatgcgcgttgtaagtaagcgtcagcggcgacggatcaccgtccgctccaaggttttcgaagtcgccgcggtagataccgccgttgttgagcaccacgaaggtgatgggcagctggtagcggcaggccacctccacttccataccatcgaagccgaatgcggaatcgccgccgatgtacagcactttcttgccagtggaaagcgccgcgccaatcgcatagccggtgccgcagcccatcacaccccacgtgccgcagtccaaacgatggcgcggttcgagcatgtcgatgatgttgcggcaatcatcgagcgaattggctccctcattggtgagaatgagatcttcatggtgtttgttgtacacctttttgatggctcccaaggcgttgaaatggctcatgggcagctgatcggattgttcgcgggtttcaaatttcgccacgtttttcgcgctggcttccttcagcatgttcagccaggtttcgtcagctttgaacgggtattcttccagagatccgttgagcagcgtcatggcggaacgaatatcccccacgattggtacgtcgatactgcgcgtgttttcgatttcttccggattgatgtcgatttggatgaatttcacatgttcgttccacgttttgccctggccgaacgacagcatccagttgagtcgcgcgccgaccagcaataccacgtcggcgttgcgtagcgcgatggaacggcagcttgccgtgctgtgtgggtcggtatcgggcactacgcctttggccatggacattggctggaatggaatatccgttttcttgacgaattcgcggatttcctcttcggcgcgggcgattgcggcgcctttgccgatcaccatgagcggacgttcggcctgccgcagcaatgcgagcgccgcgtcgatggatttgcgtgccggcaccatggcgggggccgggtcggttgccgtccacatcaggcggtcggcttcgctttggctcagggtctgcgccacggtgtcatcggggaaatcgatgtacaccgcgcctgggcgtcctgaagaggcgatatgcatggcacgggccaccgcgagcggaatatcttcgatgcggtcgatgcgcagcgaagccttgcagaactgcttggcgtagttcatctggtcgaggccttcgtattcgccttcctcaaggtcgaccacatggcgggttgaggagccgccgatcatgatgaccggatagccgttcaccgtggcttccagcagtgccggtagaccgttgaggaatcctggagcggataccgtcaacgtgacagccggccgaccggtgatgaatccgtcggccgcggccgcgttcacagcgtcctcctcatggcgcatgcccacgaatcgcatacccatgccctgcgcgatgcgcgcgaaatcggtgacgggaatgccgaccacgccatacatgtttcgtatgccgttggccatcagcacccgcgccagataatgcggcgcatcggtgaccttccgatcatcggctccctgccgttcggcatccgcacgcatgctcgcgaccatcgtttcatctgcatgttcttctgtcatcgcaacctccattcgtatcgacgacgccatgattgtagatacgtgaaaatgggagttcgtcagcagaaaaatatgttcgtctgcggcttaatttcaacgttttcagcatgatatagccgtattctcacgcacatgcggaatatattgcagctgaaatatcgcaactctcatcgagaagcatcacctccgcgagacgacatcatcgccgcatatcatcgtcgccgtaccgcatacagcatgaacgccccgcagcacatcacggcagccgccaaacccaacaccagccccatcggacttcctgtctgcggcatttcctgctcgggggcataaaggttgtcgacattgaacgtcagcaggctatcctcacgttccaccacatcgttcagcaccatcattttctgcgcggtgacggcctcatccaatcccacggactggtatccgaccttgatattgacctcgccggcacccgttgcatgccaatacacggtggttccctccagttcggcccagccgactgccgtgggctcgtcgtcctcgtcgaacacggccggaccttcgatcgtcgccgtgaatacgccctcgatcggctgtccactcgaatccagcaactgcacgaacaggcttccggaccgcaatccctgccgatcatcacgcgtcaccctcgaagaaaccggcagcttgttcgcggcctcctcccaaagctcgttgaccttgctttccagcccgtccatcaccgagaagaggtattgctcatgcctgacccacaccttttggtcgtcatagttgcggtgcaccagcacgccgatcgccgcatacgtgagcaccggttccccgtcatgttgatattcggacagcagccatgcgaggcgccgcgccgcttccgtattttccacggtggtggtttcggtgaccttatagtcggtcatgctttcgatttgccggcaataatagaatttgcccgatctcgattccgcgttcaccccgatcacatacggttttccatcgagaaaatagttgtaatgcttgccgttcgcgcgcagcagctgttcggcggccagcgcggccgggcaggtcattcccacgattatgatgcaggccgccaataccgcggccagaatcgcaagcgtatgtcgtttcatcgcattcatcgcatcgtcctttcgatatgcacatcgttgttgtcgtaattcaacaggcttgcatacttgcgattgccacatggcctttttcaagggttgtggtcggaggacgttctttttgccgtttttgtggacaacttcgcttgtcagcaaacgtaacttatccacaaaaaacgttttatcaatcgtaggtaaacaagttatccacaaagggtggaaatcgctggtcggaagatagttcacccaaatccaccttttctcctctataatcggcggtatggcagaagaagataagagcgcggaaccgcgcaccaccgcaaccaagcaaccagccgtcaagaagacgaccgccaaaagcgcggccgccaaaacggcatcggcaacgtctcagacgcctagcaagcgcaccgccgcagccaaaaagtccacggcatccaccgctcgcaagcgcaccaccaaagcgaaggccgccgcaccgcaaacggtcggcgaagccccagcccccgtcatcgaacgcaccagccccgaacagttcggccgcgtgaacgtgctcgacatcaccccgaacgttgagaacggcctgttcccggcacgcgtggagctcggcgaagcattcaacgtcaccgcccaagtgttcatcgaaggccgcaccaaggcaggagcgaccgtgtccgtgcgtaacgcacgcggccgcgaggttgaacgtttcgccatgacctgcaccaatccgggcctcgaccgctgggaagccatggtcaagatcggcgaacacagcgatctgaagccgtgggatgccgattatgccgccgtcaagcgtcagctgggcaaatggcagatcgtgatcgaaggctgggaagacacctaccagtcttggctgcacgacgccgccatcaaggttaaagtgaatgacgacgtggagaatgcgctggaatccggcgcacagctgctcgcacgttgggctgacgcgaaggattccaagctttccgcagccgacaagaaggtactgcgcgacgccgccaagaccatggaaaacaagtcgctgagcgccgaagagcgtctcgccgcagtccagagcagcgacatcgagcagctgcacgaaaccaacccgttgcgcgacggcctgtccgagtcgaatccgcagcgtttccgtgtggaacgcccgaagtccagcttcgcctcctggtatcagttcttcccacgttccgaaggagcctactacggtgaagacggcaagatcgttcccggcaacctcaagacgtcgatcgccggcttggaacgcgccgcagccgaaggcttcaacattgtgtatttgccgccgatcttcccgattggcgtgaccaaccgcaagggacgcaacaattccctggtagccggcccgaacgatccgggctccccgttcggcatcggctccgaactgggtggccacgacaccgttgacccgcagcttggcaccatggacgatttcaaggcattctgcgagcgcgcccacgagctgggcttggaaatcgcgcttgatttcgctttgcagtgctcgcctgaccatccgtgggtcaaggcgcatccgaactggttccgcaccaagccggacggcaccatcgcattcgcagagaatccaccgaagaagtatcaggacatttacccgatcgacttcaatgccgacatggaaggcatcgaaaaggaagtcgaacgcattatggatctgtgggtcaaggcgggtgtgacgatcttccgcgttgacaatcctcacaccaagccggtgcgtttctggcaggatgtgattgccgccgttacgaagaagcatccggaagtgctgttccttgccgaggcgttcacccgcccgggcatgatgcgcgcgctgagctatgtgggcttcacgcagtcgcactgctacttcccgtggcgtaacaccaaggaagagctcgaagagtacctcgaagagaccaacggcaatggcggcttctaccagcacaacacgttctggcccaccactccggatattctcaccgcctacgtgcgcgacaacggcattgccggccatgcggtgcgtgcggtgctcgccgctatgggcagcccgagctggggtatttacaacggctacgagctgatcgaaaacaagcagcgtccgggcttcgaagagcagatcgacaacgagaagtacgaagtcaaggtgcgcgattgggacagcaccgaaaagtacggcatcgccgaactgctgacctcgctcaacaagatccgtgacactcacccggcttgccgcagctaccacaacctgcacattctgccgagcgacgacgcgggcgtgatcgcattcctgcgtcagactccggccgaactgaccggtaccggcaaggcagatacgatgatcgtgatcgtgaacctcgacggacacaacgcgcaccagtccattgtgcacatcgagcttggcgacttcggtttcgccaccgacaagccgctcaaggtgcatgatgagctgaccggccgcgacttcgaatggggttacgacaactacgtttcgctcgccccttgggccgacgtggcacacgtgctcaccgtagtcgaagactgattgagtctcaatcgatctgattaatctcggtcagctcgactagaaattcgtttcgattcataccacaataccggttccacttcggtggaaagcggtattgtggttactgataatgcaaactgcccaatctcaaggagaaatgacatggcagaaaccttcaacgtcgtggtggaaattccgcgcggctccaagaacaagtacgaagtggaccacgagaccggccgcgtgttcctggaccgcaccctgttcacttccatgggttacccggatgactatggctacatcgacggcactctgggcgaggatggcgatccgctcgacgcgctcgtcatgatcccgaactccgtgttcccgggctgcgtggtggaatgccgcgccgttggcctgtaccacatggtcgacgaggctggcggagatgacaaggtgctgtgcgtgccggctgacgtacgtttcgacgacatcaaggatgtcgaagacgtttccgagtaccacaaggctgaaatcaagcacttcttcgagcagtacaaggctctggagccgggcaaggaagtgctgccgggcgattactggaccggtgccgccaaggccgaggaagaaatcgtggccgcccgcaagcgcctcgaagaatccgagaagtgatttccacgcctttctagatagctttaggtagcaatccgaggaaagcccgttgacgtacgcactcgcacacgtcaacgggcttttgcataccttccaacgtccagattccgccagtcactggaagaatcctcccgcaaaccagcccctcagcgggcaaaaacctccactcactggaacaatcaccccactaacacggcttccagcggacaaattcccccagtcactggaagaaaatgcccgcaaatcaacttctcagcgggcagattcctccaccgattggaggaaaacggacaaaaccataccctccaagtgtccagattcctccagcgagtggaagaaacagcccgcagacgggatacactcatactgcacgcgcatattcgccggggccgctatagtggaacacgtaattcacggcatgcgaacagtattcgcagaattcaaagcccgctggctggcgcggcagttctatgtcggtacccctaggcgtaggcggacgtgagactccgtcgaggcccatcccgtgggaaaccggcgggatgaacctatataccagctatgttgattcaaacattacttattgccgtttccgtatcgatggacacattcgccgtttccatcggcaaaggtctcaccgtcaaaaaactacgcggcctcgacgcgttcaaaaccgccctctggttcggcggatttcaggcgcttttcccactgctcggctatttcgccgcctccacgctcagcaaatacgtgaccgccgtcgaccattggatcattttcggcctgctcgccctcatcggcggcaacatggtgcgtgaagcattcgaagaggatgaagagaacgccaaggaaaccgctgatttcgattggaagcacatgcttccgctcgccgtggcctgcagcatcgacgcattcgccgtcggcgtcagtttcgcattcatgtcgttgaacatttggatttcagtgatcatcatcggcatcaccaccggcctgttctccgcagccggtctgtatatcggtcgcgcgttcggctcgcgctggcagaagcccgcacagatcgcaggtggcgtcgtgcttattctgatcggcgtgaaagtattgctggaacatctcggattcctcgcataataatcgcaaatcagatatacaaataaatatacaaacttacagcaaaagcccgtaattgcacatgattatgggcttttacattaccgcttgccgcaaatacttgcgattattttcctgcgctttcgcgttttctcgcgattgcaggaatcacactattagaacatgacggtcgcgtacgatgcgataccgaccacaattccggaaatcataaccggcagcagcgcaatgccgatccacggattcttggattgcggatcgggatcggcatcacgattccaccaatacgaacacgcgtcaagcgcgataatcagcaacaacgccacaatcaccgcaacagcccacgccgtcgtcgagccataatcggtggaagccgcgttttcgccggaacgaatcggcagcagcgtcgataggaagcaccagcccgcgctgccaatcatggcaacgccttccacaacattgtgcgacagcgaacgaatcagatgcgtacggttctcacgcgccatctgacgcccgaacgaaaccacaatcagcaggatcagcagaccgccgacgccggcgatccagccttcctgcatccaaaacgtgtcttcgtcacccaaaccggcagggaaaatcgcacgtccgagcatcatcgtcgtggcacacaccacggaaagcaagcccgcaatcacggaaatcgcatgccccgcaacaccatcgcggaacgggttgaacacggcaagcagcgcaatcatcgccacggaagccacaaccgtgaacgacacgattgcgggctcttccgcattcccataggaaatgccgggaatcagagcaagcacaaccagcaccacatatgcggcgatttggacggcaaacaccttgccgaacgaggctttctgagccgacttgacggcaactttttcagaggcggtcatttcgtccccttttcatgattttccataatgtggtcattacgtatgcgataccattaaatgtagccgcaagtgtccacatagttcagataaaattaatgaaacgccgacaacacacaacaagagtacaatcgcggcaacgatacaaaaccagtacaagagacaaagggagctaacgtgacggatctgacgcttatgacgttcgctagcgacccagctaccgtgcttccttctctggcgctgctttcccaccgcgtacgcgtgctaccaatggacgcggcaagtctggtgaaaatgccggaaaacaccattctttttctggatgcgcgagatgatctggccacggcgaaaacattgtgccgcctgattcatgcatccggactgtccacgccgatcgtgctcgtcctcaccgagggtggcttcaccgtggtcaattcgcagtggggcatcgccgacgtggtggtggcgtccgcttccccggccgaagttgaggggcgtcttcgcttggtatccgagcgcggcaactcgccggtcaatgcggtttccggttccggagaatcgggcgtgcagaacgaagacggcatgatccactccggcgacctggtggtggacaccaacggctatacggcaagtctgcatgggcatccgatcgacttggcatacaaggagttcgagcttctcaagtacctcgtgcagcatccgggacgcgtgttcacccgcgcgcagctgctgcaggaagtgtggggctatgactattacggcggcacccgcaccgtcgacgtgcatatccgtcgtcttcgcgccaagctgggcggcgaatacgagcatgtgatcggtaccgtgcgcaatgtcggctatcgttttgatcctccggaagaagaggaaggcgaggcggcagccaaggacgccgcagcccacaacgcttcgagcgaaaactgattgtcgcactattcgcattgcaagcattgcctgcgatttgcgatgcttgcgattgccacgatacttgcgatctgactgtcggctatctcactttcgtacgcgcgattgcatattcatgcgacggtagactggtgccatgccccgggaatcgaaacaagcgcgactgtcacgcatgcatcaggaatacgccgtattgtgcgaggagattccgcatccgaaatgcgcgctgaatttttcaaacccgtttgagctgctggtggcgaccgtgctaagcgcgcaaaccaccgacaaacgcgtgaatatggtcacaccggaattattcggcgaatatccgggaccggccgcacttgcgagcgccaatcccgaacacgtggaaagcatcattcattccatcggatttcatcatacgaaggcaaagaacatcatcggactttcttacgcattgtgcgaacggttcgacggcgaggtgccgcaaaccatggatgctttgacaagtctgcccggggtcgggcgcaaaaccgcgaacgtggtgcttggcaatgcttttggcgtgccgggattccctgtcgacacgcatgtgatccgtgtgaccgggcggctgcgctggcgttcggactgggcgagcggctcccccgaccccaaagccatcgaacgagagatcaccgcctgcttcccgcccgaagagtggacggacctgtctcacaggctgatattgcatggtcgtgccatatgccatgcgcgcaagcccgactgcctcaactgcccccttaacgacacctgtccgagcgcattcgcagcgtaacgcgcatgcccgctgtagcctgtgccaactagactcagcaccatggaagacaccatggaagaagaaaacgggcgggaagccaagctgaaagccgaaatcacgcgatggctgatctttttcggcgtcgccatcatgctcagcgtcatgacctggctgggctggtcgctgacgaaccgcaaaaatccgattacctccttcaccacgctcgtttccgactcctccgtggccatcggcattcagggcagcgcgccggaatcgctcgacatccgcaccgaacagggcaccgcgctggagcaggcgctgctcgaaaacgtgtacgaaaccctggtgtcacgcagcgaaaccaacaaactgcagccgtcaatcgcgaaatcatggcagatttccgacgacggactgacctacacgttcacgctcaacagcaacgtgaccttctccaacggacacaagctcgactcgtccgacgtggtctggtcgctgcaaaacgtcatcaacaacaattacgtgggatccgaccaacttggtagtctcaaggaaatcaccaatcccgacgaaaaaacggtggtcatcaccctcaatcagccgaatccgtgcctgctgcgcgcgttgagcgggcgtgccggcattgtttacgatgaggaaagcacggcgaattacggcaagaaagccgtgggatcgggaccgttcaccgtggaagcctcgtcgaaaacacagatcgtgctgcagcgcaacgactcgtattggggcaccaaagccgccgcatcgcaaataacgctgtattactacgcttccgaagattcgctggtcagcgccatggaagccaagaaaatcagcatggcattgccgttgagcgcgtctgccgccgatgagctcaaccagcaaagcggcatcaactccgacagcggcatcagcttcgacaaagtgatgctcgccttcaataacggcaccgaaagcccgttctccgacgagcagatccgcaaaatgacgagatacgccatcgacgcgcagaccatcgccaaagacgctccggacgcctattcgccgctcggaggcccgataagcccgctggaagacgggtatgaggatctgagcgaactgttcccctacaatcttgagcagggccagcagatgcgcagctatttcggcgcatactatatcgccgatatcgatctgctggtgcccaaggaatatgagcagatcggcaacaccgtgaaatcggcgatcgaacagctcaatatcggcgtcaatctggaagtgctcgattccgcggcgcaagtcacggaacgcatgaacgcgggcacctacaatatcgcgctcaccaccatgagcggcgaaaacgatgcgagcgtattcaccgacggccagagcgtgttccattatgagaacggcgatgtgcagcaggcatatgcggacgcgatggcggccaccaatgatgacgattatcaggcacgcatgcgcacgtatgcacgcgccgtcagcgaaaacgcggcaagcgactggctgtacacgcgcaagaatttcatggcggtaagcgaccaattgcagggatatccgaaaaatctgaccgaccgtctgctgccgttgagcagagtgaagttgcagtgattttcccgcgattgtcaatcaatcgccgaacactgcggacaatccgtgtgttgcgctgattttcttgcgatttcggcattcggctgcagttccgtaagttgtcacattcgctttctagactagcgtttatgactgaaagccaagataataccatcaacgcgaacctcacgccgctgcccgacaaggtcggcgtggacggtctcgaagacaagtggcgcgaagtctgggacgaaagcgaagtctacaagttccagggcacccgcgaccgcaaggccgtgtattccatcgacaccccgccgcccaccgtttccggccacctgcacgtgggccacgtgttctcgtacacgcataccgatgtgatcgcgcgattcaagcgcatgaacggctacgacgtgttctacccgatgggctgggacgacaacggcctgccaaccgaacgccgtgtgcagaactattacggcgtgcgtgtggacacctccctcaagtacgatcctgatttcgtgccgccgttcgaaggcaccgatggcaagaagatcgacgccaaggatcaggttccgatctcccgtaagaacttcatcgaactgtgcgagaagctcaccgcccaggatgagaagcagttcgaggcgctgtggcgttccctcggcctgtccatcgactggacgcagacctaccacaccatcggcgagcacccgcagcgcgtggcccagaaggcgttcctgcgcaatctggcccgcggcgaagcgtatcagaaagacgctccgggcctgtgggatgtgaccttccagaccgcagtggcccaggccgagctggaatcccgcgaatatccgggcttctaccacaaggtggcgttccgcttcgaagacggcactccgatctacatcgaaaccacccgtccggaactgctggcagcctgcggcgcactgatcgcgcacccggatgacgagcgttacaagccgtatttcggccagtacgtctactccccgctgttccacgtgaaggtgccgattctggcgcacaaggccgcggaaatggacaagggcgcaggtatcgccatgtgctgtacgttcggtgacgtgaccgacgttgagtggtggcgtgatctgaacctgccgctgcgttccatcatccagcgcaacggacgcatcgtgatggacaccccggactggatcgaagacgaggaaggcaagcgcgtcttccaggaaaccgccggcaagacgacattctccgcacgcaagatcatcgtcgacgcactgcgcgaatccggcgatcttgacggcgaaccgactccgaccaagcgtatgacgaacttctacgagaagggtgacaagccgctcgaaatcgtcacttcccgccagtggtacctcaagaacggcggcaccgatcagaagctgaacgccgaactgatcgaacgcggtcgcgaactgaacttccatcctgatttcatgcgcgtgcgttacgaaaactgggtgaacggcctgaatggcgattggctgatctcccgtcagcgcttcttcggcgtgccgttcccgctgtggtatccggtgaaggaagatggcaccgccgattacgatcatccgatcgtgccgagcgaggaccgcttgccgatcgatccgaccgacgatgtgccggaaggctacagcgaggaccagcgcgacgtgcccggtggcttcaccgccgaacctgacatcatggatacgtgggcgacctcgtcgctcaccccgcagatcgtgacccgctgggaagagccaggcgaagagaaccaggcaattttcaacgccaccttcccgatggatctgcgtccgcagggtcaggacatcatccgcacctggctgttctccaccgtggatcgcgcgcatctcgagaacaagtgtctgccgtgggccaatgccaccctgtctggatggattcttgatccggatcacaagaagatgtcgaagtccaagggcaacgtagttgtgccagacaagccgatcaagcagttcggcgccgacgcggtgcgttattgggccgctgcggcacgtttgggcctggatgccacctacgacgaaggccagatgaagatcggccgccgtttggccatcaagctgctcaacgccaccaagttcgcactggccatcggccgtgaggatgagaaccaccatgtgggcgctccggcaaccgcaagctggaaccctgccgacgtgaccgagccgctggaccgcgcagccatggccaagatggccctcgtagtgcgcgaagccaccgaaagcctcaacaactacgagcattccaaggctttggaagtcatcgaaaactacttctggcagttctgcgacgattacatcgagctggtcaagaaccgcgcgtacggcaccgcagactccaccggccatgtgccgagcgagaaggccgtgaagtccgctcgcaccgcgctgggactgggcttggatgccttcgcacgcctgctggcaccgtacctgccgtacgccaccgaagaagtgtggagctggatgcatgagggcgaaggctccgtgcaccacgccgcatggccgaaggctgaaacgtacgatgcggccgcagcagccgtctccccggagctgttcacccatgccggtgaagctctggccgcgctgcgtggcatcaagtcgaaggccaaggtttcgatgaagaccccgatcctttccgtgcagctgggcgtttccgatgaagcgcgcgaatccatcgaaagcgcattgggcgatatcgccgaggccggtcgcgtggtcggacgcatctccttcatgggagcggccgccgcactgaaggccgtcaaggaaaccgccgaagcagccaaggaagccgtcaaggaggccaaggctgatgccgaagccgccatcgacgtgattgtggccgacagcgaacttggagagccgccggctaaaaagccgaagaactaatggcaactgtaggtgaaaccggcagccttcgtggcaaagccgttcacttcacctacagacagtccacaggactgtctgcttaacggctcagccggctaaaaaagcctaagaggggatcttccacgattggaaggccccctctttgtgtatctggatcctatgtttatacatttttataaaacgggaactgcaagcagatattgagattgcgcggccttagcaggctgcgattgcacaggcatatccggatacagcttctgcaaagcctgctgcaatatttcggcagcggccgcaatttcaacggtctcgtcaatcaaatcgctattatcaggcacaatcaacgtgcgatttccggaaccagcaatgccgtatgctgcaatcggcaacgcacttgtcatcaacatttcggaagatgcggtttttcctgttgttccagtattttcagatgcggaatctaccgaatcgccatcgctggatttctttgattccactcccccgactttcgcaacgttcttcgacgtggtatcggcagccgcgccaaatgacgatcgcaggccgcccgcgtagctcatcacatcatccatgctgatggcgttcttgtcgtccaccaagctggccgcagtaccgtcggaagcgttctgctgattggccgcatccgcctgcgcgcgttcctctttgcgttgggccttgatacgcgcccgctcggcacggcccgcaagcgacgtctccgaagccgaggcaagtcccatagaccccttcaacgtaacttccgaaccatcgacagtatcgtcggaactggtcgaatcatcacctgcatcaagctgatccgcaaaacgaagcacgatctcgtggaacgcactggcctgacccgtgtgctcgctcgcatccgccaacgtctgcatcgcatcgtcaaccttgcttgaagccgacttcaacttctcattgccgtcaatgctgttgcgcacatccgcaatcgcctgagattccaagttttgcgccgaacctgcggaagcccccaattccttaagccgagcggtgtacgcgtcggtgaaatccatggaatacggaatcatcgccgaagaaagctgcgactggccggcactgtaatccttggcgccacgctgctgctcctcgcccgcacgcttgttgagttccgccaccaaaccggatgtgccacgctgttcgatggtgcgaatcacctcgttcaccgcgtcggcggcacccgtatgtcggtatgcggcgctcacatcgttgaccgcgttggccagatcgaccacggactgcgccaccgcagtatcgccgttcaattcggccgcggtgccgagaatggcggtaagttgcgtggtatcgccaatcgatccggaaagatgcgtcgtatacgagccgacgtacgcgtcgatatacccgttgaacgcctgctcatgttcctgctcacgctgggcgatggtcgtttcggcaagctccttttcatgatcgcgcagttgttcgagctgcgcgatgagctcatggttgcgttgcgatccgacattcgtcaaaccatccaccaatgtggatgcgcgatcggtcaaactggtgagattgccatagcagccagttctttcggaatcgcaggcaacagcggcgacagacagcgaactcatggtgaagtttttcgcagtcacatacgtatgaatcgtaagatcctcacccggcttgcctaccgcagcgaccaatgtcgacgaattgccggcagacacaagcacgccttcgtctgaggtcgcgtcattgccgacgcggttgggaatggtgaacgcgacgatcggcgtcagatcagccgtttcctccggtcgttccgatttcagatcgatgcggatgccgaccacgcccgatgcaccggaaatcttggatgcgctgacggtcggaccgtccaaagtaaaggtcgccgttatatcccacggcagttccacacgctcttgcggcacgcgctgcgaagacgtcgcgccctcatctgcattcatgtccgtatcagttgcagaagcggcgtcactcgtcaaatacaagcggcccggctcatcaacggactcatatgcgctcatcacatcgtgcgaggccaccgccgagacgtactcgccgttccgacgcaccacatcaaccacattcgaaaccccgaccgcgcatacgggagccgccgaaaccagcgttaccgcaatggacgcagccagcatgtgccgcagatggacactcgccacacgcatatcacgctcaccacgcgtgctatcggcatgatgggcacaagatgcacgaaacgcaacagaacgacgcatgccgagcctctcaatcgcaatcaaaacaacgttccaaagcaatcaatgtagcgcgcggcatgccccggcaagaaacgatttcgcggaaaacagacaggtcaggcgaatacgtcgagcacacccggatcgacgccgttctcggcgatgcgcttatgcctgcgcttggcttcggtcaccacgaattcgcgatacatttcggcgatgtcgggatccaacccggcatcgacagcaatgcggtgcaaccgttcgatctggtaatcctcacgcttgtaatcggccggcgcgaaacccgcgcgggctttcagcacacccacttgggacgtgtatttgaagcgttccgccagtagggaaacgatggccgtgtcgacattgtcgatcgactggcgcaatgcagcgattttcgccacggcatcggcgacctcgggattgctttgcgcggtgcccgcatcgatgacggtttcggtttcatgctcttcttctggccgaagccagtcatgttcgctatcgctcatgcgtacaagactaccgcgcgcatgtcacttggagaagtaccgttgcagcacaatcgtggtttccgtgctcaccggcaccgtttggtggatgacgttcagcagatcctcaagcttgcttggcgaggctgcgcgcacggtcagcatgtagctgggtgacccggccacggaatcgcacgacatgatgccttcgatatcctgcaatttggcgggaatctcggcttccttggaataatcgatcggcgtgaccgcaatgtaggcacgtacggcgaggccacgcttttcatcgtcgataacggccttgtagccgagaatcacattacgacgttccagtttctgcacgcgcgattgcaccgcggaaatcgacagtcccgtagcgtccgaaagctgagacagcgtagcgcggccgtctttctccagcatgctgagaatggtctcgtcgatatcgtcgaattggcccacgctcgcatgcgtggtgtcgggttcgttgccattgcctgtcatagatgcccctttccaacaagcattctgcatcagtccggtaggaccgactcccctatgcagctcacgtttccgtccattaccatacccaccccaacacacaatccgtcaactgcattttcgtaacatttccaacgaatttcgattttcaatcatttttctcctatttttttcatataccccctatatagcaatactattttcgtctttttactttcgatttcgtattttttcgtgcgtcgatttttacataccgtatgtccacaacgtgatcatccacattgccgaatcgtgcggaactttcgaaaaacaatcgaaacgcattcgaaagtagttgaaaactgcaaaacggaaaaacagccgaacagaaagacagccgaacgaaacaaaagggccgcatggcgattgtcatacgacccttggatgcgtaaccgcagattgcgattacctgcgattagctgttgccgttattcgcggtattgccgctctgctggatcagcgacgccatgaaatcacggttggtcgcggtcttcttcagacgcggcacaagcgtctggtaagcctgctcaggctccagaccgccaagcagacgacgcagacggtagatgatcggcagctcctgcggatcggtgatgagttcctcgcgacgggtgccggaagcgttcacgtcgatggccgggaacaggcgcttgtctgccagttcgcggctcaggcgcagctccatgttgccggtgcccttgaactcctcgaaaatcacctcgtccatcttggagccggtttccaccagtgcggaggagatgatggtcagagagccgccgttttcgatgttacgagcggcaccgaagaacttcttcggtgggtacagcgcctgggcatccacaccaccggaaagaatacggccggaagccggagcggcgatgttgtaggcacgggccagacgggtcatggaatcaagcagcaccaccacgtcctggccaagctccacgagacgcttcgcgcgttcgatggcgagttcggcgacggtggtgtggtcggaggccggacggtcgaaggtggaggaaatgacctcgccctgcaccgtacgttccatatcggtgacctcttccggacgttcgtccacgagcacgaccatcaggtggacttccggattgttggtggcgatcgcgttggcgatgttctgcagggtgatggtcttgccggccttcggcggagacacgatcaggccacgctggcccttgccgatcggcgccacgatgtcgatgaggcggccggtgagcttgttcggcgcggtttcctgcttcagacgctcctgcggatacagcggagtgagcttgttgaactgcggacggttctgtgcggcctccacggtcatgccgttgatggagtcgatggactgcagcggcacgaacttctgacgctggttgcggcggtcgccctcacgcggggtacggatggaaccgtgcacggcatcacccttgcgcagcccatacttcttgacctggcccatggaaacgtacacgtcgttcggacccggcaaatagccggaggtacgcacgaaagcgtaggaatcgagcacgtcgacgatgcccgcgacaggcacgagatcctctttcggctcctcgtgacgctgttcgcgttcaacattgcgatccgtgcgctcgttgcgctcgacgcgatcgttacgctcgttgcgatcattgttacggtcgccggtacggccacgacgctcgtcacgctcgtcataatcgcggtcacggccacgcaggcgacggccacgacgatccacgcggtcacccctatcgctgacgcgaccgcgaccacgacgcgcgaaatcaccgtcttcagcctcgtcacgacgttcgtcatcatcactgccctgcgaaggcaacgtggcgagaatgtcatcaagatcgcgcacaacgtcctcatccttcggcccttccaccgcacgacggcgacggcgcggctcaacgtcggacgcatcatccttacgatggcgacgacgatcatcctgcttcggcgaagcatcgtccaatcccagttcggccagcagatcggtggcagcgtccgcatcacggcggcgacggcgcttcggagcctcatcgatgctgtccagggcgttcaccgcggccatgacatcggccgcctcctcgctcgtcggagcctcagcctgcttgcgacggtcagcacgctcggtgcgctcggcacgttccgtctgttcggagcgctccgcacgctcagcgctatcagcacgtccggcaagggtcttcctaacggttttggccgtctgcttttcggactgctcagcctcgttggctttgctttcggcagcctcgttggacttgccggattcctcagccgtgttcgccgcgacctcagcgtctgcggtttgggcttcagcatgagccaccggagcggccggtgcagcggacttcggagctcgcacggtcacaccggcaggcgcttcaccgccggaacgagcggcctgaagcgtcgcgataagttccggcttacgcatggtggaggtgccgcgaaggcccatctgcttggcgagctccttgagctcaggcagtttcatgtcttcaagattcgggctggttgccactggtttttgcctttcccctagctttcgcaagcacacgcctgcaacagctgtaaaaagagatacggaaatttccgccactgaaagtccgccgcgaaatatcacggttttcgaacttccctaaccatacaacgtcatccagaccaacgcaacgtaggcgtgccaacgtattcatgccaatcaagcattcaagtcaatgacaaatcgcaaatcacaatgcgaaagacccgccatgcgatcacatgacgggtctttcgctttaccacatgctttacagcaacaggtgcaggtcttgccggaacctacttttcctcgtgatagctcttgtcggtattgacggaccatacgttcttcttggacgtcttgccgttcttgatattgccgacggcctcgattgcggtggccatggaatgatccatgttgttgtaacgatgctggccgttgcggccgacgcaatacagattgccgaaggaatcgaggtattccacgagctcaggcatgcgatcgtaggtgtcgaaatatgccggatacgccttcttcacgcgctcacgatgggagtcgatcacgtcttgcggaccgttgatgatctgcatgcgcgtaagctcctggatggcgaacttcttcgcttcctcgtcagacatgttccagaaggaatcgccttcttcgcagaagtattcaagaccgatccacacggtgttgtcaacgtccttgaccaggtacgggctccagttgttgaagatctgcaaacggccgaccttgtagcccggatcctgcacgtaaatccagcaatcaggcacgatcggcgggttgccgagggtgggaatgtcggtggtgttcgacaggcgcaggtgcttgacgagcagaccaacggtcacgaagtcgcggtacggcaggccgttggcgatttcggtcatgtccttcggcgcgggctggctggaagcgtccacggcgttgatgagatccttgacgggcatggaggagatgaagtcgtccgcggccatttcggtgcggttgccttcggaatcctcatataccacggatgcgatcttgccgtcggcctggcgaatctccaccacgttcgcgtcggtgatgaccttcacgcccgcggcctcgcagttggcctcgacggtttcccacagctggcccggaccatacttcggataccagaattcctcaatcagcgaggtttcaacctcggcattgctgcgcttcttcggcaggagcttctggaacgcgttcttcagcacgcccataatgctcaggcccttgacgcgctgcgcaccccaatcggcggaaatctgggacggatggcgaccccacagcttctcggtgtacccctcgaagaacatggaatacagcttgcggccgaaacgattgatgtagaagttctccagattgtcttccggcagcttgtgcaccatggacttcaggtagctgaagccggcaacaagcgtaagcttcggacccatggccttcaacgtgttggcgctcagggaaatcgggtagtcaaagaagtggcggttccagtaaatacgagacacgcgatgacgcttaagcatcaccttgtcttcgacttccggatccggtccgcccggttccatatcgtgctcgcgaccgagcttcttgtcatcatagcttggcgcgccctgcagcggcaggacccccttccaccaatccatgatgcgttcgtccttcgagaagaaacgatggccgccaatatccatacggttgccatcatgcttgacggtgcgggagatgccgccgaattcgcgggtcgcttccaacacagtcacgtcgtagttctcggagccaccgtccttgacgagctcccaagcggcagtcaggcctgcagggccaccgccgataatcaccacggattgcttttgcgtcactttgaggtctccttatgaaaacaaaaatccctgatagtctacccgagggtagggaaacgaacaccgcaacttgtgcgaatgcttacaaaatcaagccaagtcagccggatatacggctatcgcatcatgcaaaacgcaatcatcaaaccggccgatgcacgacccgactgcgcggccaaagcgcgcaaccacattacgcaatccaactacgcgaccagcaaccgcacaactggcaaccgcgtgaccggcaactgcgcaactagatggaatcaggaatgtcaatatcggttttctgcacttcctcaacattgacatccttgaacgtgacgatacgcacgttcttgacgaaacgactggaacgatagacgtcccacacccaagcatcagtcaggcgcacgtcgaaatacacgtcctggcctgcggaacgcacattgaaatcgactttattcgccaaataaaagcgacgttccgtttcaacaacatacgtaaacagcttgattacgtcgcgatactccttatacagagccagttccgcgtcggtttcgtaattatcgagatcctcggcgctcatcacttaccttccgtatcgcgcttgcgaccacgaccaagcgtgcgccaccaagcttccttcgacgtcttacgctcgcccgccgtgtacggccagctgttttcggcatcggcatcgccagtaacggacttgcgatcatcatgctcgctttgtcgcgcaggttccgcgccttccgcgtccttccgcacagcctcggccacgtcaccagcaccatcggaagaagctttctgcacggattgcgcagctgccgcggcatcgttgacatccgtaccttccgcatcatgcttcgaagcattcttctcattcagtcggatggcaatggaatgctcgcgcgcgctcaacgcttccttgacgcccggattatcttcgatcacatgcatgccgaacgcgtcaagcgaacggatcgggtcgaactcgtcaaccagcgtgtccataacgatcagatcctggtaacggttctgcgaagcgttccacaaggcgtcgcgcgaacgaccggacggcacgaatcccaacgactggtacacggacacggaacgcgtgttctgctcgggcacggcaacccaaatgcgatgcatgccaaggcctgccggttccggcgcaagtccgtacgtcatcacgcgcggcatgatgtcacgcgaatagccacggccgcggtaatccttgccaagcaccacctgaatgcgcgcggaacgagcccaaccgtcaatatcgatcaggaaaatcatgccaatcacattgtcggaattcgcggcatcgatctcgccatcgccatcatggtcggcttcggtgatgatggaccatgcgatcgtgcgacgcgactccggatcccccacaccggattcggtcggcgtttcgccttgggaccatgccacggaacgacgcacccacgcatgcaccgcgccacgctcggcaacccgatccttgccggtgattccggaagcgccgatgtacgccccaatggcgtccatacgttcaagatcttcgatcacggacggacgcagatgcaccatctcgcccttgatagacggaatgacgatgagatccggcaattcacgcgactgctggtccaactgctcctgtgtcgcagcctcaacttgttctggcattattcctgtcccctacatcattgcaggcacgaccgtcgccgcacccataccgagggtattgtacccgactgtatgtcagctgtgaatccgcgcggcggcaatcgctgtacatattcctctaccagcataacctgatgttgaaggacatgtcggcaatcgtaagaaaatgcgcttcgcgattatgcattctctttctttgaaatcccttttccggaataacgaaaagaaaacgcacgtcccaagctttttggaacgtgcgttttcctgcgattcaacaatcggctgtaatcgtcagcaatcgttgtaaacgttacttgatcttgctcatcacgatcttggtgacggcctttgcgtcagcctgaccgcgagtggcacgcatgacggcaccaatgatggcgcccatcggcttcatattgccgctcttgagcttttcaacgatgtcaggattggctgcgagagcctcattcacggccttttcgagagcgccgtcatcagacacgacctggaagccatgcttcttgacgacctcatccggagtgccttcgccagcaagcacaccggcgacggtctgcttggccagcttgtcgttgagcttgccatcggcgatcagcttctcaacctcagccacatcggccggagcgatcggtagctcttcgaggctcacgcccttgttgttggcttcacggctcagctcgcccagccaccacttcttggcacctgcggcggtggcaccagccttgacggtctcctcaagcagatccagagcgtcggcgttgagcacgtcacgcatctccaaatcgttgaagccccactcgcccttcaggcggttgcggcgctcgcgcggcatttccggcatctgagccttcatctcttcgatgtgctccttggtgatgtgcagcatcaccagatccggatccgggaagtagcggtaatcgtcggcatcggacttcacgcggccgcctgcggtggtctgcgaagcctcatcccagtggcgggtttcctgcagaatctcgccgccttcgctcagaatggccgcctgacggcgaatctcatactgaatggtcttttcaataccgcggaacgagttcacgttcttggtttcggaacgggtgccgaacggatcggacgggctgttgcgcagcgacacgttcacgtcggcacgcatgttgccctgctccatgcgagcgtgggaaatattaagcgcacgcacgatgtcgcggatggcgcgcatgtaggcaccggcgatttccggagcacgatcgcctgcgccaacgatcggcttggtcacgatttcgatcagaggaacgcctgcacggttgtagtcgaccagggagtggtcagcgccttcgatacggccgtcagcgccaccgacgtgggtgttcttgcctgcgtcgtcttcgatgtgggcgcgttcgatcggcacacggaacacggtgccgtcttcaagttccacatcaagatagccgttgccgttggtcggcttgtcatactgcgagatctggtaatcgcgcggcatgtccgggtagaagtagttcttacgcgcgaactggctccactcggcaatttcgcaatgcagggcaagacccagcttgatggcgtaatcgacggcggtcttgttgaccaccggcagagaacccggcagaccaaggctcaccggggtgagctggctgttcggatcgccaccgaacgagacttcggccgggcagaacagcttcgtggtggtgctcagctcaacatgggtttccagaccgatgaccggatcgaacttcttgacggcatcggcgtacttcatcaacttttcagccattttgttttctttcctccgatgcttcctacttgttcaagccgtcgagccacggggtcttcagggactgccagatcggaccgttccagtcttcctcgagagccgcctcaagtgccgcggcaggcttgtacatggcctcgtcacgctgctgcggagcgaggaactggaagccaaccggcaagccgtcgtcgctcagaccagcaggaatgctcatggccggaacgcctgcaaggttggccggaatggtggtgatatcgatggcatacatggccatcggatcctcggtcttctcaccgaacttgaatgcggtgaccgggctggtcgggccaacaagcacgtcgaccttctcgaaagccttcttgaaatcgtcgatgatcagggtgcgcaccttctgtgcggaaccgtaccatgcatcgtaataaccggcggacagggcatacgtgccaaggatgatacgacgcttgacctcgtcgccgaaaccggcttcacgagtgtaggccatcatgttggcggcggtctgcggaacgcctgccggcggcatgacgcgcagaccgtaacgcatgccatcgtaacgagccaggttggagctgacctcggacggcatgatgatgtagtacgcgccaagggagtacggcaggtgcggcagagacacttcagtgacttcagcgcccatctcctcaagcttcttgacaccttcgttgaagcgtgccataacgcccggctggaagccttcgccgccgagctccttgatcagaccgaccttgaggcccttcagatcacgcttcatgccttcgcgggcggccgccaccatcgggcgaggaccttccggaatggacgtggaatcgcgcttgtcgtggcctccgatcacttcctgcagcagggccgcgtcgagcacagtacgggagcatgggccgatctggtcgagcgaggaagccatggcgattgcgccgaaacgagagacaccgccgtaggtcggcttgacaccgacggtaccggtcagcgagcccggctgacggatggagccaccggtgtcggtacccagggcgagcggggcttcgaacgctgccactgcagctgcggaaccaccgccggaaccgcccggaacacgttcggtatcccacggattgtgtgtggtctggtaggcggaatgctcggtggacgaaccctgagcgaactcatcgaggttggtcttgcccagcagcggcatgcctgcagccttgagcttctcgatgacggtagcgtcgtacggaggcacccagccttcgaggatcttggaggctgcggtggtttcgatgcccttggtgacgatcatgtctttgatggcgatcggcacgccggcaagttccggcagctgtgccttttcctcatcggacttggcatcgaaggcgtcggcctgttcgagagcctgatcgccggacaccttcaggaaagccttgatgctcggctcggcggcctcgatgacttcgagatgcgcttcaaccagttcacggctggagacttccttggccttgatcttagccgccatctcggcggcggaaagcttgacgagttcgctcatgtcactcctcccccagaatgcgcggtgcaacaaacatgccggcctcggaaaccggggctcctgcggtcgcctcttcctgagtcagcggggtttccggcacatccgggcgcaggtaggcttccagcggaatcgggttcgcggttggttccacatcgtcggtagcgacttcctggaccttgttgatggattctgcgatgacgttcagatcgccctgcagacgggtgatctcctcgtcagtaagtgcaattcgggccaaatcgcccagatgcacgatttcttctttggtgaaagtaggcatgtccctaacattaacgcgtctgtgtgacgagcgcccgcccatttcgcctcgcccggcaaccccacactgcatgccgcccggcagccccacacgctaaccgcaacagcccgccgcaccaacaccccagctctgtcagagtcccaaatcccccacccactggaacaaaaggacgccaaacgctgtttcaccgggcaaatccctccagacactggaggattcttcccgccaacaagccatccacagtccaaaacctccatccacagtcccaaaacctccactcactggaacaatccgggcccaaaccagcctctcatcgtcccgattcgtccacccgctggaagaatcttcccgctgaacgctctgctggagtccggattcctccagaagatggaaggatcctcccgcggaaggccccactagaggccaaaatcctccagtcattggaacaaaacggacactaaaagcaatacaaccgtctaaaaacctccagccactggatgaattctcccactagcgcttcgtcagagcccctattcctccacccaatggaagaattctcccgcaagccagccatccacagtcccaatacctccacccaatggaggaatctggactctgaacggcatcccaatacttaaaaatatccaaccaatagaagaaaacaacaaaaattcacacaaaacaagcggatacaagcacttatctgcaaaacaaccacccagttatccacaaaacccgtaagttatccacagacacgcccgaaacagcatcctctatccacatttgccgatcgcacttccatagcagagccacaacaaggtagcgtcaaatcatgaaagcatatcctcaaatcgatgcgctgctcgatcaaacagaaaatgcgcaacgatgcgcacacagcagtgaccctctcatccagaagggactatatcgcagataccgcgcgggagatttggcgcgcccgtacccagggctattcgcccgtgccgaatattggaatcagctgaacgagcccgaacaatcgttgcacgcggcccgaaccctcagcaggctccaccccaactgggttttcgcaggaataacagccgccgcagcccacggattcgaccacccgcgattcctgcaccggcaaggactgaccataacattgcccaatcacggatcataccggccgcacgacaaactcaatatcatctacagcccatatcccagagaaaatgcggtactcgcaaacggaatccatgtcactaatccccctcgtaccttattggactgtggacggacgttagagttcatctattccctgccgattttcgatgatgcagcagcagacggaatcgaagaaaagcagatcttgcaggaatgcgcacgcacgacactcgattgctcgcgcatcttcaaattgttgagatataccgacgcaggaagtgaaaatggcggtgaatcttttgctcgggcagtcatgattgaaaacggttttgcggttcctcaattgcaagtctccttcgccgactcgcttacgggaaaacaatttagggtcgattttttatggcgcacaaccgatggacgtattattgtcggagaacttgacggcacagcaaaatacgttgatccgaaaatgactgatcgtaggagcatccaggagaccgttcaggccgagcgagaacgcgagcaagcgctttttcgcgcaggagttacggaaattgtcagattaacttttgacgatgcagtccagcaaaaaccgctgattgcgaaactgcggcgtgctggggttccttgcgtttcatagggtaatcatctgcgggaagattcctccagtaagtggaggaatcggaacgttgagaagctcgccaccgggaagattcctccagagggtggagaaatctagactctagcagggcactcagcggaaagattgctccagtaagtggaggaatcttcccgcagaacaccgtactaaagtcccaacctcgccagtcactgaaggactcaccccgccagacgccccacaggagacccaaaacctccacccactggaacaatcatcccgctgacagaactccaatcgtcccgattcttccagtcactggaggattttggacgataggagatggaggttagagctggggagcggcgtgctgggagatccatgcgtgcatggagactgctgcggcagctccggcgttaatggaacggactgagccgaactgagaaatgtagaccacgtcatcggccagctcgagcgccttttcagacaatcccggaccttccgcgccgaacagcatgaggcatcgcttcgggaaatggtaggtttccatcggcaccgcgccgggaatgatatcgagcgcaatcacccgcgcggccttcaactcggcgatacgctgattaatcgccgccaactgcgccatacaagtggactcgtttccatgttcaataccactcgtagctgaaacgtccattgaaataccagatggagcgcacccagcaacacggatctcagctaacgaagccgcctcgctcatgcaggcacagttcgctttttttgcattttcgcgcatgcggaatgcgattgcggccgcttgcgattggactgcggcgatttctccggcaatgcgcagcttccagcattcgacaagttcggttatggaagggtggttttcgacgtgctggtacagttccgtcatcagcgaccccttgcgattccacttgtgcggtccgacgatatgtacacgtttcgcttggaatgcgttggcagtgcgcaccatggatccgatattgaaatcgtgcgtccagttttccacggcgacttcgaaatcatgccgaccatgatcgtcaagatcatctttaatggccgaaaccgtccagtagcggtaccggtcaagcacgttacgacggtcgccctcatcaagcagcacagtatcgaatcgacgatcataattcggtgattgcggatcatccggacgaggttcgccaggatgcgtttggccccacggacctacgcccacctcacgaaaagccggctctccggacgctttcgccgcaatatcaataggattaggctgatgcacgattttcctcacattcgtcgtccgatatttcgtcgacaggtaacttctgttatatcttccaccattcgcccacgatcaacatcggcaatcgcagcattgcccaccgcgattttggagatcgcctgccgtcaaccgcatccgtactgccgactttatttttcctttactcatgtcagcatgaacgtcagcatgattccaacagaacaatacccgtgaaacattccatgaaacacggcggatgacatcattaaaaaaaccgccggtacaaccggaaagtcgcgctggtcagtgaagctccgactccttgaagacctccacaaacggcagttcagcttcggacccatccaccggattgacgactttgatcgacgggtcggccatatcgacgccaccaatcaacgaagcgacagcaagcacttcggcgccttcgttcttcaccacggagaagtcaaggctcaactcattgccgttacgcaaggtgaccaaagaggacgtctgcacatatgacttttcagacagccaggaatccagcaacaccacacgtttaccggcaatcgaaggccccttgatggacggatacacaaaatccatcacaaaaccgttaaggttttcacctcgagaagcggccgcctggatcatagcggaaaccagcggaaccgcagccgcagtcagcgcaccaaccgcatcgaaatcatcaacggaatagccggcctcttccaacgtatccaacaaaatatgcccaacaatcgacgctccacgatggtcgaacaacactgaggaaagttccgagaacggcttatcggccatctcggcctgcagcagcgacttgagctgatcacgcggttcaagcatggcgaaatcaacggctgcgttcacagtatcgccagcggttacggcagtggattcagcaaccggcttggtcttacggaaagtcttctcttcggtcatagtcccagcctaccgtttctactcgtcaaaagagtgacagtgttggtgtcaacaagcaacgtccaatatctcccatcaacagatggtcaacagaaaatcaacatttcaaaagtcaggccggtctcaccataaaaatgaaaccggcctgaaccgaacccaagaaaccggcgagagcagcagattactcacttaagcgcgagaatccacttcagatctgtttcaaactccgcttccaggttcgcttccggactctcatttggtctcgcttccagccccgctgacgcaccggcgcaataccacacccgctcccaccagcaacaccatcacggcgattacgccactgacagccgaaccggtattggcaaccttattgccggtcttggaagcagtattgttcttaccattgccagcagaattaccggaattaccaccagaattatccgaatccccaggtttgtccgaatctccgggcttgtccgaatcgctcttcagcgaagcctgcgccgctgtcaacgcttcagacgcctcatcgacgtccgcctgcgatagcccctcatccaaagccttagacagcgccagtttcgcagcgtcacgagcctcaacgaacgcatcccacttcccactgtcatatccgttgttgaccaccgccgcagcatccgcaacagcggaagacaacgcatcggtcttcgccatcgtgatcgacacgccttcatcggtaggattgatggtttgcatcagcccgttttcgtcgaaggtgatctcgtcgatcgcggtttcgcggtgaaagccaagcccggaagtaaacacgccaagcggagtgtagtgacggtgatacgccatgaaccagcgctcttcgccattcgcgtccaccacgtgcacttcggactgatgggccgtaccctgcaaattcttcgacgcgtccttttgcaggagcacgccatggttgtcgatatcagtcacggagccatcttccttgaacagcgacggcgaagtgccgtattcgacgtggtaattcgccgatccggcatcgtcgcatgaccacgtccagtgatagacgccatcgcgcttggacaccacaacggattcccggaagttgttcagaccgttgatccgtttgaccgttcccggcaccacgctcatcatgtcatcgctcaattgggcgatggccgccgaaccgttgccgtacaggatatacgacgtgccgtcatcatcggtaaaaatcgacggatcgatggcctgccccacagtcacaccctccatcgaacgcgtaacgatggggtctttggccgccttgtatgggccggcaggcgaatccgctaccgccacgccaatcgccgattcaccgctctcaagcttggcgcagtagtagaagtaatactcgccattctttttctcgatggtcggcgcccatgcggatccgacagaccaaggcgaaattgccgtattctcgtcgccattcgtggtcggctcgtgattcttatccacgtcgaggatcactccttcgtcggtccagttgaccaggtcggtcgagctgaaagcatggaagtaattcccactccatcccgagaagccatcagtcgtcgggaaaatccagaattttccgtcgaaataatcgatatccggatcggcatattgccccggcaaaaccggattatttgactgaaccgccttttcgagcgtccatttttcgctaacgataccaccgttgccgtccgaacattcgattacaagcgtatgcttcttggacatgtcaagcttgtcaccgctggcaaacgacttgccatcgaccgtgacactcgcatcgtcgtaagtcagcgcgaacgttaccggaacggcgttgatctcggcacgattgttcactacggaggtgatggttttcgcgtcgcaatccatgctggtacgcacgttgctgtgcttatcggtgccacgcaatgcatctgcttgcgacgaggtcggcacagtgcccacagtgatggatgcgagcgcgggcgcgttgttccgttgtgcgatttcgttggcgttcagcgttcgattccagatggtcagattgtccatcagaccggaatagtattcgccggatccccagttggctttgccgatttgcaggattcctccggtttcgccaaggatttccttgacgcccagcccggaaacgtccgtgctttcgccggcaagcacgccatcgatgtagacacgtgtcgccttcgcgtttaccgtgacggtcacgttgtgccatccgtcgccgcttgtggtggccgatgcgttgcctcgaccatctcgattgccgtcggtgttgtatcgttcgacaacaacgctgccgaccttatcaagcactccgatgtagtgttcggattggttgtacgtcggggcagccgtggacggagccgcgtagaaggtccagccggtattgccgttggagtcgggcttagcatcgtaggagacggtgaactcggtggcgtccaacagcagtgcggcgccattggtttgcgtgacgctcagccaggaaccgctgcccagtcgagcggctttggtgccgttgttgccatcttcaagcttggccgttccgtggattccggcaactgccagatcgctggtgtaaccggtttcctcatcgtcaaaggtgaattgcgcgatcggattcttctgctgtgccagaggagtgttgggcgcggtatgttcgccgtaagctgcgagcacggcggtttcctcgtcgacgtttagacggacgacggtgccatggcggaatcgctgtccgaaattggctgaggcctttgagaatgtgcccgacttcttcagggacgacagttttgcgatggtccagccggcgtagcctccgttgtcgcccatcacaatccacgccccatcagtgccttggtacacggtcaaaccttcgatgcgggtgctcaatcctgattccgaggtcttgacgactttgtctccagtaattttcgacgtgccgtcggcattgacttcggagtcgcgttcaactagtcgggtccacttctgcgcttccagagaatccgcggtgtcgatcaccgtgtaccaatccgatgtggagaaacgatagtaggatccgtcatcgccttgcacgattgtggtgtcgatgatgttatgcaggtcggccgagctttgatcgatccagatttgaggattctcaaacgtggtgaagtccgaagtgtatgctttgtacactttcagcgcggtattgccagtagtgggattgtctccgcctgttgacaggtcgcggcttgaccaatacaccagatatttgcccgcttcggcgtcccagatcgcttcgggagcccaagcgttgccgactttgccttccaaaccggttgataccagttcaggatcggtccagatgacgagatccttggatttggcgaccacaagataggtgctggcgttgatctgattccaagaaccgcccgaagcgcttccttcggcgtgcagatcggtgccgagcatcacatacttgttgccgtccgcatccggctcttccaagcgaatcagatgcggatcgcggatgcctttggtgccttgcgtggaagacatgattgcctcaccatcgttcagcgcctgccatttcaggccgtttttgctgtatccgtaattgattttttcatagtcggatgcgttgaagtacagccacagatatccggctttcttggcagcatcgtcatctttgggatcatccttgccgtcatccggcttggataccgtcacggttgcctccacgggcatgcgggagtcgtcttgagcggttcccttgacggtgaaggtgccagccttggcgtactggtccgcgtcgatgtcatcccattgcacgtcagcatcctgttcggagccgtcagccattgtcagatgcacggtttccggcatcgtcggagcggtcccggcgttagtggacacgtcaaccgatgccaccgacttgaccgcgatgctcggcgcataggcttcaagcacggtctgatactgggcgcgggtgaccggaaccacggtgccgtgacggggcttgccaccatcggaattgacggggaagttttcctcgggcatcttgtcgccgattaccgtccacttcgaagcgtcggaaatgtcggtggtcgccatgggcacgtaatggttcggacctccgtgatagctgggctggtcggcgaacagatagtattggtatccgttcacatcgccttcgttggctttgaacagcgaggggccttcgcctgcggagaaggtgccaccgtatccgttggatttgtcgttgccgatcgcggtgccgacttcgctccacgagctgccggacaatgccgtgctgtagtctttgacgccggcttttccaatggaatcggtcagggtgttggacttctcctggcgcaaggtcatcgacttttcatccttgtagatgcggtagtaggtgtcgccttccttctgcaccgtcacatcaatggaacccgctccagcttggcctctccgatccacgtcaatccacgtcttcggtttggagaacgtgatgaaatcaggcgtcgtcacatacatcatgcggttgtaacttggcgaggtacgagtgctcgaatcgtcattgtcgtacagattcgaggcccagtagaccacatattcgcccaactcatcatcccagtaggcttccggagcccacgtgttgcccgcgctgtcgtcgctgaccttgatatgacgctggttcgtccagttcaccagatcattggattcccaaacctcgatatacagcgaaccgttgtactgtgccgccgagaagctgcccttcctgccggagatcttcagatcggtggcaagcatgtagaaggtgtcgccgtcatgcgagcgcatgatgaatggatcgcgcaatccctgttcgccttcggtggaagtgaacagcggagtgccttcattgagcgtattccagtcgagcgcgttgttgcccttggaagcggcgaggcttatcttctcgcctcccacgccttcgccggtgaagaacgcccaaatgtatgcctcatctttgctttggtcggaaggcatcggcgaaacggtgatcgggaattcccggtttgcggtggcaccgttgttcgtcgccgtcgcttccaatgtcacgttgacggaatctttgccggcagccggccgattcaccgatactttggcattgttctcgttatatccttcggcgatagaagcgttcgcaccgccatcgttcttgacggaccatgtaatggcggagccattgtcaccgaccgtcggcaccacgaaattgctacgaatatcgtcggcgtccaagatattcacggcatcaagatcgctttggatcttctcatcgtccgatatgatgtgcggaaccgtaaccttaaacgtccgcaactgatcgtccgagccgttgagcttggcagtcaaagttgccacagcatcggcttcaccgactgcggggcgagtaacttgcgcggttccatcttccgtgaaccggatcgcgttgttatcgctcgaccaaacgatcggcacaccgttgctttccgtaatgacggagaagttttcggttgcctcttgcgcaacgctgatggcgttgaacgcatcggtcgccgcagctagggaactgtcgtaaatcttgaaattgtcgatcagaccggtaaagtattccgcgccccaattcgctttgccgagttgcagaataccaccgtctttgccgaggatttctgtcagatcatggctttctttggcctccacgctgttcacaagtgtgccgttgacgtacattgtggtggattcgtcggatacgactacatccacgtgcttccagccgacactggaagcaccgctgacattggctcccgtgcgaccgcccgtggtgttgttgtagcgttcgaatgtgatcttgtcggttttgtcaagaaagccgatgtaatgctcataaccataggttggtttcgccgcatcgcgggccgcgtacagcgtccagccgctgttgccgcttgatgcgggcttcgaatcgtagctgatggtaatggcatgcttgccttgaagcaccgcactaccatccgcggatgtcaggctcatccagaatccgctggacaggttggctgcagtagtgccgtcttcgccggttcccgtggccgtctggccattaatcgaagcgacgatatttcccgattggtaggttccggtttgtcctgccgtaagatcgttgaaattcagatctacaagcaggctgctttcgttcttgtatttgtcaagcgccgatggctccgatgccatcgtacttggcgcaacgagcagaacggcagtcatggttgcggcggcgacgatagcgccggtcaaccgtttgacggtgagatgttttctcgtattcataaatattccttgaagaattcagcattagtgcatgcgattcatgcataacaaggaggatgagaaaccgtccgggaaggaggtaaatagaaccggacggtttctcttacggggcttcgtcttgttttcacgcgggatggatggaatacgtggaaacggaataggcgaagcgttcatgtgaagtcagcgagctgccttccagcgacgcagaacagccaacgcaccaccgatggccaggattgcggcgaccagcgctatgcccttgacattggcaccggtattcaccacaaccgcagccttcttcgcagtcttcttggtggtggtagtaccgggcttagtggtcggagccggagtcggatcaggatcaggagtcgggtccggagtcggatcaggatccggagtctgctcgattgcatcgtcagacacgttgaccaagttatcggtgtacccaccgtaggccgccgtgatcttggaaactttgcccagcgcgccttctggagcggtgactgtggcgacgccatcagcattgagcttgacggtttcggtccagtcgccagcggtgaagacaaccgatccggccacattgccgccgtccttggcggtgacagtggcagtcagcgtgtctctaccgcgctccagcttggtcgtggagtcagtcgcatccggagtggtggggttggcggtcgtccaacgatgcatgttctcggcgatggcagcaggcacattgacgaacgcaccgtggcgggtcggggtcggcatgccattggcatacacgtagccgctcacacccgcgttctgatccttctgagtatgccatccatcggtctgcgacagtcggttgttccaatcgcagctcagcagagcggattcgctggtcatgtacggctggtatccaccggaatcagccatgatgaccatggcatcccctgcttcattctgatacttgtctccggcgttgagcttgatagcctccggaccttcgaacggcaagatgcgctggtcaagcagctgccagccggtttccggatcggtatcgggagatgcctcctcggtggtggccgtcagcaccttcgaacgctcaaggaacgtggacttgccgttggtgatgtagcttccggcagcgccgctttcctcgttcttggtgaagcggtagtagtagtcgccaaccttgatgaccgtggagtcgatacgggaatagttggtatcctgccacatcaccggttcggtgaaggtcttgaagtcgcgggtaatgcagtacagcagcacgttgtacgcgtagccggtattggtgctggtcaccgcggtggaacgggtgtcgtcggtgtacatacgtgacgagaagaacaccacgtaagcgccgagcgaatcatcccagtaggcttccggagcccacgtcatgcccgcattgtcgacattgattttaatgccggtatcgccgtcggccgcgttggtgcgagtccagttgaccatgtccttggactcccacacttcaaccttgagcgaaccatactgctggttctggccccatccttgtgcggaaaccttcagatcggtggcgatcatgtagtacttgtccccgtcatgcgacttgagcacgtaaggatcgcgcaggcccttggtatcggcgttagattcgatgaccggattggaattgttgatttccttgaaggagaagaagttgttgccttccgtggcagacatgtacagcgcttcgcccgtcttaccattcgtcttgtcggaatccgacaggaaggtgactgcggcataggcttcgtcaggcacttcgcgagtcttttccttgactatcaccgacactttggcggttttggtgacactgccgtcagcgttggccgcggtggcggtcagctctaccggcgcggcatcgccgtcaccgtatgcagggcgggtcacaacgcctgcacccttatacgggtcagcggatccgaccgacggcgcctggtaatttgtatcggttccggtgatcacattttcattggaagacgtccaagtgatggtggatccgtacttcgagccggtggaaatcagcggcagattctcggtggttgcctcgttgacggcagaaatcgcggaatccagatcgaattggaccacggtcgccggatccaacggcttgacggtgacgtcaacgcttgcggaaacgccgccggccttcgtagtcgccgtgattgtggtggttccttctccgacagccgtaacggtgccgtcgctgtcgacggtggcgacggaagtcttcgacgactcccatgtcacatcggtgctgatggcgttttcaggagaaaccgtggccgttagcttcgtagcgctgttttcaaccatggtcagtgcaccgtcaagcacgccatcgccaacgatcgtcacgctgcttggcaacgtgacgtccgcaccttgatagatcttgatgtcatcgatcgcgccactccaataagcgtcgccgctatacagggatttgccgatggttgcggcggtgctgcccagatcggccatggtgatgccggtgtttgccttgtatccgacaagttcgccgtcacgaagcatggtgagggtttcgccgtcgacgatcagcttgtagttgtgccagatattgtcattgttagacagcgaagtcttaaatccttgctcattgttccacttgttatcggaaatgacgaacttcgtggacttggtgctcaggtaccagaacaggtatttctgctggcttccacccacagagaagctgaaatagttgccgtcatcagcatgacgtgatttggcagcgaattccatggtgaacgagttgcccgccttggcgaacagctcatccgggaacgaagcatactggccattgcctcgcagagacaacgcctggttattgttcctgtcgccgaacgcttcgaccttcgcaccgccgttcatggtcaggttgtacccgttgccggatgtgtcagtcgcagttccgtcggaaaaatcatagctggcaagcaggttcagaccgcttgaagcagagggggttgccgaaccgttaccggttccggcgccgtcttcagcgaatgcgaccggcgcgaacgaaaccatcatcggtaccgtgaccgcgatggcaagcccacgtctgagaatatcgcgtaatcgttggctatgtcgtttcatgcactctccttgatttaccaccgccgcacacggttacgacatagagtgatagctagcgctctgcttatgcttcattactgcatcaccgttgttcgttctgagtcggcggcgctggtccgtatttattgtttttcttttgcttgtggccgcatggccggaccgtccatgtccaaccacgaaccgcgacgcaccctacaactctgtgaacgttaacggtctatgttctattcaaaactatggtgactttcaccacaatcccagccagtaacaattcaataacaattccagccagcagccctctttgcaacaaagacggcggaagccggacaatccccttaaaagagcctcatcaaggatttatagacccccatacaaagccaaatagcattacaacacctgctgcagcactcgccccaaagcacccataatacacccttttcacagcacctactgctcgttggtttcaggagcggtgagttcgcggatgtcggctttttcgggcgcgatcatgtttacgggttcgatgattctgctctggtcgacgcgctgcagctttcgcgcggttaccagcacgcgcgactccagcgacgatgcgaacgcattgtaggctcccacagttttggtgatggcggaccccagcttggtggcgcgatcgcccaacaccgcgaaccgttcatacaattcgcgggacaggtcgaacagcattttcgcgtcatcggtcaggctttgctgctgccacgcgtatgccacggatttcagcaccgcccatagggtgatcggcgaggtcaaagccaccttgcgtgcaaacgcgtcatccatcagcgtcgggtcagtttccaaagccgcctgcagcagggattcgttggggatgaaggcgatcacaaaatcgggggcatcggcgaacgcgttccaataggccttgtcgcccaaggtcttcacatgttcacgcactgccttggcatgcgcatgcagcagctccgactttcgcgtcagctcctcgggcgtggcggtatcgggaatctcgcacgccttctggtagtcggcatacggagccttggcatcgattggaatggttttgccgcccggcatatggatgaccatatccggacgctgcgtatgcccatccacgtcggtgacgaccacctgggtgtcaaaatccacatgttccagcagtcccgcggattccacgatgttcctcagctgcgcctcaccccacgcgccacgcaccttgttgttgcgcaacgccgacgacaaagcgttggtttcgcggtcaagacgggcctgctgctcgccaagccccttgagctgctcgccaagcgcacccatctcccgtttgcgcccttcttcgatttgcgagaccttctgctgcaaggcgtcaagattcttctgcacgggcgcgagcgcggacaataccttgctttgttcctgcagtttccgctcgttttcggcctgcttgcgttccgcttcggccgcggcccgctcacgctctcgctccactcgttcctgttcggcccgttgggcttgcgcgagctgcgatttgagataggtcaactgctgggccaacccttccgcctgcgtgcggtattgggtcatcgccgtggacaattcgctgatttcctgccgatcagcttcgatctgcgctttcgcctcgttaagatcagcggttttcgcatcacgggccatttcctgccctttggaacggcccgcaaaaaagccggccgcggctccaagcgcagccacaaccaccagaagaatcaccacaaacacaggattgtcgaacatatgttctatataacagcatgaccaagacatcttggaagatcaaagttcgcaagacatccatgcccagctgcattatgcttggagccgaaagcatgctcacgaacatgcggcaacgcgagcacgctgaatattcgagaggcattcaagaggcaatccgggggttcggaaacacatgggattcgatttgtttatgacggtggcggcgattgttgcggcggccgtggccacttgggccatcctcaggctattcctaagcgaaaacgatgacatagccccctcccaccaacgcatcaccgatgacaagcccgccaagaatcacaccgaaaatcacaccgaaaatccagacgaggcagccggcgcaacacaccgaagcgacatcgccaagagtctcgccatcgcaaccatactgaccgctcccacattcaccgtaaccatgctgacattcggcggcatcacacttccccactggctgaccaatccatggctgcacgccatcatcgccacgccggtcatgttctactgcgccgcgccgatgcacaatcgcggtatcgccgccctgaaaagccacacgcccaacgcggattcgctgctgtcgctcgccatgaccattgtgtacgtctacagtctgctggcgtgcgtggtgtcgtggattttccccgcggggtcacgcaatcagtatttcgctttcgcaagcatggtcgccgtgctatcgcttgcgatttcgctgatcgcgcaacgccccatggcaaagaaagcatcggaaggcgatattccgaccgcacaatcgcaagaaaagcaagaaatacaatctcaagaaacgcaagaaacacagcaaagcatggatacgcttatccaggccagcatcacatatgagattcgcacgcgggtaacgcagattaccgcgaccgtgacgatggtcatcgcggtgtggacgttcgctttgtggctgattttcgggcttcagccgaagcttgcgatcgccgtgttgatcggtgcgacggttttgacggtcgcaggcttggttttgcaggcatatgaccgccaaccgtcacggtaaaacggttttcgcaaaagaaaatcgcgcaatcgcacgaaaaatgggcggacccgcatgtgcgcagtccgcccaccgtcaacggttagaccgttttgtgactcggccaatcaacagtcagtcaggccaaaccgatcagccgaatgactccgaccgtcacttagcctctgccgaaaaatcgtcgtcaatctgccccggcgcccacgaggagagctccaaatggtcgccgccggtctgatccacaagcacggtgtcgccgtcgtgcacttcgccggccagcagcatgcgcgccaactggtcgccgacttcggtttgtaccaaacgacgcagcgggcgagcgccatacgccgggtcgtaaccggtgttggcgagccaatcgcgcgccgaatcggtaacatccagcttgatgcggcgatccgccaagcgggccgaaacctgcgccacctgaatgtccacgatgccgccgagctcttcgcgcgtaagcgggtggaacataaccagttcatccaagcggttgatgaattccggcttgaactgcatatgcacggcgtccatcacggccttcttcttggcttcgtcatccagttcggtgttcaccaggaactgcgagccaaggttggaggtcatgatcagaatcgtgttcttgaagtccacggtcctgccctgcccgtcggtcaaacggccgtcgtcgagcacctgcaacagcacgtcgaatacttcaggattggccttttcaacctcatcgaacagcaccaccgaatatgggcggcgacgcacggcctcagtcagctgaccaccctcctcatagccgatgtagcctggcgcagcaccgatcagacgagacacagaggccttctccatgtactcgctcatgtcaatgcgcaccatggccttttcatcgtcgaacaggaagtcggcgagcgccttggcgagctcggtcttgcccacgccggtcgggccgaggaacaggaacgagccggttgggcggttcgggtcggaaatgcccgcacgcgaacgacgtaccgcatcggaaaccgcttgaatggcttccttctggccgatcacacgtttgccgagatagtcttccatggtcagcagcttctcgttttcgccttgcatgaggcgtccgacgggaatgcccgtccagtcggacacgatttcggccacggagtcggcgtcaacgcggtccggcaccatcggaatatcgccacccaagccaccgtcagcaccgcctgccgcactgttcttggccgccgcctcgttttgttcggcttgcgcgatctccttctggatggccggaatttcgccatagttgatggcggaggatttcgccagatcgccttcgcgttcataccgttcggcttgggtgcgtagttcgtcgagcttcttgcgcaggtcgccgatgcggttgtgcccgttcttttcggcgtcccagcgtgctttcagaccgttgagtttctcgcttttgtcggcgatttccttgttgaggtcgtcgagacgttccttggcgctttcatcaagctcgttttccgctttctgcgcggcggcatcgtctttcggattgccaagcaggtacgatttttccatcttgagacggtcgacctgacgctgcagttcatcgatttcctcaggcgaggagtcgagttccatgcgcaggtgcgatgcggcctcgtcaaccagatcgatggctttgtccggcagctgacggccggaaatataccggttcgacagcgtcgccgcggccacgagcgcatcgtctccgatggtcaccttgtggtgggcttcgtatttcggtgcgatgccacgcaggatggcgatggtgtcttccacgctcggctctcctacgaacacctgctggaaacggcgttccaatgccggatccttttcgatgttctcacggtattcgtcgagtgtggtggcaccgatcaggcgcagttcgcctcgcgcgagcatgggtttgagcatgttgcctgcgtccatggatccttcggccgcgcccgcgccgacgatggtatggatctcatcgatgaacgtgatgatctgcccgtctgcgttcttgatttcctgcagcacgctcttcaggcgttcctcgaactcgccacggtatttcgaacctgccaccatggagcccagatcaagcgagatgagcttcttgttttgcagggtggtcggcacatcgccggcgacgatacgctgcgcgaggccttccaccacggcggttttgcccacgccaggctcgccgatcagcaccggattgttcttggtgcggcggctcaggatctggatgactcggcggatttcctgatcgcggccgatcacggggtcgagcttgccttctttcgcggctgccgtcaggtcggtcgaatacttttcgagggctttgtaggagccttcggcgtcgggactggtcactttcgcgcctcctcggatcgttggcacggctttgcgtagcgcgtcggcggtcacgccgtattgttccatgatttgcgcgctctgattcggctttgccgccgcgatggcgatgagcagatgttcggtggatacgtattcgtcgcccatctgctgcatttccttgccggcttgcgcaagtactgcggatagttgcctgctgacttgcggttgcgcggtggtcgatccgctggcgcttggcagcgcgtcctgcgcttggtgcacggcggcgctgatgttttgcgcgttgccgcccgcggcttcgatcagaccgcggatcacgccgttttcctggcgcagcagcgcatcaagcaggtgcagggtttcgacttgcgcgttgcctgctgccgacgcgttctgtacggcgtcggaaatggcttcctgcgccattgtggtgaacttctgttccatatcatcctccatggttcgcgccgatcgtccgtttttcgcacggtcgcgtcgacgcatatgtcgttgtctgatatgctcaaccgacttcaccaccattctattcccaaaagttgagcctgcaacactcaacttttgttcactaaacgggaaatcgcgaacaacgcagcacaaaggccgtcacccacgaaaggtgacggccttcatatcttcaatatgtcaatcagcaatcggcaatcagccgcgcaccaccacgttgcgcaggctgccgatgccttcgacgtgcacgatcgcctcgtcgcccggatcaagatggccggaagcgttcggcgtgcccgtcagaatcacgtcgcccggcagcagcgtcgtgaagctggaaatcgccgcgatctgctccggaatgccgtgaatcagattcgccgtggtgccggaagccagctcgacatcctcaccgttcagcgtgaaggagatcttcgcgtccttccaatccaaatcgtcgcgggtcacgatccacgggccgagcgggcaggaggtgtcgaagcctttcgcacgcgtccacatcgggtcaagtccctgcaggtcacgcaatgtcacatcgttcacgcaagtgaagccgagcacgtaatccatggcctgttcgaccgtcacgttcttggcgatgcgccccatcaccacggccacttccggctcgaaattcatatcgttcgagtacgacgggatcacgatcggatcgtccgggccgatcaccgacgtgctcggcttggagaagatcaccatgtcttccggagcgtgcttgatgtcggaatggcctgcttcatgcatgaactgcgcgtgcgcctcgtaattcttggccagcccgtataccttcgacgggatcaccggagagagcagacgaacgccatcgccatccaccggaaaacgctcgccggtcggcttcacaccggcaccggccagaggatgcccctcaagcgccacgagatagtccttgccgtcgctttcgtcggtctgcacgaaagcgtattgcggtacatcattatgcgaaaaacgtgcgattctcatgtctgccagtctacccgcaacaatcgtcgaatcgtccatatcatcgacatgcaacgcccgacaatcaaaaacatcgaaaaaaaaaacgggccatcacatcatgcgaaggcccgtcacaggaagaaaacgtcagataaaagcacgctcgccgaaaatcgcggtgccgacgcgcacgatggtggatccttccgcaaccgcaagttccatgtcgccggtcatgcccatcgacagttcgcggcaggattgcgtgcccggctcgccggattcgagaatatggtcgcgggttttgcgcaggtgctcgaatcccttgcggatggcggtttcgtcgtcgacatgcgcgccgatggtcatcagcccctgcaattcaagtccgtccaatgtaccgattttttgcgcgatgcggatggcatgcgagggatcgcagccggatttcgacgcctcacccgattcgttgacttccagcagcacgcccacggtgatgccgcgcgccacggccctgcgcgagattttctccgccaagtcaagggaatcaaccgattcgatggtgttgacgaccggcagcactttgccgatcttattgctttgcagctggccgatcagatggaacggaatatgctcacccgcaatagtggaagcgccggcatcgtcggcaacgcccaacgcgaatccgcgctccccgcaacgtgccatcaacccttcggccttcgccatcacttcctgcggacgattctcgccgatcatacgcacgccagcgtcgatcgcagccatgatctcacccacgtcgcgcgttttcgtggcggcaagcaggcgtacggaacctgcgtcacgcccggcatgctgctccgccgatgcgatgcggtccagcacacggtgcacgccatcggcgatctgcacggcacgcacaccgtcgatcgcctcattggcaagattcttatggtccatatatgcagtcatgttcagcctcttgcgttcaatcccaactacctctaccagagtaagaagaagcccgtacgacggtctgaagtgaagcgataaagcgaccgatatccgtacgggctaataaaacagacggcagtagaagggggaacttcaaagactccgtccgacagcaactatatgcaagatttactaaacacgcgccgaaaaaaacttttttcttcaaaaaaaaaatttctcagcgaactcaaattcagccttgcgattcgtctaatttgcgttccaaagcatcaacgcgttccttcaacgcaagcacctgacacgtcagcgatcgaatctgccccaactgcacagtcaccaatcgttccctggtgtcggaagacaaggcgcccgtcgtggaattgcttcttgcggccgccataatatccagatccactttccaacgtgcgatattacgttccacacgcttgcgcccgataatcgcagggctcaacccagccgacgtgaaaatcgtgctcggccgctcgccatccaaatatcggcgcatgcaactgatctgaaaatcacgcgaatacgtgatccgattttccgtaaccgactcaaccgccggcaacgcacgaagatactcgacctccgtgttactaaactgccttttcgtcatatcgaccccattcatccgacaaaacggaataccattctcgtgctcgtagattaccatcacaaacgaacgcacccgaacggcatatactaccactttaacgtaaggctatgggggctcacgccacctgaatcgccctacgctaaacctagctaaaccccaacgggtacagttgcgtactgccacagtcaacccaccaaaggagcagccatgaccggccgattcgcaccaaccccatcaggacgcatgcacatcggcaacgtttacgccatgctcggagcatggctttccgcccgcaaatcgggtgattccatacggctgcgcatcgaagacatcgacgagccacgagtggttcccggcgccgccgaaaccatgatgcgcgatctcgaatggcttggtctcggttgggatgacgaaccggtattccagtcgtcgcgacacgccctataccaggaagcgcttgagcttctcagcaagctgagctttgacgaaatcagcgatattatcagtactggttccaacgattccaagccctgcagcactacagcaggcaacgaagcagccacctctgaggcaacaccgctcatctacccctgcttctgctcgcgcgccgacatccgcgccgcctctgcgccacaggaaggcgatcgtttcaccgtgtacccaggaacatgccgacgcctcatcgccagcgaaccgcagcgtgcgaaacaacgcctcgccaacaacgaccgccactcgatgcgcatcgccaccgccgacaccaccatcaccttccacgacgaagtattcggcacccagcaatacaacctcgcccacgacatcggcgacatcatcgtgcgccgctcggacggcatctactcctaccagctggccgtcaccgtggacgacctcgacatgggcatcaccgacattgtgcgcggccgtgatctgcttcgctccaacgctttgcaaatctacattcgcaaagcccttatcaacgcgggattcaagccttccgaaccgacacagcccttccatcctgccgacggttccaataaacctgacgatgtgaccatctcatacgcgcatctgcccctcatcgacaacgcagccggccaacgccttgccaaacgcgagcgctcgctcgatctcggcatactcacggcacacggcgccaccgcgcaacagatcatcggctattgcgcatggctgctcggattgcagggagacctgaaacacaccaaaccgcagcctatgagcgccgacgaagcgcttggcgtattcagttgggatgccgttcgcaccaacacgtcagaccgcacgctcgatcaaggcgagttcaacgcatatttcggactgtaggccctattctgcagttttattctgcagctctattccgcaatcgcgttcagccaatccataattccgaatcaagcggatattcgttgatcgcacagccatccaaaaatatggactgctcctgcataagcggtgccgcttggccagccccgcgcacgtcatctcattgtcgatatgccccaaccggtgcccgacctcatgattgatcaccatcgtgcgatatcgcgccaagtcgccgcctcccgacatccacacgtccgtgccggaattccaacgatcatcgttgataatcacattgttgcccacacggcagctgtattgctccgaacataccgacgagaacgtcggcaaggtcgacgcttgggcgagcacgatattgaaatcgcaattgccgtccgtagaaggttcgaaaatcgcgcctgcgcgcccatccatgttcgctgttcagaatacgaaacacggcattcgaaaaatcttcgactgatccgacttcaccattggtgaccacacagtaatgatattgcaccatgccatatccgctgttttgcgccgtttgctgcgctttcgcaagtatttcgcttttctgatcgtccatcagcgcggccgactgctcgcgaagcgctttggtgacggcgtcttcctgcggttccgccgtttcctccgctgaggcctttgcgtctttcgttttcgacgattcctaggttttcttctctgattgttgcgatttcttttcggatttcgcggattgatccgttttttctgaatgtgttccggaattgccgatctgcgccgttttcgcatgtccgttcagtaccgcgttgaccagcacggcatgcacgctgcacgacgtacatgacacgatgacgcataatgcaagaatccaagccacgacgcttctgcggatgcggaacgcttccgtccgttcccggcggctcatggtggcggccgctttcggatcgagcgcacgcagaatggtacgaattcgcttcaatccggcctccttataaccctgccgtcacgcaggtggcagcatatctcttccgcggcaacactaccagccaacagtaggcatgcaaaaagcccgcttcccccgtaccggaaattttccgaggaaaacaggctttatgcaacagttctcatatatcaaacgcaacttatgcgacggtcaggcaaacaagtcacgaatgattgaatgcgatcaggcgaacaacttgaacacgaacgcacccacgatagcgcccagaatcggggcgacaaccggaatccaagcctcgccccagcgggaggagcccttggacgggatcggcaggatggcgtgcagcagtcgcggcatgagatcacgggccgggttcaggccaggaccggtcgggccgcccatggaagtcacgagaccccacacaatgaagccgaccacgatggaagcggcagcgtggtccgcttcgccccacggcatggacaggcagcacagggcgccgaacacgagcacgagggtgccgaagaactcgttgacgaagtagttgatgcggtcgttgtgggcgtcggtggtgcagaaggtgccgaggatggcgttggcgttttcggtgtccttatagtgcgggtagtaggtgatgtacaccacgagctgacctgcggcggcaccaagcagctgggcgatgatgtacggcagcacgaggctccagtcgaacaggccgttcacagcctgggcgatggtcatggccgggttgatgtgcgcgccggagacggcaccgaacatgagcaccgggatcatcacgccgaagccgtagcccatggcgatgttcagccagcccgcatggtggcccttggtgttcttcagttcaacgttcgcgacagcgccgttgccgaagatcatcagaatggcggtaccgaagaattcggccgcaagtttgacaaaagtcgagtattccactgctgtttcctctattgcttcttctcaataagaatcagattgatgtcgattccgctctcggcggacaacagcgtccaacactactccccgcactggaagtcagtatgccactaggtatgacgtcatagcgctggtttcatatgttggatattgcactcgtagtttgattcggcaaaccgcggtttcgccagttccaccattatcgtcagacctgccgccttggcagagaatccccatgtgccaatgagattgcctttcgcagccttcttcggtgtggtcagcgtggccacaaccatggtgctggctttatctatagatgatgaatccactccgaagaactctgcaataccgatgtcttcgccatccctgtagaaatgaagattagagatgtcgtactgcgcgttggagcctgtcgacctgcccttgccaagagtgcccacgatcttgtcttctgcaatcagagtaatacgtcattattctcagacaaagaagcaaatcgatgatcggaccgcacgtgggcctttgagcatatcggaaccaaagttattgtctataccctcggaagttattaccagggtggacgcgccgggggattgaacctggaacgcgtgtcttcatggagtgatgaggcgtcggccggcatgcgggagccatagtgagtccgtcgcgggaagccagtagggccggtgcgtaagtccatccacgggaattcatcgcaaagccatttccttagcatcccatttcctccacccgctggacgttttgcccgctggaaggcttgctttccgggtaaattcccccagtcactggaggaatcaggactccgaagcgtgcgccagcgggtagatttccccaccggctggaagaatcaggacgctgagacgccagtcgatgggtggattcctccaccgactggacgttttgcccgctggaaggcttgctttccgggtagattcccccagtcactggaggaatcaagatgctgaagcgtgcgccagcgggaagcttcccccaccgactggatgtttcgcccgctgaaaggcccacttccgggaagatccctccaccgattggatgttttcggactctgggatgcttacaaacgggaagattcctccactgactggaggaatcaggacgctggagaaccttgccgatagtacggatgcggagtacgaggaggataggcccgagaaacagtttctacgcaaactgcagtggatgtgggagtagacatgcgagcatcagaaaacaaaaaaaccttggaaccggagttccaaggttttgtctgtgccccctcagggattcgaaccctggacacgctgattaagagtcagctgctctaaccaactgagctaaaggggcgttggtcttgcgaggttttgttctcgctgagcacgagaagtaaatatactcagaatcaagaagaacgcaactctcggcgtgtcgcgattgtagaaccgctatttttcaacgatttcagcatattgcataaattacagaaaaatgcgatccagccatcatgttccctatctaaacagcacagccaaggcaggaaatcacaatttcttcacaactgtcgttccgcgtaatccaatcgccccaaacacttccgccaattcatttcgctaatttatttgcacggccatgcaatcattctccccgaatccattgtccgaacaccatgcacgcgcatcagccaccgaaccgaactcctccccggaaagaagcacgtaataatcggcctcatgcccataccgcgtgtagtagctgtagtccgcggcccacgccaacaccgccttcggccatgaagcgcgcaatgtaagatactgcgcgtaaatatcgcggtattgctgggttttgccgtcgacttccataccgtatttacgactgaacagctgcgttgtcggaatgtcgtacagtccggaaaccgccgaccggtcatgagacagctgccagctcaacgccagctgcgcatagcgttccgcatcggagtcggcaatgttcgcaccaccccttgcgtctcccacactcgcaaccgcattaccgttcggcgtcgcacccttctgcaccaccatgctggtcgacttggtttcgatctggtcggacgcacgccagtactgccctatcgcgtacgccagctcgagcgtcgctgtgccgcttgtgaactgcatcggatcggatgcgaagtcgtacaccgcgggcgcgatcacctcattgctggaatccttgatggagattgtgacgtcctcgcctttccacgcggtgtcaccgcaggcgtgtgcagagaacgcgacggtcgcaatcatcgtggttccatttttctcgacactctccaagcccgcgtcgggcgttgtcgcgcaatccttggtttgcttggccgcatcgttctgcttggttttgttggattgctcatccgcgttttgcgccgtcgaagaaccgttttgcgccgaatcgtcaccgctattacgattggttgatttccatacaacaaatcccgcgattaacgctatcaccgcaataattacaataattgcgatgatgattggcttcttgcggttcttgcaatcattggcttgcggatcagattgcgttccggactgcatgtctagctgcaggcttgatggcgcgggcatgggaaccggaggatatgcggccgttgccggcggaacatcgatttgagtggtctcagccggctgagcaccttgtgtccccaacggaaaaccgcaggaaccacagaatcgcatatctgcggtgacggcgacgccgcactgcggacacacggaaggaattcccgcagccgcatggccatcctgcaattgcgcggcgccgcgtttggcgcttatatgctggcgcgtaagtccgcactgcgtttcaagtggaccggtgcgatcagttccgctatcgtcggtgtgctttccggtttggtggttgttattctcgccgccattttccctgcgaaaatcggaggatcgtacgcatattactccgcgtccgcatcgctttccggagcatcgttccgcacgttcttcatggcgttcctgctggctggactcggcgcattggccggctacgctctggcgcaatttgctcccgattccaataacatgttctccgccacttggcgttgggctcatcgcacgcgcggtttcgtacgcacgcttgttgaatctgctgcgatttacggcgtattgttcctggcgctcggtctcgttgcactgattgtggcgacggccgcttccggaagcgcactggccggcatactgctgattccgctgctattgcctgccgtaccgttcgtactgttttccgtatcttcgttcggtggtgtcacggcttcggtttccggtcaatcctcctacacgctttccctgttcaatgtcgccagcgtcacccaatacgcttgggcactgtggatttgctttgtgcttttcatcattgcaacgatttacattgcgcttcgtgagacggcccgcaacatgtatgacccgtattatgcgaagtgggagaacacatggaaggctcctgtcgccgtgatggtgttctggcttgtcgcggaattcctgtgcacgaatttccttgccggatacagctcgaatacggtttcgacgatggtgccaatgtggtatttcatcgtcgccggcgtctgggctttcctcgttgaagtgattgcgatgacgtttggtccgacgttggttgcgtcgacgccgggattgtggaagattcttgttggcggtaccgtacagcagactccgcagaacgtcgtcgattacgtcaaggcttgcgatccgcatttcggccaaccgaaggcagccaggaccgcagcttccgcgcagaccacgcagaccgcgcaatacaacgcgcaatacaacgcgcagtacgccaatccgtccgcgccagcaacgtcaccagccgcgcagaccgctcctacgcaagcgatgcccgctgttccaatgccaaccacgccaatcccagcgccagccgcttcggttccaccagtaccgcagtcaacggcttcggttcctcccatgccacaatctccggccgacattccgatgccggccgttccacagggtgaaggaaagccactcgacccaaaaactaagaagacgatcctgatcggctgcatcgtcgccggtgcactgatcgtattgggcattgtctatggtgtgctcaattcgaccgtcttcagcgcgaaatccatggcggaaagctatgtgtcggcaatcgccagcggcgattacgacaaggctaacgacattgccgatcctcaagtgggtaaaaaccaacgcaagctgctttccaacagcgtcgccaagaccgataacgcgaccatttcgaatgcgcatgtcaatggcgtgaaatccggcaatggcacaaccaccgcatcaatcagctactcgttgaacggcgaaaccgtcgatgaggaactcacgatgcgcaaatccggcaacaaattcctgattttcccgaactggcaaatcaccacgccactgatcaagtccatcaatgtttccgtgccaagcagtgtggaatcgttgacggtcaacaaggttgcggtcacagccaaaaacgcggagaagacggattccggcgaatggcagttgcgcgtatacccaggcacgtacaacatttccgttacgagcacggattatatcgtcagcgaaacggtggtattccgcacgaacgaagacagtgattcgccgaccacgctgaaggtgacgaccaccagcaagttcaaggatgcattaagcaccgccgtgaacaacgcgctcgacaagtgcgcggaatccaccgactatgcgccggaaaactgcccgttcggcttccgcgtatgggatgaggataattaccgtaatttcgcgtggtcgatcagcatctatccgaaaatcgacgaagtcgaccttgattatggcgcttttgatactaaaaccggtaaggcaaagtgcacatacgaggtgaaagacggcgattcttgggattcggatgatgatagtacgacgttcaatgcgagcggatcgttcgctatcaaggatggtaaggtcacggtcacgcttgatgacggtggctacagctattaaatgaagtatgaaaatccccctgcatagctgttttcagctggtgcagggggattttccatgcttaagctcagacgtatctcagtctgaagtcattcgccgtaaccgcaatgaatgcagccatagcgaatggggccgaatcactcagcgacaaccttcacggtgaaggaagcggagatttccgggtgcagagcgacggttgcagcgaactcgccggtggtcttgatcggatccacggtgatgttcttcgggttgacggcagccttggaagacagcgcgatggcgatcttgtcggcggagatgccaccgaacagcttgccggactcggagaccttggcggcgatttcgacgacggaaccctcgatgagttccttggcggcaacagcctcttcgcgggtggcaacggccttggccagacgagcgcgcttcatggcctcgatctgggcggcagcgttcttggaccatgcgaagcccagaccctgcggaatcaggtagttgcgagcgtagccggccttgacggacacgacgtcgcccgggtgacccaggtgattgacggacttggtgagaataaccttagtttcagccatttttcaaacctctctaagatcagcgaccggaagtggcgtacggcagcagagccatctcgcgggcgttcttgatagccttggcgagctcgcgctgttcctgcacggaaacaccggtgatacgacgggaacgaatcttgccgcgatcggagatgaacttgcgcagcagggcaacgtccttgtaatcgatctcggtgaccttagcggccttcagtggattcggcttcttcttaaacggcttgaccggcggctgcggcctcttgcgtgacatcttgatgttctccttacaatctggaaattgcttttcttttaagctgcgatccgggtcggatcagaattccggttcgtcgctgcttccaccaaattcggaggagccaaaggaaccgaacgatgaggaaccggaattatccgaattgccccacggatccgatgccggagcaggctgcacggcgggcgcggcattggctggagcggtagccccaccctgatagccagcgccaccggaatacccggcaccgccctgatatccaccggcattgccggcgaagccaccgttgttgaacccgccgttgccgccagcgaaagcattgccgccacgattgccggcaaaattaccaccgttggcactggaggttcgggtgacctgggcggtcgcatagcgcagggacggaccgatctcatcgacctgaagctcaataaccgtgcgctgggaaccatcgttcgcctgataggaacgctgctgcaaacgaccctgcgcgatcacacgcatgcccttgctcaggctctgcgcgcaatgctcggccatgtcgcgccacgcggagcagcgcatgaacaaagcctgaccatcttcaaactggcccgtattacggttccaggtgcgcggagtggaggcaatggtgaagctggccacggacgagccgttgccaaccgtacggatttcgggatcagccgtgaggttacccaccacagtgataatcgtttcgcctgccatcgttacctacttactttgcagcttattgttttgcagcttgaaaagcttggaattacttacttgcgaagaatcttcgtacggatgacggattcgttcaggttcagcagacgatcgagttcgtcgctggtggccggctcagcggagtagttgaccacaacgtaattgccttcggtcttgccagcgatctcgtaggcaagcttgcgacggccccagatgtcgatgttctcgacagcaccgccttccttggtgacagtttccagatactgctcggtcagcttcttcagaccgcgctcatccagctcaggatcggcaatgaacatcagttcgtacttatgcgcagacatcacccacctccttcggactatcggccatggaccttccatggcaggagtgtgtatgcgtactgccttcacgcatctatatatgaaaggtataaagatacagttcagacaacctgttcagcatagcccttctgctggacgagcggcaattgcgcacgttctgtggtgcaggcgcgtcatgggcacccgcattgttatattgaatacggctatttttgtacggttggtaccgtatttacgcgactctagatttgtggaaggcgaagcatgtcggcgattctcgaaggcaccccggataagaaattggctttggtgacgggtcgtgcgtaccctgagcaggcccatgaaaccgcgaaatacctgggaatcgacgtacttgagaccacggcttacgatttcgccaacggcgagatgtatgtgcgttacaccgagccggtgcgtggcgccgatgcgttcgtgatgcaggcgcacaccgagccgatcaacaagtggattatggagcagctcattatggttgacgccatgaagcgcgcttccgcccgttccattaccgtggtcgcgccgttccttggctattcgcgccaggataagaagcatcagggccgcgagcccatcaccgcccgactgattttcgacctgttccgcgcagccggcgccgaccgtattatgacggtcgatctgcatgccgcccaggagcagggtttcttcgatgggccggtcgaccatctcaccgccactccggtgctgcttgactacgtgcgcaacaacatgccgcttgagaacaccaccatcgtgtctccggatgccggccgcatcaaggtttccgaacagtgggccgcgaagctgggcaatctgccgctcgcgttcattcacaagacccgtgacaccacccgcccgaaccatgccgaagcgcatggcattatcggcgaggtcgaaggtcacgactgcgtggtggtcgacgacatgatcgacaccgcgggcaccatctgcgaggccgtgcgcacactgaacaacgctggtgcgaagtccgtgacgctggttgccacgcatggcctgctgtccggcccggccgtggaacgcctgagaaattgcggtgccaaggaaatcgtgctcaccgacaccgtgcccgttccggaagagaagcgcttgccgaacatgaccgtgctgtccgtggctccgctgttggccgccggcatccgttccgtgttcgaatccggatccgtttccacgctgctcaacggtctgcccgaagacatgcgtccccgcaatatctacgcctgattcgcgcaatcttttcaacgtaacaaaaactcgcccccatccggtcggcgagttttttaatgtcagatcttcccaaaaacggggtgccgcatcctacgtcggtaggatgcggcaccccgcgtatcaagagagaaaagagaaatctggctagcgtccgataggcatcctcgctcccgttatttggcgaatgcttcgcggatttgcgcggcattgccgtaggaggcctgcgcaccataccctgtggcggcgtatgccgaaacatacgaggcaagctcggccgcttcggaaagcgccatgcccgaggcaagaccggctagcaccgtgcccatgaaggagtcgccgcagccggtggtgtccaccgcgttcacacgcacgggggcaatgcgctggatcggcgttgccgaagtggaatccaataccacggaaccatcgccgccgagcgtcacgatcgcctgttcgaaaccgaatccacgcattgcttccagcgcatgattccaatcgaaaccgtcccaatcgtcgttttccggctcgtcaatgccgagcagctgcaccatctcatgctcgttgacgagcagaatatcggatgcttccaccagttcggccggcagcgacggggtgaacggcgaatcgttgagcagcactttcacgcccgcttcatggcacatgcgcgcggcggccgtcaccgtttcgatcgggctttccaagcacaggccaagtacggaagaccgtgccagcgcatcgcgcacggattccacataatccacggtgacctgcgcgttggatcccggcgagtacacgatggtgttttcgccggttgcgtccacggtaatcacggttgtgccggatggtccgagcacgcggcgaacatgcgtggtgttcacgcccgcctcgcccagagcgccgagtaggaagtcggcgttggaatcggagccgaccgcgccgaacatctgcacggttgcgccgatgcgcgctgcggcggccgcctggttgccggattttccgcccggcagcagctgcagcggaccgccggtgatggtctcccccggccctggcagacgctgtgcggtgacggtgtagtccgcgttcatcgagccgattacggacactgtgccgtggatgcggtccaatgcggagagaacttcagtcgcgctcatctttaccttccttacatcaaaagaagatttatgaaaatggagatttgcgaaatagtgttgttcagtaatcgcaattatcgcaaatccccatttttattatattgaggatgtaatgtgcgattactttgccgattcctcggtttccagcgcatggttgccttcgtagatcttcttcttgaagacgaagaacacgatcaggccaagcagtgcggtaccggcggcgaccagcagcaggttggcatagttggcggcagtgccggttgcgccggtgatggagccgcctgcgagggcgttggagccgagcaggctgccgatgatggcgatgccgatggacggggaaacgttcatggccagatcgttcatgccgacgccacggccggattcgtccttttcaatggtgcccagcacggtggagaccaccggggagtacatgaggccgcagcctgcgtagaacacacatgcgcacagggtcagcaccacgaaaccggagttcacgcagaatgccgcaccggtccaaccgaggaacatgagggtgcctgcggtcacgatgccggccttgattccgatcttgcggatgatcatgccggagcaggtgcccaccacggcggcgaccacgaaggcccacacaatgtgcagggagacctgggtggtggtcatgccgtagatgttggtgccgatggcgttgaagatcgggctcagtgcgtagttcacgaagtagaacacgagaatcaggcagatggcgcgcagccagcgggtgttcttgaagaacgccggggtgatgaacgggttggaggccttgttgatgtagaaggcgaatgccacgaacagcagcagggagaccacgagcatccaccatgccatgtacgagaagaacagggtgaggaatgcggtggcgaagccgaagatcacgaagccgaatgcgtcaaccttctggccgttgccgctcttggacggcagggtcttgagcaggatcggcaggaacaggatggtgacggacgggatcaggaacaggaactgccatgcgatggagctgagcatgccggctgcgaacacgccgatggatgcggaaagctggtatgcggcggtgaacagaccgaagaagatgaccttcaaatcgttacgcaggtacttggtggccaccaccaggaaggcggaacctgccacctgttcgcctgcggtctgcagcacgcgtgcgatgatcacggtccacaggtttgcggcaaagaagtagtttgccacgaaaccgaagatggagccgacgaacagcgtcacgagaccgacggtcacaagcttacgcagggagacgaaatcgcccagggaaccgtagatgaagcacacgatgccgagcacgatgctcggaaatgcggtgatcagggacgcctggttcggtgcgccgacgtcggcgccgacctgctggaacaccaggttgaagccctgcaggcacagggtgccgagcacgaaggtgatcagcagcgggatcagggcgcggatggccatcttgttgctggtcaccggatcatcgaacggatcggcggatgcggtgccggtcacggcggttgtgttgttagacataataaaaatccttgattctctcgaattgcgcgatatgcgatacgcgattgcttggccggttacgcttattcagccttggctgcgaggccggagatgcgggtcatgaattcgttcaggaagcgcggcacgtcgacgccgacggcaaccttcatggtcttggccgggtcattcaggcgggtttcgtcgccgatggtgcgtccgcgggtcgggccttccacgtcgaccttcatattgatgtcgagggtggtgacgagggtcgggtccactgccacgccaacggcgagcggatcgtgcaggccgcagccgcccagatgcggggacgtggtttcgtaagccttgatgtagaagtcggtcatgtcggccaggaacttgccggccttggtgccgaggtcgcgccactgctgggtttccttgtaggtgagcagggtctgcagggttacgtcgagaccgatcatggtggtcggcgccccggaacggaacaggtagtcggcggcttccggatcctgcgaaatgttggcttccatgcaggcgttgcagttgccgggtacggtcagtgcgccgcccataagcacgatttggccgatttcatccttgatttccggtgctttcttcagtgcggcttcgatgttggtcatcgggccggtcggcacgtagacgagatccttgccataggtcttcactgcgtcgatgatgaagtcgaccgcagattcggtttcgacggaacggctggaatcggggatttccacgtcgccgatgccgttgtcgccgtggatgaacgcggagattggcagtacttcgaagtgatcggtggtgctggagtgcggcaaaccctgatacaccttgacttccgggtggccgagcaggtcggtcacggccagtgcgttgcgcacaccctgctcgacgagcacgttgccgtaggtgccggtgatgccgatcagctcgacttccgggcttcccagagcatacgaaatggcaagcgcgtcatcaacgccggtatcaagatcaagaatcatctttttcatgtgtgtgcctttcctctttgacggcctgacgacggtccgccaccatacgggtgcgtcgtcagttatacatcgagcgcattctcgattgtgttgtgttgacaagatttatgataaagcgttttatcaagaacgcaaattcttcacctatacacggcgtgttgcctgtattcccaacgattacagcatattggagatgcttacgtcaccacataccgagattgatctgcaccacccgttttgcaccagtctgcagcatctaaaaatggcggtttacgcgcaggccgcctgcaccagtttcggcgtaagcacttcaacctgcggatcggaaagccacggacgggcatcccctgattccgtaccggacttggcacgaaccgcaacatcaatccgcttacgcaacataccccaacaagcggcggccaaatcagtcacgctctgctcaacggtggtcatacgccaaccaagaccgaatcgtttgagaatattgtcgtaaccaatcacctgcatatcctcagtaacatgcaacccacgctccgccatacgctgacggaagccaagcgccatcacatcgttgcagcagaacacggccgtcgccccgccatcgatgatctgattcgcggcacgatagccgctatcgaaacggtaatcaccctcaacacacagcgaagaatcaaaatgcttccccgactgctcgatggcatccacaaaaccacgacgacgctccgcggcactcgactccgcaatatcgccggtgacaatgccaatacgagtatgaccaccttccaacagatactgggcagccaaacgaccaccaagatagttgtcaaaaccgacggcatcgcaccagccgcactgcgtcaaacggtcgatcagcaccaccgggcacgacacaagcgccacatcctcacacagctgctcaacagcactcccaacacacgactcacgcgccgggatcaacatcaccccatccaccccacgggcaggaagacgctgtaacaactcatgctccgcagcacgcgaatcatcggaattggccacaatcagcgaatacccctgcgcggcgcactcatcctccacacacttggcaagcgccgcgaaaaacaagttctcaatatcaggcacgatcagcgcaaccagctgggactgcttggtcaccaagctacgcgcgctctgattcggcacataattcagcttcttcgccgcgtcggcaatggccttacgcttctcctcagacacgcgagccggccgattattcaacaccagcgaaaccgtcgtcacagacacccccgcagcagcggccacatccttcaacgtcgcacgatacgccattcaaaccccttaaaacgtttctccttccagcataaatgccacgcactcctgacgcgcccagcacccccatccacaaacaaattcctttcatagcaaaataatccacattatttccagtggtaaatcgtttctcagaaatgtttttgtatactcgcaacgttttgcttaatacgaaagccacagagaagagaggaaccccaatgcaaccaacagcacagaaaaacaatgcgaaacagcgcaagaccatcgccatcgtcgccgtgatagcagtggttgccatcgcgctcgcagccgttgccatcatcgcagtcgccaataagcgcgaaatgacgcaagccgccagcgacacctgcacgttgaacgcgaaggcgctcgccacgcatcagcaaaacttcgaagaggctcagaaagaagccgaagatgcggcaaaactcaccgtggacgacgtggccgacggcaccacgctggaaaccctgaaggatgcgatcacgctggccgaagccgtggaaaacgcgccaacatgccccgcgaacggcaatgccagcgacttcaccaaggcgacagacgatattcgcacgtacgccgacaacctgcgcaacatcaccaacgaactcgacgcggccgccaagtcggtgatcgccagccaggaactcaaactcgagtccgccaagtaagccgtccgagccagacgagccgacagggcgccgcccccagctccgccacccctgcgttcaacggggccaagttgcgttttcaaacaactttgacctcgttaaagatgactttcgcaacgttttcacaacccgataaccgcccataccgcaaatcgatacccccttccgcaaaaacccgaaagagcttattaacggggtcaaagttacgttttggacgacttcacccccgcacaagcgctttcgcaccgtatctggcttatatatggcagattcgacagtccgaccggaggcatttcctgacgaagtcagctacttgcaacacgttatttcccaatcgccacttgccgaacccaattaccaagctgcgtcgcatccaccatgacgcaccgtcacaaacgttcccgtccgacgcgctttactggccttgggcgcggtagcgggcttcggtggcggctttggcgggctcccaccaggcgcggttggcagcataccaagcgatggtcgcttgcaaaccggcttcgaaatcggtgcgcacaggcttccatccaagttcggtacgcagcttgctggagtcaatcgcgtaacgccgatcatgcccggggcggtcacgcacccagtcgaacgcatcttcggcacatcccataagccgcaggatcatacgcatcacggcaatgttgctcatttcaccatccgcgccgatcaggtatgtttcgccgatccgcccgcgtgtaagaatcttccacaccgcagaagagtggtcttccgtatggatccagtcgcgcacgttctcgcctgtgccatatagtttcggacgcacgccctccatgatggaagtgatctggcgtggaatgaatttttccacatgctggtacgacccgtaattgttggaacagttggaaatcgtggcgcgaagcccgtacgtgcgaacccaggcacgcaccagctggtcggatgccgcttttgacgcgctgtacggacttgacggcttatatggcgtgctttcggtgaatttgcatggatcgtcgagcgcaaggtcgccgtacacttcgtcggtgctgatgtgatggaatcgcacgtcatgcttgcgcgccgcctcaagcaggtggaacgtaccctccacattcgttgtgatgaagggttcaggattggcgatggagttgtcgttatgcgattcggccgcgaaatgcacgatcgcgtcatgcccgggcacgatacgttccagtagtgcagcatcgcaaatgtcaccttgcacgagttcgacttgcgattgcggaagaccggcgatattctgcggatttccggcatacgtcagcttgtcgagcacggttatgcgcacgtcaggatggttgtgtgccacgtagcgcacgaaattggctccgataaacccacatccgccggtcacaatgatgttgcgcggcttgaaaatctcactactcaccatttcagggtaccggcagggttgcatcatggagcgctcgtgggcgatgtctcgaatcactaattcacgtaacccgcgcaagccgaaaagttcaatggttgcacggcttcccccgtggcggatgcgatatctatgacagattcagcaggtttttcgcactccaaaccttgatttggtgtatgaacggcacctcagttacccttgatttggtgtatgagagcgcctttcgcaacccttgatttggtgtaaagaccgcataatcattggcttttcaagcagagacccattgaactcaaacgagcaccctaaatttaggtcctggcagaagagaacttctggattacatggcaagattcgggctctaggccaagtatgagtcaggtcccgcttccgcctccagtgaagccgactcgcttgcagcgtgacatcttcaaaagcgacgcttaccgaatctcagttgtcagactgcgtcacatcgccatggcgaactgtcataagcgttcccgtccgacgcacttcacaaattcgtcttcctgaggcttggaacccttatagtcagcaaacaacacttcaaaatccggaacagcaatggtcttcatacgagcacaagttggaacggcatgttcagcagcaatatgtccagaagtcggaatagtgcgttcatggtctgtcatggcaaccacgttacatctcacgtcaacggtctaactgcgccaagccacgcaccgaatccgccgcccgccttctcgtcgccccatacaagccacgctttcggcgcattatcagctggtggcatccaacacttgcgcgcgcatatagtcgtccaccttgaacaccaaatccgtctgtcgactgtcgctcgcagcaaattgagtaaaaagatccacatatcgagcctctcccccagtctgcaaatcaaccaattcctgcgctacgacccttcagatttcgcatacattttgttgccctttcccacttacgttgtaggcagataccccacgtagcacagttaaccttccagctacctttcagacatctacgagatacccgttcgtccacagctgaacactaaaatgtatccggtttaattgtacagagcccctaattataaggggctatcttgttgaaggatgcgacgatgcctattttttcgcctgaccgtcatgcttgtgcaccttcatacgtaaaacttactaagcagccgattgcgggtggaacatatcgccctcttgcgaatgacgaagacagcaacgcttgcgccccatccgccctttcaggtcaccatagttcaaaactgtatacgcagaaatcagcaattcacgccatctccgataacacaagcatctttatttcaggcgctggcaccctgccctgtttaccggagatggcttccagtggatccgtcagtaaagccgaaatagacaataacgaacaaatcgcttcttctgagctccagccccatcaacccgctgagcagcctttgaatcaggtcgtctcggtttgcaaacgagccgcacatactacggcaaaaacgctttccaccgcagggcacacggctgtaaaagcaaccaaagttaccggtcacgccatccacaccgctgccacagcagtaaaaaacgcatggcatacttttattaatttcaaagccgttcaactcatcatcaaattcttcaaaaaggcgtatggcctctggaagaaacgtcatcgcttctcattctcgttctacgccattgttctcgtattagtcaccgcttttgaggtcgtttttcttcagtggggcatgtacagcgagccggaatatcctgaaggctcggaaattgacgatacgaccagagttttgcaaagtgttattgggcgcacgacaaaattcgttagccagatctggattgaccatcaataccaagcattactgaatttcatagttttgggtgttatttaccttactctggtgctgattctcaatcgtttctgggttgcttcagccatctttggcacagttatgacagtatttgctgtcgccaatcacatcaagatcgagtcccgcaacgaacctgttattcccgccgatttgaacttcatcacaggaggcaatgcgggagaactcacttcctttattccaaattccagtcaggctctagttgacggtgcggtagctggcgttatttgctttgtggccatctgcatcgtcatgcaattccttgatggcagaaatgcagtcatcccctgccactggctacacccgtttgccagcgttaaaaattttgccggcacgattacgcgcattttggcagccgctctcagtactgcactcgtattttccttcgtgtggggactcggagcagacgattcctgggctacaaaatttgcccacaatctttccgaccgcccccagccttggaatccaattgctgacgctaccagcaatggtcccgccatcaatttcctccagcttgcacataccaagatcatggataagcccgaagattattccgaagaaaccatgaccaagattacaaagaaatactccaaggaggctgattccatcaatcagtccagaacaaccaatctgactgataacaccgtaatcatggtgctttcggaaaccttctcggatcccacacgagtaccgggcgtaagtttcgccgaagatccgatgccaaatattcgacagatcaagcgcgaaacaacatccggtcttatgctttcccccggctatggtggcggtactgccaacatcgagtatcaagctctcacgggtctttccatggcgaattacagcgataccctatctatcgcctatcagcaattagttccgggacaaaagtgggatcagtccctcaatcagctatggaatgaaaagaatggcgaggactcttctgtagcctttcacgcatacaaccgtggaatgtatttccgcgatatcaactataagaagttcggattctctaaattctacgccacggacggaacacccaagctcacagatcttcatcctatagattcggcttggtattcttccgatgaatcgttctatagccaggtgttgaaacaggtgcagtcctctgactccaacaagttctatcaggttgtgactatacagaatcacatgccttatgaggaggatttatacacagataatcagttcaaagaacttgatacttccgaaaatcttcaggagaatgaacgactcaatattgagacttacactaagggtcttaattacacagatcaatcaacgttagatttccttaatcagctcaatgacatcaatcgtcctatcactgttattttctacggggaccacttacccggcatctatagcactgcctactccgattcagacaatattcttggtcttcacgaaaccgattacttcatttggtccaataatgcgtcttctgctgctggaaccaaacttgatgacgcgtcctccgcatacacctcatccaactatttctccactcaacttgcttcacatctcaacgcaaaggtgagcccttatctggcattcctgacggaaatgcatcaagccatatctgctatgtctgttccttcagcagcgggaggcagctctgaagaaccggtatatctcaacgctgctggggctcgtatgagtaagaaggatctttccgaagaggctaaaacactactccatgattacaaactcattcaatacgatatgagtgccggtaagaattaccttaaagacactaatttcgtagagcttcagtagattcgtgttcctcatcaccgccagtttctacaatagtgctagtttgtcgagaataacgaaagccggtaactatgaaaattgcagttgcaggaactggatatgtaggtctttctgtcgctttgctgcttgctcagcataatgaggttcatgctttggacattgttccggagaaagttgagcttctaaacaacggtaagagtccgattgtggatgctgtgattactgattttctggagaagaacacctccggcgagcgtcctctggacttccatgcaaccgttgacccagaagaagcatattccgatgctgatttcgcagtgattgcaacgcctacgaactatgacgagaaaaagaattattttgatacttccagcgtcgaagctgcgatttccgcagtacgaaagtatgcgccggaagcgtggatcattattaaatctacgattcctgtcggatacacgcagcagctacgcgaccgtttgaacgatgatcatattctgttttctccggaattccttcgtgaaggtcacgctctgtttgacaacttgcaccccagccgtattgttgtcggtgctccgcaggatgacgcacgttccgtagaggccgcacgtacttttgtggatcttctggctcagggagcagcccccgaagaacgctctcgagtcaatcatgatggcagtacaggcattccagaactggtggtgggcactaccgaggccgaagccatcaaactgtttgccaacacgtatcttgcgttgcgtgtggcttatttcaatgagcttgacacttatgctgaaagccgcggactgagcactcgcgaaatcattgacggcgtttgccttgatccgcgcatcggcgacggttacaacaatccaagcttcggatatggcggctactgcctgccaaaggacaccaagcagctactcgccaattacgatcaggttccacagaatctaatcgaggcgattgtggatgctaaccgcacccgcaaggaattcgttgcttctgaagtgatggatcgcatcaaagatgtgaaagatccgattgtcggtatctaccgcctgaccatgaaatccggttctgacaacttccgccagtccgcgattcaggatgttatgaagcagttcaaggcaaacggcatcctcgtactgatttacgagccgacgctagatgccactgacttcttcggcagcgaagtaacgcacgattttaattcgttcacggaacggtctaccgtcatcgttgccaatcgctggaatgatgaccttaacaaggtatctggcaaggttttcactcgcgatttgttccgtagagactgacaattcttttaaagccctaatgaatttctagggcacaactaggaggggcgtctggtgcttgtatgaaccgcaccccgattgttggactgaggaaattcagattcgatgatcggaggtgcggttcatactcagcataacggctcctcggtaatcttctctcatgcgatagtgagacactattgttccactactccatctcctaccgtatcccctttccttcatatgcgacaagataaatgcggttttgaaaggacaaatgtcaaaaatgctgcatccgcaggcagattaaagcaattcggcaaaaacaccaatccaccaaatgatgtgacggcataagccaacacacccatccgaatctacaccctacttaaaataagggggtaaacactttgatgaactagctaaaggagcacatcatgagagaaaagaagaagcctaagaagcggatattatgcgcgataatatcatgttctttgttggcaagcataggtttcgcgcaaccggcgagcgcagctgacaccgcagtagacacgcccgcagtccaagacgacatcgagacaatgtcttattcagatggcacgtcgaccggtacttcagagcttaccggagtgtcactgggaacaggaacaaccgtatacgcgaaacaattcatcaaccaagtggacgtctacaactcggcactgaatgaagtcgtgaaatggcgtcgagacgcgctcaacgacaaacaagtaactttcggcgtctacaactggcagaccaagcaaaccgattactattcagtatcggattacctgaagaaacttggaatctccgaaaacgaatatctaacgccaaaatggtctaatgcgttggaacgaatcgcaattcaacgagcgattgaggcatattctgcagaggatgcgcatactcgacctaatggagagagctgcttccgagccagctataacaaaatccaatcagaggcagaaatactcgcatggggtcctgccaacatatccggcgcaattgatttatgggccgaagaaaagaaagactacgtccaaaacacaggagctgaagtcgggcattatcttactttgatcaatccaaactatgagtattatggtttcgctgcaggagatggacagtattacagaacaactttttctggagaggcaggaactcgcagcagtgccgctgaatactcggattcaactccgacgaacatgcgaggcctagggcaattcgaagtcaacgtggatgacgatgatttacgagaaggggctacttggaacctgtcatcgatgaagtctggatccacgcaaaccgcaaaagtaacgctgaagcacaggtccggaagatatgagttcaggggcacatggggatcttccaatgcgaatgtgattagcgccaaccaaagtggcgtatataccgcggggaaggtaggaactgcgaaagcaaccgtttcttctgggtctttcgctttttccacggatgtcacggtcatgcctctcactttgaaatatgacggcaatggagcgacctctggctatgtagcttcacagacaggatcccacaatgatgagatcacagtggcgaagaatggtttcagccgatcaggctacactttctcgagctggaacaccaaagctgatggtaccggcacttcatatgcacctggatccaaaataacccttcccgctggcgataccatcttgtacgcacaatgggttgagaatccaaaactgacgagacttgccggacagacacgctatgacactatggcaaccatcgttcaacacgaacagacaaaacaaggacaaaccgtcatcatcgcttctggagagaattatcctgatgcactctccgcgtcaggcttagccggaggattagctgcaacgattatgctcgtcggatctaactctctgcccagccaaactgctaaccgtcttgcctcacttaagccgaatcgaatcatcattatcggcggtccaagcgcaatttccaaaaatgtagaaaacgcactccatcaatacagctccacagtcaccagatattacggagaagatcgttatgaaacctctcttgcagtattcaaggcggggcagaagctgggagtagaatggaattccacagcgctaatggcaaccggagataactacgcggatgcgctctccgcgtcttccttggcttacgcgcagaagatgccgattttcctgtgcagttcagcttcaggattctcttcatcccaactggatgccatcaacaaaaccatcaaacagggtcttgtaatcggaggcaccagcgccataccaaattggattgtcaacagccagctgcagcagcagcaaggcatatcaacaaaaagaattgccggcgcaactaggtatgagaccagcattgaaatcgccaaaagcgcagagcggtatgggttgaccgctgaaggtagcgtcttcgcaaccggcgccaacttccctgatgctctggctgccggaccgcttgccggaaagaaaaacggattcctgttgctagcggatccttttggaactacagctcagtttgttcaaaaatacaagaatcaagttaaaaccgcttacgtagttggcggagaacaagctgtttcttccaccacggctaaccagatagcagatagtctcggtctgcgtcatccgtaagtttcgtagataagagaatggaatggcgggatgccagcctaggctggcatcccgccattccatttagtgagcaaacaccaccattgacttatcagatacggcttgttcctaagcagtcaatatgaagcgccttgtcattaagaagtcctgcgaaattagtagttcctggatttcgaaccgagaagtagcatgagttctcatcactcgtaaaagcaagctgctcaaacttcctcagatttgacgtatccggaatcttgcgcatggtggcgataatcttaaaatctccatcattgaatatgctcagaggcaacgcaaagtgaatcttgttatgcccggcattgctgaatttaaaagcgacaccacagtcatagggcacaccgccgcgcttgacatccaagaccgacataggaatgtagaattctccgccgtcactatcacgaagatcatattcgacatcaaattcgaacgtctcggcacaggatgaaatctgcggggaaacaggcagaattcggaaagtgggcaccttctcactcaagcctagtgaatattcatcttccggattttcttttcgctctttatgctcagacttgagattttcgagagtataacgatcggcaacatcgttcttgtcaccactggcgataatctcgccgtccttgatcaggatggccttgttgcagtacttcttgacggaatccatggaatgggtgacaagaataacggtcttcgttggatctttcttgatttcggcgaagaagttgtcgcacttacgctggaatgcttcgtcgccgacggctagaacttcatcgagaactaggatatcgccttgagccttgatagcaacggagaaggcgaggcgcacctgcatgcccgaagaataattcttgagcttctgatccatgaaatcttcaagctcggcgaactcaacgatgtcgtcatacatcgcgtcgatttcagcacgagtgaagcctagtagagcaccgttcagatacacgttctcgcggccggtcaactccggattgaatccaacaccaagctcgatgaatggcaccagcttgcctttaaccgttacggaaccatgttccggagtatagatctgagaaataatcttcaacagcgtggacttgccggaaccgttacgcccgacgataccgaagaaatcaccttgacgaacttcgaagttgatgtcacgcagaacatgctgctcggtatagcctttgatgcctttcgtccaattcagaaaggccatcttcaagccagtagcctgttctgtaggcagacggaacattttggcgacatggtcgaccctgagcactacagggcgctcgtcaacgtttccctcttcagtcattgcaacctcagtcatgatttagagcacctccgcgaacttggaactgtacttacggaacacgtgaacgcccagccacagaatgaaaactgacaacgcatacggcagcaagcaaagcaacttgttatcaaccatgctccacacagtcggcacatactccggagaaagcagattatgacgaatatccataatcacctgagtggaaggattaagcatcaaaatattggcggcccagccgtaacccttatccgcaatcatggaaattgggtagatgataggcgttgcatagaacatggcctgcaatatgacttcccaaatatgagccacgtcacggaaatacacgaacagcgaagcaagcagcaaagctacgccaagaccaaggcaatacaactgaataatgctgagcggcacaagcaatactcgccacgtgtaatgcgcatgggcgaagaaaccgaagcagatcaccacgagcaggttgatgccgagagaaatcatagaacccatagtggtggaagccacaataatgtagttcgggaaatgaaccttacgcagcaaatcaccgcggccaacaatggattgcatacccatgctagtggattcggagaagaagctccacaagcaggtaccgcacaacaacgaaatcgggaacgtcggggtgccgtcggagaacttcaagaacttcacgaacaccacatacatcacagcgaacaacataagcggcttcaacacggaccacaccatgccgaggaacgatccttggtaacgcaactggaaatcggttttcaccagttccttgaataccactatcgcgtagtggtacctctttttgaggctgtcaaaaaagttcttcacaagcgtcctatcctactagtgcgaagtatttgagcacaaaaacgtatagcgtgcccttcttcagcagtactttcatatattctattgtggaaaggacgtttgtttcagtaaggcggaatatctcacatggctctcacaggagaacatcagcatccggatatcaaaatcttcgtgtcggcacacaagcctgctgttttccctgaaggaaacagcatcctccctgtacaggttggagtggcccatgccgcaaggcggttcaacagcacgctgcatgacgatgagggtgagaatatttccgataaaaatccccgttactgcgaactgaccgcgcaatactgggcttggaaaaacgaggatgccgactactacggtttctgccactaccgacgctacttcgatttcaccgataccccgcatcaggaaaacgactatggcgaaatcatcgattcctatatcgacagtcaaaccattgaaaagtatggcatcaacgatggcgatatctccaaagcggtagatggatgggacgttatcaccacgccgcttaatgacacccgtcgtattggtgggtttacgaatctcaagcagcattgggatgcggataggcatcttcgcctcaaggatttgcgtcacatgtacgacattctgtgcgcacgtcatcctgattacaaagcggatgctgatgcggtgctgaatggccatactgcagctttctgcaacatgtttatcatgaagaaggatattttcttcgagtacaacgaatggttgttccccttgctggatgagtttgccgagcatactgatttcagcaagatggatgtgcagactactcgcaccgtggggcatctttctgaacggttgcttaatatttttcttgcacataagcagcgcactggagccaattggaaaatcaagcgactgcagtgcgtgcattttctgcatccggaaccgttcgccaagcttgaaccgttgcaggagaatcctgaaaccattgtgcctgtggtttttgcagcggacgataattacgttccaatgctcactaccacgatatattcgatgctgaagaacgcttccgaagatcgtttttacgatgtgatcgtgctggaacgaaacatttctgacgagaacaagcagattattacgaaattccttgcgcaattctcgaatgccgccgtacgtttctatgatgtgagccgatatcttgcaggattcaatctcaccaccagcaatgcgcatatcagtgtggaaacgtattatcgtttcatcattcaggaagcgttgcctttctactcaaagctgctgtacttggattgcgatcttgtagtgaatggtgatgttgccgaactgttcgatacggaaatgggcgataatgctatcgccgcagtgccggatatcgacttcatcggcaatctcaatatgaaggatggtattcgcgccgagtatgtgcgcaagcagttgcatatgcgtgacgcctatggatatttccaggctggcgtgctagttatgaatttggatcgcacgcgtaagattcatacggttcatgaatggctgcagattgcctcgaagccgggatatatctacaacgatcaggacattcttaataccgagtgcgaaggtcttgttacctacctcgactattcgtggaatgtgatgcataactgtgctggacgtgtggcgggagtattcgatttcgcacctgcagacgtgtataaggcatacatggaatcgcgcaaggcgccaaaggtcgtacattatgccggtttcgacaagccttggaagaatccttggtgcgatttcgctccactgtattggcagtacgcgcaggaaactccgttcgttgcgcaaatgtacgccgccatgtcgggagtgcagaagccggaacctccggaacatcatgatcgggccattgctgaagacagtccaatccgtaaatatgtggatgttttagcccccaccggatccaagcagcgcgaactcatgaaagtcgtagcgcgcaaggtgcgaggcaagaagtaaaacaagtagcgctaccggtcatccgcgtatgtgttggggctgtccgttcctttaaggagcgggcagccccaacgcatatctctgaatgccctcacgaagttgcttagtttgtcagagccaaaccaagactcttagaaagccggccggcagtgttccagctaaccgcattagctcctcccaaaatgtacgcttcagacacagattccgcataagaagacacatagcttcccacattggatacggttgcatcgctgttgttcaccagcaacatacagcttgcatcacgaccagccaaaggacctccagataaggcatctggatagttttgccctgtagtgaaaacaacattgttcatagtcaatgcgccctgtccgatagcccagcgagcgaaaagaatactcgtattataccgagtctgcccagcaatacgaattggtttaatacctaccgtctgctcgatttgagccgagacaaattcaggaactgcctgagcccctccaacgattacgatttgagtaaagttcccatcctttaaagcattctgctgatctgctgtaagaccagtctccgcatcagataagaacaccggtgccttctgagcatacgcataggatgtcacagatagtgcatcagcaaatccgttttgattatttcctccagtaacaacaaccgcggtttctccccatccagcggacagactcttccccgcttcataaatttgcaatgccgtatctattcgtgtggcaccctgaattcgttcaactccgtcaacgcattgctttaaagaagactccacatcagaggaaaccgctttttctccaccgacaataacgacggaagaaggcttcaagcgctttatttcattacgtacgttggcactcaacacctgtgggttcgtcagaagcacaggagcattttctatgccggcaaatccggaaacagccaaagcatcgggataattctcacccgaagtgacaataaccgtcgaagtctcctctggaaaagcagtgtcgacaacatccgtcatcgtgtcgtaccgattatttccaaacaaacgaatcatttgcccatgcgtatcgtccggagtgggatcaggattcggtaaaggcacttccggagaagcgttattcccgttgtaaaccgggatagtttgcccggacggacactgagacaataccgaccgcattgcttctttctcagcagtgtctaccgaaagaccgtagtgttcttttattccgatttgacgactcacatacgagcagtcatagctcttctgagaaggaagccagttcgctgcatctttatccgattttgacgcattcgccgctccttttacggccagcaaaacataaggatcattggcataggcaacccgctgattctttgtccaagcatcagcgccactttcatacgcctcccctacggcaacgacatgatcaatctgaaccttattagatgtactctgccctctttgaaaatagattgtttctccggtgtacgggtcatgcagtgttccagtattaacatgcttttccgacgtgaacgtgacattttccatatctctctgcaaaatatagtcacgagtagtcgcgctacctccaagctcatcattgtggagccaggttccgaataaatcctctctttccgaggaacggtaatcatctgactgcgctttgaccattaatcgttcaagagcaaccgacgcattttccccctcatcagccgcagctgggagcgctgcaatcagtaaaccgaataaaacaaaaatacaaaccataataggaatgtctcttcgtcccaagcgtctcatagaaccccctcaatctcagtcggcgacccgaatctccacattcaattcaacacctttcaaaggtataatcgctctaggcacaccgtttgaggagagaaatatgaaatcgattcataacaaagttcgaagtgtgattgccgctatcgtatgtgtattttgcactctagcgcttatccccacacataatgcatatgccagcgtcaactcattcacccgaatcgcgggcaatactcgctatgaaacgatgtctcagatcgttgaacaggcatttcctacatcgtctgagtatgcggtgcttgcggcaggaagcaacttcccagatgcacttgccgcttcttctctcgctggagcctataacgcacctataatattgacggattcctatagcctgtcaagcgaagcttccttcgagatgcaacgtctcggagttcgcaaagtctttatcattggtggacaaagcgctatttctgccgatgtggagcagtcaatccgtcagattcagtcctccatggaaattgaacgaatcgccggcagcacccgttatgacacagctctgcagatttacaacgctttgacctcctcaaatacgagaagccaagcttccaaagtagcaatcattgccacaggaaacagcttcgccgacgctctttccatatcaccttatgcatatcagacctcttcgccattcttcctcagctctccttctggtcttgacccagattcccttcagattctggaatccggcgcattcaattccgtcattatcgccggaggaacggcagccgtcccacaacatgttcagacgaatctggaagcactgggaatcaacgtaactcgcttatccggaggcactcgctatgaaacgagtaaatcaataggcgagttcgtgctcaataacctaaattctgcaccgcaagatgtggtattcgccacaggatccaacttcccagatgcccttgcaggcagcgcactatcaggatcgaaaaagactgccatgctgcttgtgcaagacagcaattctccgactattgattttgcagcgcaaaatatttcctccgcgcagaacgtctacgttctaggaggaaaaaatgcagttaactcgtccacgcttaataccattgcgcgagcatatggtttgggggatcaggaaagcgagccacaaccgccagcgccccaacctacccctcagccaaacccacaagtaggcactcatgatgctggagaattctgcaagaaagcagatgtcggcaaagttgaatatgcgaaaaacggcagactgatcgtttgcgaatatcgaaataacaataaaacaccacattggcactatgtatagcgcaatgaggcattagatgggttgggtgccgcaaggctggactttgtggcacccaatccatctaaactaatcaaagatattgatcaagctcatcatcccgaacaagctgatcaaaatcagctgtcaaggcatggcggctcttcatctcttcaagaattgccgcaagcacgatgttgttcacgccactttcagtattctggtggcacagggcttcctctccttgcgtgcccggaacataattaagcaattgatcgcctgttgcagccacaacaggcactcccgctttgacttgcatcacttttagccacaaatcatccgcagtgagacacaatttttttatatcttccgcattaaaagtttcagacggcataaggtgtggtgggtacaaggttccggcaccatttgtagcaaatactctcatcgaaggctttcctacaagatctggatgataatggggagcttcgtaaatccactgctcgtacggagtgcatgaaccttgttcatcgaacatgatgagatgggttctcacggctacgattgctttcggatgccgttcatgcatctccatcagatcaccgatcattgtattcctgtacaataaatcgtcatctgttgtaattacataatcatctttgaactcttgcaaagcccaataatatttcttatgcggtttgagatcattgttcacccaacgcacttcaacatcatgccagagaacgtctttcaacgattcgggaagatcatcttccctatttggaaaatcgctttcacatagccaaagaataattttgtccggcaatcttttttgagcaagcaacgtacgaatagcaaagtgaacagtgttaattcgtgccggatacgaagtcatggaaactatgattcgaggatgccgccggaatacacgagctagatgcgttccagcacggcgaagcttgttcttcttctcaccaacccatgtcaagtctaccattatgactgctcctcaagttcttaacaatgctctacagcaatgatacttatatacgctgcttttcagagtcaacggatacactgttaacagttgcgttagtagtttgcccaatcgagggagagttatgccgaagatctcaatcatcattcctgcatacaatgtcggcaaatacatagaggaatgcttggagtcagcacgaaatcagaccctcaaggatatcgaaatcgttgtcgtcaatgatggaagcaccgataataccggcgatgtcattgcccaggaagcttcaaaagatagccgtattcaagtggtgaccaaccaccccaatatgggcacacaccgcacccgtatggcgggagccgaagccgctaccggagagtattctttcttcctcgatggtgatgatgcgctcaagccagacatgtgcaagcaacttgttcaggagttatcattgcatcctgcagatgttcttcatttcggcatcacagtagtcggggcaaacgaacttctggattccgagcgcgaagccttcgaagccaataacaacgcgtctacgcaggatgccgtaggcgaggacataattcgcgatatcttcgacgaatctcgaggatataaagtggactggcgagtaacccagcgtctgtacaaaacgtctgtccttaagcaggcttttgcagcaatgaccaaggagcgtctcggccgttcacaagacggatatgaatgcttcgttgtttctgcctttgcaaagacatatcactcatgcaagcattgccgtggatatatttactactacggtcgcggtatcagcggaaccagcaccattagcgctgagaagtacgcgcagtattgtcatcatttcaaggccgattttgacgcagcatacgatttcgccgacactcagcactcagaaatgcttcgcgcttgcgctcagggattccaacggaaagcaacagaaatcctcgctaacgactggaaaatccgaattccggaaaacgagaagctttcagcggcacaaagcatgtctgacgtatttggaccggcaattgcaggtcgagaaatatatcgttttgtgcgggatgacgcgtatgaaaaactgtctgaaaaaacagcacttctgcctaatgacagactgaataactggtttggtattgccaattcgtttgaggttctcccatcccttgaagatactgatagccttcgtttccatgaaatgaaacgtatcgcaacatcccacatgcttgatttagtaactcaaagtgagcaaaccgaacaaatcgaacgatacaacaaccagcgcgttcgcctgttcgtcaccacgcataagaatgtgaatcgatttgagagcgatatcatgcagcctgtgcaggttggcctgcacgaaggcagctatcgtttcccctgggcgttccacgatgacgaaggcgagaatatctccgaccgtaatccgcgctattgcgagctgactacccaatactgggcttggaagaatgtggatgccgattattacggtttctgccactatcgccgctattttgatttctctgacactctccacaaagagaacccatatggcgaaatcatggatgattacatcgatgccaaagctgcgaaagagtatggacttgacgatacaaacattgagcgagtagttcgccaatacgacgtcatcaccactccattcggtgatctcacgaagattatcgacaagcatggtactcctcgcgcattgtgggaagccgctcccctgctgcacgatgatgatatgctccgctgttatcggattctatgcaagatgtatccggattacaaagaggatgccgattctttcttcacgggcaacaaggcatgcttctgcaatatgttcattatgaagaaggagatcttcttcgactattgctcttggatgttcccgattcttgaggagttcgataagaacaccagctatagtgcctacagcaaggaagcgttgcgtactccgggacacctttccgaacgcctgctgaacatctatttgatgcatcataagcgcatcggttccaattggaagttcaaggagcttcagtgtgttcactttaccaatccggaacccgctgaagagctgaagcctcttgatatgtttaacaagccgatcgttccagtcgtgtttgccgcggatgataattatgttccacagctcaccaccacggtttattcggccatgaagaatgctgatccgacatatttctatgatgttgtggttctacaacgaaacatcgcttgggataagcaggaacgactgcgtgacttcttcaagcagttcccgaacatgtcattgcgattcaccaatgtggagcgtgagctgtctggatacgatctttccacgaataatgctcatatcagcatcgaaacctactatcgattcctgatccagaagctattgccgttctacgacaaggtgctgtatttggattcggatatcgtcatcaatggcgatatttccaagttgtacaacaccgacttgcaaggcaagctgctcggtgcgattcgagatatcgacttccttgccaacctcaacgtcaagcatggcaagcgcatggggtatgccaagaatgtgctgaagatgaagaatccttacgattacttccaagctggcgttctcgtgctcaacaccaaggccatgcgcgagcgctacaccatcaagcagtggcttacgtatgcgtctaaccctgcgttcatctataacgaccaagatgtgcttaacgcacactgtgagggagaagtactgtatttgccgtgggagtggaatgtggttcacgattgcggcggacgtgtcggcaatctgtttgtgcaggctccgaacgacatttatgacgcctacatgaagtcacgcaacaatccgaagatcatccattacgctggttttcaaaaaccatggaccgatccagattgcgatttcgcctccatctattggaaatacgcacgtgaaaccccgttctatgagcgtctgctcaagcgcgtggtgaaggcgaacgaaccgaaaatccctgaagaggcgcttcgtccaaagcacgaacgcgccgttggagaggataaccctattcgcaagattgtcgatccactcatgccaataggttcccgccgtcgtgccatggcgaaggccatcggtcgcgcggttcgaggaagggaataatcgcattgaaacagaccacaaaaagttttagaattaccgaacataactttgcttatctcgtccccattcttctgggtacgttgtttggcatgtgttcttttattggccagcatgagggcaaaatcgacactcgaaatgcgctgttttatgtgaacactctcttttatattgccctgttcacattactgtttttcgctgcgacaaaaatagttccgcgcataaatcaccataacgaatcactgaataaaccgttcggagcgttccgcaaactcacattggactggtctcctcgatccattatcacattatggtgtctcgtgacggcattctggattccgtattttgtagcttatttcccgggcgtctactggtacgacacttcttggcaactgatggaatattatgacccttcagtgccgttcaccgatcatcatcccttcatgatgacgtatttgtatgtcggattcgcacatattggcaaagcattgttcaataacgctacttatggattgtacctgctagtgctcgtgcagtcgttactgtccacattggccatcgcttgtacagtctgttatacaggcaaatacaacataccttggaaatgccgtttctttattgctgtatttcttacctttttccccatcatccccatgatgtcgatgtctcttgcgaaagatactttcaatacgccatttttcgtattcttctctatcgcattctgtgaactttggagaacacaggggacaattttaaaatccgtttcatttgatgttttctttatcgcagacgcattggccgtatccttaacaaaaaaaacaggcatgtatatcattgtcctggctctgcttcttttggcatgcttcgttgtcaaacattggtcctataaaatagctactattgttttaggtggtgttccttatttagttgttggtataatcgtgccaacttttatcttgccagcattgcacattgcaccaggagaaagtaacgagattcttgctgtgcccatgcaacaagtcgccaatgtggtgcataaccataaggatgatttgagtgtagccgaaatcgacgaaatccaacaaatttaccatatggatattggtcaactccaagatgcttactgctggtataaagctgatccgataaaaggacaggaattatcttctaaagatgaacatgccttaatcacgacgtggacgaaacaactggttaagcatcccggcgacatgatagcaggatggggcgggctctccgtcgcatggttctcattcaatgtcgcatcaggagaagaacaagacctcagcatgatgcgtccaatcaataattccaaacatcattatcaaaacatcgaacaatacatgccttggacagataatactaaagccggtaatgcgattggacaattctacgcagacacattatcagcgacgcctatactcaatatcatatggcaaaaagccttttgggctacaatacttccttttgccatcatgtttctcatactgagatccaagaagaacaaacttaatctgttgatgcttaatctgccaatgttcatcacaatgcttgttctatttgctggaccgatttccacgcacacggaggcaacacgctatgtgttgcctatgctgtatatcattccactgtttctatcacttacgctgaagcatttgcctgaagaatcctaaatcgtctctccggacgtgagtcctacgctgactcacttcgatagtagggctcgtttcacctttgagatgcaccacttgccgacatatacggcaatgccagtaagcagatagaccgcaatggccttaatgaatgggtggtattgcccaaacgtcaggatgcgctcgaaaggcccaccaagcgtaaggttcaccagcagtaggtggaacatatatacaccgagcgagacgctggacactttgcgaattatcgacttcattctgtcagatccacgctgaagggatggctccagcgctttgcagagcatgaacagtgataccgcggatatcacacataacggagaggaaatgccgacaagataattctggtattccatccccatcgaattctggaagaaaccgttccaccataaaccgccgaggaacatcaacgtcacagatccgaggaaagttgcggcccatgcaggcgcattccaatgcaacggcaagccgtagttttctaaataatatcccagcaggaaatacagcagggcactggaagcaaatagcggccagctcaacaatgggctgaaatatttctcgttaattccaatggcttttgctgcaggaatcaggattgaacagaacaacgtcagcgcaatggcatattccaacaaacgacggtcatggacgatttttgaaagcaatggagtcaataagtacaaataaatgatggaatacaggaaccaataaatatcgatgatggagttggtgaggaatctcttgcaaaaatcgacaggaccgaaaccatcggcgattgattgcgctccataaaacaggccggggagcaaaccgaacaataaatagcaagcgatgctgcccagaatcaacgcacgtcccactcgtacgaatcgtttttgaaaaaacactttcgtagaatatttcttccggtaatccaaaagattcattccgctgaccatgaagaaaataggcacggcgaaaataaacatcgcctgcatgagctcttggaatgcccatagaaaagtatgttgcagagagaacacacctaaagacgtatgcagacataccacggcaaagcaggaaacaatgttcagcacgtccacaaatacatagtgagtaccgtgacagctgctttcccgcctgtcgacagagccttgccacatatctgtttgtctcgccgtcactgatcgtcctttccttctccaacttgcacgcccttagcatatcaacgctaaagtatctccgacagaagcggaaactcatccgcaggcgtccgctctcatatctaatctggaaaacacagcatctttatctacgaatcagaagtccgagacatgaaaaacaagtttggaaaccgctatactcgcgccatagcaacgttccactttcataaatttgttcagatgtttagaagaactttctcattgacactgtcattcattctgttttcctgcgtacgctcaggaaagcaagaaaacaccacaagaaaacggaaacaccgcccttcctttaccgagctgtgtaatggacagcatggttctgcaacagaacaaaaccaccaccttaagcggctcagctcagaaatcctcatcggggaaaacaatttccgttactttgcgagaaggaaacataaatacgccagttcttcaacaatcgataaagcaggaaaattttcaatcaagttgcctagaatcaaagggtcacttgcccaatacaccatggaatttgccatagctaccaccgtgatgaaaacacggtatatgatgtatgcgtgggcgaactttttatagccgctggccaatcgaacatggagatcaactataacgattatttcaaaagcgattcggcattcaagacgaacacttcgtcacgctacactcgtgataattaatgtgaatcgataaatccatttgcttcaagtatgcaacatcacctataatccattccccatgcagaccagtacaagagatatagtggagtacatgcctgagaattcgaacgtttccgttgcggtacttcttccttgctacaacgaagaagtcaccatcggcaaggtcgtgcgtgattttaaaaccgcgctgccgcaggcggacatctacgtgtacgacaacaactcctccgaccgcaccgccgagatcgcggcggcggaaggggccatcgtccgcaaggagccacgccaaggcaaaggcaacgtgatccgagccatgttcgaagacatcgacgccgatgtgtacgtcatggccgacggcgacgatacgtacccggctgacgcggcaccagccatggtcgacaagattcttgaaggctatgacatggtgattggagcccgcttgagctccacgtacttccaggagaacaagcgcccattccacaacttcggcaataggctcgtacgtggatccatcaatggactgttcggagctcacgtaaccgatatcatgactggctaccgagcgttctccttcacttttgtaaagacctacccagtgctgtcccgtggttttgaggtcgaaaccgaaatgactattcattcgctgaacaacaatctccgtctttatgagatgccgattcagtaccgtgatcgccctgaaggttccgtcagcaaacttgataccgtcggagacggcatcaaggtaatgagcaccatcttccgtatgatccgtgagtacaaaccactacctttctttggtgggcttggtctggtcattggcgttattggtctgattctttgcggcagcgtaggcatcgacttcatgcacaccggcatggtcgcacgcttccccacactcatcggtgcggtaatgcttgtcattgcaggcttgctcttgattgtcacaggaattatcctcgacgtcatagccaaaaacgatcgcaaagccttcatcgttgaggccaatcgttttgcgttgatgaagcgtcggggaaagtgatctctcaatgtcattaagaaggcttgattccagcagaatatgcgtaaccaagccttcgttttattctgctacttcacccacttttgggcctttgttccgttggaagtatacaactgcacgttagtgccgttcgctctggaaccacaattcacatccaaaaccgcattttctgcgagcgctgactggagcgtatacgagccatcggaattcttgactgctatccacttttgagcgtatgttccattggaatcgtactgttgcacgttggttccgttggcagatacgccgccattcacatccaacactttgccagagttcacactggttaacgtcacatacccgttggagtcatgcgttactttccacttctgcgcattggtaccattacctgcccaaatctgcacgtttccataatttgaacgggaagcgccgcttacatccatcttcatagacgtattaagcttcgatccgaacgtgtaggttccatccggcagatcttgcctatgcttggttgcggtttcgttcaaacgttcgcgcaacgttaacggcgcctttgcaaccagccattgctgagcaacagtgccattcggcgaataaagctgcagctgagcctgctgcacagcattaccacctggaatatcgacagccttattagcattcaccgacactagcgcaaccttgccactaccgtaatttcgcaccgtccactgctgagcaacagtattgttactcgtatattgctgcaacgccgctccattagcagtggatccgccagccacatccagcaccttgccggaattagcattgataatcttataagttccattgccaattgattcaaatcgatatttctgggcgttcgtattattacttgaataaagctgaactcgtgccccgttcgccgttgacgcactcgtcacatccgtgacaagttttttattcgcaaccgaagtgataatcatcgatactccagtagctatgttgacatcgcttgacgaaacaacaaacagctgtgaagcagtgccgttgggcgtatacagccgaatcgcagcaccattcgcagtatttccaccgctcaaatccagaacccaattaccgagagcggactgcaaataatatcccgctccggaatcacgaataaaccatcgttgagcttgagaattatttcgagaatactgttgcactatagcgttattctcagcaacaccattacgcacgtccaaagccttgccggaattcacattgacgatctcgtagctcccatcagactgcctagtaaaagtgaactgctgagccttggaaccgttaccggaatacaactgaatggcggtggaatctgcagcacttccaccaggaatatcaacactagacgcaactttggaacgaacattgatgtaataattgccattcggaatggtaactgccgtcattttgcgtacatcaatggccgcttgtaaatcattgctactcccgccattcacaaactccttattcccgaacgcattcatgtccacgttgccgctgatgccgtccaccttgccggtgctggtgtattgccatccgcgactgttggtcgggaatgagtcgaatcccatgcgagcgccgtactgcgccacccacgtggttttggcgtaaatgtcggcatgtttcagcggcccttgcaggtagctggtgtacgagtagacgccaagattcttgtatccggcggactgcagcgcgctgtaccaattgttgacgatattgttgtacacgttcgggtcggtgggcggcttgtgcccttcccacgtccacttttccaggtcgtaatacacggggtacgccagatcactcggattcacgccaaactgcttgagtttagagaccacgtcggcaccttcttctttggcgagcgccggcgtgtccgcgtaggaataccagtaaatgccgaacgggatgccaagtctcttgcattcgctgatgttacgttgcgctttcttgtcggcattgttgccttcgccgtagccgaggcggatgatcgcgccttccacgccgtcggctttcgctttggcccaatcgatgtcgccttgccatccggaaacgtcgatcacgcctttggcttgctgtacgaacaggttgttctggtagtcaaagaaagctttcgtattgttgtaggtgccccagtgcgcgccgtattcattgctttcgaatttggagagctgtacgttcgcgtcggctacagcatttttgacatcttccgcacttaccggaatgaaggattcgccgttggttttggcgagcggatccggctgctgatctttcatgccgaccaatgttggatcggtcacgatttcgccggtttcgatgttcttgacctcaccttcgggggtgacagccaggtcttccgaaaccacggtggcatcgtcggaaatctcgtcactgacgttatccggaagtttcgcattcggattgtagggcatgctatcttgcgattgctggtcgcccgtctgatcatccgactgatcgtcagactgcataacaacgccattatctgcagtaacggaaccgctttgcgcaacagcatcctcaatcgcaatatcctgcaatgcgtaagccggtgcaaccgcaacggaagcagtcaacgcaaccgcagacagcgcagtcacgatcttcacaacatgatgtggcgaaaccattcgtcagcctctcttgaatacagtcatcaaccccaaatattcggcgcaaacgccctaatcgtcaactctaactgcaacccacaaccccgtccctccccaactccaaaatcatcccaatccccacatctcacgcattacacactgataagaatcgactagctcgttaggggcaccgatatggcatcatccattcccacatctcctttccagcattctcgctgaccttcccatcacgcttcgtagagggaccatttccaggaggggagtacatggatcgtgccagtggaatcgggaagttcaatggtttctccctcgttaagcgtgagaatcaggccggaatcaacgttggtacgttgcataaccgcttgcagagagccgatttctcgcgccctggttttctcatttcccatattggcacacacttgaataagcccatacggttccgtagcaagagcatcgccgataagaaagtcaactttctcctgtttggacgtcggcatagtgtacgaagtgattgtttccgtacgcctaccggaagttcgtctctgcagttcgcagaaaatcgcagtttccagtcgttttccaatatcttgctggttggcgcgtgacaccgcgtaaaccataccctgatcgacggcatacattttcggcaccgcagtactacccggcttgagcatggtggaatgctcctcaagctgatacaccagaaatgcctgcttgaacagctcgagtaacgtattcgccttatcccaatagattttccagccgaccgctcgcaacgtttccacaagaccattggtagacagctcgcaggccgtattgcgcagcaaaaacagcgctatctgcgtggcgagagtaatgttttcacgaccaagacgctcggcaacgtcacgcgcaaccacgtcccgcacgtaaccttggagcgtttcaatacgatcagcttcaaccatacgttgcactgcagggaagccgccaatagttaggtaatcgttgtaggcagcttcaaaccgggtgacctctcgcggcgaaaacacggcatcggcaagagtgctgcccgctgtaggcgtttcgattccccgaaagtcgcagaattcacggaaagacagtggcgccatggcatgcggatgcgatcttcctcggaaattcgttgcgatttcttcgctggacagtttcgaagacgatccagtaatgactagcgtcacagcttcatgttcggctatgcgctggcagaatccctgccaattggcgcattcttgcacttcgtcaaggaagaggtagcagccatggtcacgagagtcgggatattgccgccagtattccgtaacaatatcgttgagcacggtgtcttgcattggttgcagacgatcgtcagcgaagttgaaatagaaaatatcattacgcgagacgccgttttgtaacaaatcatgaattttctggaaaagatagaacgttttgccgcaacgtcggatgccagtgatgatgtgcacagcattgaacactgccggctgcggcagctcgcgtatgatttcgatgcggcgtgacggcgcaggaatgtcaaactgcatggactcacgaaccagcatggcatacgattcacatggattatccggcaccataagttcttcctttcgccgtccgttgcgaaacacccaacaatcccagcataacacttctcaaaaattttaagaagtttccaccaacacttctcaaaatttttaagaagttaccacagacgaataaaactccagagaatacctgaatgcattaacgactacaacacgagtatgggaaatcggggaaggacgggtatcgtacgctgtatattggcatttcaggtggactctcggaacgtgattcaattgccctgaatcgggagctgtcaccggggaatacagaatagtaggcagattctggaggggttatggcacggcacggcaagaagccaagcgaggaaagtacctcgtcacacacaccgagaacacttgccggaagcgcaacgacctgcacttctgccgacagcactgacgccgctgccagcggtatcgctgttaacagctcgaccgtcagcagcgcatttgccagcgatgccgatggcaataccgggaatacgcttgtcggcaacgcttccaacgaagtcgaagcaaccgaagtcgaaaccaacgcaaccagtaccaacgcaaccagtaccaacgcaaccggagagcgcacaatcagcagcagcaacacggctgaaaccagcaaccggcaatcacacgaatccagcgaatcccgccagccgcaagacctattcgacgcggtcatagcgcaaggcatcagcgacggcgacgcttggacggaccagcgcgtaaagcacatctaccgccagatcatcatcgccgtagtcgtcgtagtcgttgttctgggcgcggtcttcggattcacaggcgtgcgcgcatcgcagcaaatgcgcgacctggccgcactcaacgactgcaaggaagccgtcacggccatgaacacctcctattccaaggcgttccagctgaaggcgaagatctccgaagcgttcaccagcttcgacgggtcctacgatctcgacaagcttgccgaactgcaccagacggaagttaccgcaccgaaaacgctgagctgcgccgccgacacttccgctaccatcagcaaagccaacgccgcaaaagccgagtacgacaagcaggccaagcagttcaagcaggctttgcagaagagcgacgaatccgcggccaccgatggcggtgacggaaccgacaatagcgctgacggaacggccggcgacgacggaacggacgaagccacagacacggagggcgatgctggagttgccggcgacgcgggcgccacggacggcaccgtcgaccaatccggcgcagccgacgcgaccgacgcaacgctagacgatcaattcctccagtaaatcaaccaatcgcaacgctgccaaccaaccagccgatcaagccggccaatcaagccaaccaggcctgtcaaccaagccggtcattagcctcaccatctttacgtttctcccaactcttccataccccttttccgcatacccaacgtttcttttgattttagaatcaaaagaaaagcaaaagagagtcacatggcagacaaaagaagaaacgttgaaattccgccattttcaagactttacggctataaaatgcagtaacaagtcaaaagaaaagcgcaagactagggaaagaccaaacgaacggaaaggcggctctcatgagctggacagcggcaaatgggcaagagatcaccgatgagatgatcgatcgttggcgtaaatcctacgaacaaggcgaatttcctgaagacgaacgaacagtgggtggcgtgattatgggacgaccaccgctctcgaccgataaaagtccggcccatgggacgccatcataaagagatgacagaaatgggcagagcctgacggatgaccatatttgtgcgcatcgcagcaagattgactaggctttaatgtgattgctccgttaaacaaacgctgcaagcgttgcattgcggacgcagaaggggagccatcttgaagaagaaacgactggcacgcgtgattattgccgcggtagtgaccgcggcaattctggtggcgatcattgttggttgtggaccgaaatggggcgacggttcagcaaacgtcaacggcagtaattccaatagcagcaacagcgcatcagataatgtctccagcaacgacaacgccgcgcaatccaacaacaattatgcgacccgcatcaccgcgaaactcccctcctactatttggagaacatggttttccaacgtgggaaaacgctggtagtcaaaggaacggccaccacttcacaacgcggaaaagttgttgacccaacgcaactgattacaacgatttcccaaggaaagaaatcagcatcagcacaagctaaaatttccaaaaatggcgatttcacctgcaccttacctaaacaaaaagcaagtcttaaaccatattcattaacgattttatacaacgaaaccactttgttgactctgaaaaacgtgtatgttggcgacgtatttattgctgccggacagtcgaatatggaattgaattattcgcaatattatgagggttcaggcaactcctacaatttcggcggaggtctgataacgaccgacgatctgccgaagcagctttccgacaacaacgtacacttcgttgcgagcgccaattcctcaaaaggtacggattttccgttacgcgacgtgaatgagcaggctggcatctggcttgaggcgaccgccgataattcgcagcatttcagttatctggcgcaacagtttgccatgcagcttcgtgccgcgcatccgaacgtgccgatcggcattattcaaaccgcatggggtggcacgccgattcgacgtcacgtgcaaggcggtgatatttatgcgaaccatattgcgcctttggaagggtttcatgtggcgggcgtgctgtggtatcagggatgcaatgattccacgaacgaggcaaccgcgctggcgtacgagtcgcagatgacgctgctgatcaaccaatatcgtgaagtgttcgatcaggatgatctgccgttcctgtatgtgcaattggcacgctggcctggctaccagtacacgcaaaacgtgcgattcgcgcagttgaacacgttgagcaatgccggattacgcaatgcttccaacgttgcaatgacggtgtcactggatacggacaagggcacttcaacgttgatacatccgcttggcaaagatattctcggcgcgcgcatggcagcgcaatatctggcgatgtcggaaggcaagaccattcccaacgggccgcttatcgcgcatgcgaagcatgcttccgatggcacgatcgtattgtcgttccagaacggcaccgcaaccggtttgcaggcggaaaagcccaattattcgaagactgcgagcgcgaccgtacccgattatgatgcgaatccggacgcgactcctttgaatggtatttccaacgttgcaacgccgacttccacgccattgcaaggttttgaaattgccgacgattccggaaagtgggtttcggcaacggcaacgattaagggtgatcagattgtgctgagtgccgccgatggaagctcgaattgcaacgcggtaactcaagtgcgttactggtggagtggaaatccggttatttccagtctgctgtataacgatctcggattgcctgcaagtccgtttattgctgttgttgagtaatacggcagattgataatcgggcattatccggctgcgacgactaatcgataaagcggactgtaattaggttagaatcaggcctgtttcatcgaacttaagtcgaaagcaatgtcgacggtcaaaatcgacgatcaatcgacgtagtgcggggcgctggacgctatgcggggcgttatggagccgctattgccgttgccgtcggtactaccgtctgcatcgaaatcttgcgatttacgaagcgagccggcagccagcgaacgtatggatcgagcggaacggccaatctgcgcctgtttttcctgagcatccgactgtattgcgggaatcgtgcccgtcacagggcgaatgcggccggtcgcagtgggaatgaagcttggcggcaacacctgcgtggtaacggcacccggcgatgacacatggtagtgggccatcgaagccagggaatcgcgggtatcgagttcacgctgcatatctagctcatcgtcgaactcagccatcgctgccctccctctcttcaagcaatctctgccggtaatctctccactggcaacggtcatcgttccgagcgtaacgcaaggtagcataccgttacgaacgaaatcagcgatatgcgcaactcccccactgtttcgcaacttttccgttgcacgtgccgcagcgagccacgccagcgagctattgaaaacccgccgttttggcataaaaaaaggcttccgaaatcatccggaagccctactggcggagaatacgagattcgaactcgtgaggctgttacaccaacacgctttccaagcgtgcgccatagaccactaggcgaattctccaattatgcaacgtctcacagtgtctatccgcgaaacgcaacttgattagaatacaacagtttcttccaaaccccaaatcggcgtgtcgcagcgtcccagatcgcccactcactggaggaatccgtacacgtgaggacttccccgcgcaccgaattctccaccctctgggacaattcacctgccaacgcacctctcagcgtcccagatcgcccactcactggaggaatcagcccgctgccaagactctcacagtccgaattcctccagtggctggaacaatcagtacgcccataggccttctacagtccgaaaacctccacccactggaggaaaacacccgcgcaccggcctccaaacgtcctgaaacctccatccactggaggaattgatacgttggtatacttcccagcatccggattctcccacccactggaggaatctgcccgcatatacacccccgaattgtccagattcttccagcgagtggagggatccggacacgagctcacgtaccgtgagcacagcagctatcgtttggacgcgaaggcacgcaggtcggcgagcatggcagtgaacatcgggcggaccggaccgaacttatcaagcagcgatcccgaaaccggagcactagccgctcccagcaacaccacgcctgcagcaagcacagacgcgccgaatcccagttgcgaagcgttcggaatcatatagccgtaaccgatcgtcacaaactgcagcagcacatacgcaagcaaatgccaacggaatttcacactccgcaacacggtcagacgaaccagcggcgagaacgcacgatgcgacacccaagcgaacactagcaaagcggccatggcaatcagcagcagaaccactgcaatcaccattgcgtagtcgcggaagtatccccattactcactgcggtaacggcggatccgccacggtcgagcgcaaacacgaaacagacgaatccgactgctaggcaaagcacatgcagcggattgatatgcgcctcttcggtaggagtgacctgatgaatcgttttaaggccgcacaccagcgaaacaaacaggaacggcagcagaatcacgaaaatccaacgccacggcatgaacgtaccgacaagaccgcccacagtcggtccgagtgccggcgccacggccaccaccatgcctccaacgcccatcagcatgccgattttgcttttcgaagactgttcaagaatgatattgaacatcaacggaagcgcgattcccgtgcccgctccctgtagtattcgcgcggtcatcagcataggaaaattcaacgtgcaagctgccatcaggcagccggtgatgcagagcacgattgcggtaaggaagatggtacgcaacttcagtttgcgcttgaaatagcttgagagcggcgtgacaagcgctaccgtaagcagatagccggtcgtcagccattgaacagtggacgtgtcgacgtggaattccgccattaatccagggaaaagcacgttggtgagggtttccgtaaggatgccaatgaaggccatgattccagttgacagaatggcaagaataagattgatggagatgttctcgtcatcttgcgttgccgtgttattgtttcgcgcaatggactgtgacatggatttgcggccgttcccggccttccctttcttggcccggctttgctgagccaccattccgttatgccgggcagtttgctggaatggcgattatttgcccagaaatacaaaaagatccttgggagcggagcgctctaccaaggatcttcatattattaagttgaatgttgtggattgggagcctcccgcgcgccgcgggaaacaagaaccaaaagacaaaaaagagggttcccggagcgtcacgctcgacgggaacccccaacgaaagaatgcggcggcgtgctactctcccacaccctctcgagtgcagtaccatcgccgtgccaggccttagcttccgggttcggaaagggaccgggcgtctcacctgggccatgatcattgactataaagaagtagtacaaatacgctcttgagttctcaaaccaccaccacaccagcagaccgtcccgaacctcaggagcggaaccgccgtgctgagcagcgagatgtaaacttacacgtccttgccgatccacgcaaatcgaccttccgtaaacaccgtgtaaaccgttgaaaaataacgtatctctcggcgtgtcgaaatcgcgggaaaatcgagtgatgagcaccatttcacagcacaatcccgctggaaaaacctcaacatacctcgctacaggtcaacatccgggcgtgtcgcaaccacactatccgtttacggcccatcccccaagccaacccatccgagaaaacctcccagccgaaagctgaaataggagaaacagaagaaagcagataaacgaaaccacaccgccgatcgttgtcctgaacacattcagatcccaactgatcgaaagtgcggttttgcatatgcgcgtgcaagcgacggcagaacaaggcagcgcagccaaaaatcgattaatcggtgcaaccgaaacggtagagggcccaaccctggccgtattgcgaataatcggcaaccttcaccaacgtgccgccatccacatacgtatcaatcaattcctcattgtggaaggaatcgtactgggcgcgatacgggaatgactgcagactctgcgcctggtcgcccatcgtaaggaagtattccggagcgtcggtcagcggacataccgtgccgagcacctgctgcgcatcgccggaagcaaacgcggtctccactttgccgaacggagcggatggcacatcggtgcgcgcattgatgatcggatacagcatgttcgcgttgaacagcgtctccgcatacatcgaaccgttcaacggatcggaaatgatggtggcctgggtgcccgtacgttccgtgaccttgcgcagcacagcgatcttttgctcggtgagctgctcgttggggtcgctttggttcagactggaatgcgcgatgatcgtgtcgcgagccgcggaacgcgatgggcatacgatctgcgcggaaaccgcaagtatcgcaatcacaaggaatacggcgattaggacgatccaattggaagcgaaagaagcgttcttcacggaagaaacagcagacgcagaagaaagggaaggaacggaagaagcactattcttcgtggaaaaggacgatgcagaaggagcgaaagaagcggatgcggcgcacgcggaaacgcattcggcaagagcgttgattccaatgacaagcagcggcagcgcgaccagcggaagcatggtcataatacggttttcatcgcgataccacggagcgctgatgatattcggcaacgcgccgaccagcgtgaccgtgcacacatacaccagcgcgaccagcaggaatgcggccgtcaacgcaatcacgtcacgcaggcgatcgttgcgacgaagtcgagatgattcggacgacgcggacgcggcatcagtggcgttggagtgcgacgcaggtggcggacaggaaacggaaaccggggaatcagcggcggaaaccgcaatatcagaagtcgaagcatcaacatcgacatcagcagaagccacgggaaccacagtggaagcagccgacgaaaacgaatccgaagcacgcgcagccgcgcggcgggaagcgcaaacgaaagcggccgcagttcccgcaatcagcaacagtgcgaacagaatcgcaggaaaaccgtcaagcccatccgtgagacagaacgaaatcgactcccacaaattcttggacggctgatggctatggaaccaggaatcgggattcgcccaacggtccgatttgaacgacgtcagcatcaacgccacaaacgccaccgcaccgacgcacatggcaatgaacgcgccaagaatcagcttccacggcaagcgcagcacaatgaacggcaccagaatcagagcatacgtgaatgcgatacgcgggtgcgcaacgaggcaaaccacgcctgcgacagcagcgatcgcaagccattttgctatatgctcgcgcgcggcgatcgcatcgaacaagcgcaatgtggcggcgatgaggaacggcagcagcgacgtggcgaaaccgaatgcgatcagcggaccggcattcagcagtccgtacgggtggcacaccgagctgacggcaagcacgggcacgaacagtccaatcagattctgcagaacgaaagtagcgtcgaaagtgacgttatattgccgattcacagctgacgatacctgctgatttgaaacattcgacgattcagatacggacgacgattcaggcgtagacgatgcttgagaaatacgtgaaattggattggaaattggattaccgcgattccaacgttgcaggaaatacctgcataataccagcattccggcagggaaaatcacgcccgaagcaatgatccacgtgatattgaatgccgcgtagatcgaacattgcacgccgaacagcgccgcgatcttaatcacaaggtaagcacagacgtgaaacaacggcggataaaacgaatcatgcggccacaaatgcagagccgcccccaatccctcgtcaagcagacggtgaatgaaatagtaatgcgcgggggcatcgctgctgacgatcggcgtattccacaccgtggaggggaaccacgcaatcaccaggcatagtgcggacgcgacgccgataatcgacgtaagccacggcaataacgcgtgacgcgatgcaggacgcagcatcgcgtggcaccgctgcaggccatgtttctgcccggacggaccgcccttggctgaatcattcctggctggaccattcgtagccgaaccatccttggccgagccattctgccgagcctgagtctgcacataagcctgcacatgagttcgcgcacgagcctgagccgagccacaatcgcccgacacggaaccggtattcgtaatctgttcggaagtcatcgattccatcgtagcgagtgccgcaaccatgctcaacgcttattctctggaatcacttttcaggaatcattcagacttcatgcaggggtataacagtgttgcgcaagaaaacaatcacgttggaagcccaagatgattgcacgggacgcatcatgcgctacgggcctgccttgctgcggagcgcgcgtcccggccaacgctgacgtcggcatgcgccggcgcgctataacagagaactggagaagtaccgcatgttcgttctcaagaacgcatgggcggcgcttggtcgcgtcaaatggcgcaccgcgctgatcgccctactcgcactactggtgtctttctcggctgccgtggacttggcagtgattcgagccgacgacaccgccaataatgaaacataccagtcgcaaaaagccacggcggtgattcgtccgaacgcgcaaacacaagccaagcgcgacggtgccgattccagctataccgacaagtatttgacgtgggaaaagtacagcacgtatgcaacggccgcacagagcaacaacgtgaccttcaattacacgttggcaacatcggtgccggtgcgcgaaagcaagtcgttgcaggcgatcgccgcgaaaaacgacaccagcgaagacaagaccggcggcaacctgactctgcaggcgttctacacgttggacgccgcgaaaatcaacgactacggctactacaaggtagtcaaaggcaagcatctgagctataagacgcagagcgacggcgtactcatttcgcaggcgctggccgataagaacaatctcaaggtcggcgacaaagtgacggtcggcaatccgtcgaaggcttccgacacatacacgttcaccgtgcgcggcatttacgaatacgacagcgacgtgccggaaggcaacggatccgacgcgaaatacgcaaaggacaatcgtgagaacgtgatctacacgacgtatatcaacttcgccaagaacgggcttgacacgacggaggccacgggatgggccattccgaatctgaatatcatcttctcgctggcgaatccttccacctacaacacgttcgtgcgcttggtgaagaaggccaagttggacacgaagacgtacgagatcacctcgccgtcgcttaccgcttacaagaagtcgatcgagccgcttgattccgccgcttcggcagcgcgcatcatgctgattgccgtgacgattgtcggtggcatcgctttgctggcattgattgcatgtgctgcgattggcggccgccgcgatgagatcggcatggcgatgatcacaggtgtgaccaagggccgtttgggatggcagttcatgctggaaacgttcatgatgacggttccgggttggattgtcggtttggttgcgggcgcgctgttggcgaagccgatcggcaccgcatgggccggcgggcaggctgtgtcgatgacgtccgcttcggtgtggaacgtgatctggtacggcttgggcgcatgcctggtgcttggcatcgtggcattcgcgcgcgtggcctgcttcaacctgaaccaactgtttgaggaacgctcggaggtgaaggcatgagcgacaacatgaatgataagaacgagaacctcgacgagaccgtggtcgacgagaccgtggtcgacgagactgccgagaccgcatcaaacgagaccgtcgatgatgttgcgactgacgatattgcagctgacgcatcttccgctgattccattgaatccatcgattttgcggtggtatacgacgatgacaatgcagatatcgaaattgccgcaactgacggcgcggaaatttccgacgatgtaaacgatggcgatactgcagtagctgccgacggcgatgctgtggtatctgcagataatgcagataccactgaagttgcagatgacgctgcaactgctgctgatactgcggatggttcggatgtggtcgccaacaatgcgaatcaggtgagggaaacgcttgccttgcgttcttccgacgaaccgaccgtgctggaatcacatgaaatggtgaaagccgattccgcaaccagcgtctcctcacagctcgaccgcgaaatcaagcatcatcgcaagaaggatgcgtttttcttcaaagcgaatccgacgttcgcactcgatcatgtgaccgtgatcaatcgcaagaccggccgcaatattctcgacgacctatcgctgtcgttccatgcgggcgccacgcatgcggtgctcgtggacgcggaggatcgcgaacagcatcaggcgttgctggccaccatggtcggcatggtacgcacggaccgcggcaacgtgatgcacaaaagcaccaacctgagcgacgtcgaaccggtcgaaatgttgggacaccgcatcggattcattccgcaacgtttcgctttccgccccgacctcgacgcggaaagcaatgtactgtacgccatggatgcgtcgaaccgcaacttcctcaagccgaagcctgtgatcgcccgcgaactgctcaagcgcgtgggcttcgacgaagtgacgtccggcctggcagtcggcgaagtaagcgaactgaaccagcgccgcgtggccatcgctcgtgcgctgagctgcgaggctgaagtgatcatcgccgacgagccgaccgctggattggatgccgacgatgcggccgtggtgttggatctgttgaagaagttcaagcgcgatgccgaccgcaagcgcgccatcatcgtggtgaccaccaatccggagatcgccgatgcgatggagcacagcgtggaactcgactagccgcctagtgcaacgggcgcacgaacatagactctttcgtgcgcccataggtaagccctttggaattctggttttagccaaattccaaagggcttgcgtgttctgaaaacggtctgccctactcgacgatacgcatgtggtactgctcggcgagcggcgtgacgtcaagcacgccgtatcgttcgagcagccgcagccattcgcgcctgttactttcgccgaaacgggccgccttgcgcgcataggcttcggccgtcaggaacttcggcggaatcgacttgctgttgtacttgtcggccaccatcaccacttcctgctcaagattcatgggcacatagtcggccggaggcaatggcaatccttgcgattccaccgcttctttggtgagtcccacaccggtgtggttgcgcgcgaactgcgcgatagactcgtcaacaccctcattcaacaaatattcgtagcctttaagcccatgccgcacgtaattcggaccgtcgaatttcagcggtccaccgtcggaaccgtcttgcttgagcagaaaatacgtgccgatatcatgcagcagaccaccgatcaccaccagatgctcgtcgatcagcctcggcggaacggtcccgcccgtaagcccgtccgatgatggaatggaggggatgcgaagcataccgaacgattcgcttccattgccgtcttgcgtaagcctaaggccgaaatcgcccgctttttcaggggcatcgtccggtagtgtgcagcggcgggtgaacagtgcattctgcctgcgtgccatgcgacgtgcgatgtcggcgacgactacgcaatgtccgtgaatcaaatcgtatgcggcttgcgattgcgcgatttttcgatgcagttcgtcaacttgggcgagtgtaggaatatatccggttgtcataccgcctatcttaggcgctgtatgacgattgccgcatgctgaatccggtcgaaaaaaactggaaatccccgatgaaagtttcagccgaaaaattccgaaatacggatttcagattacggatttcagatggaacgcacacggaatgcgccggtacggttggaagcaacgatcatctgattgttttccaaacgagtccagccatcttcggcacactgatcgaaaccggagctggccacaaccacgcccttcggctggcctgcagcctgatccgcttcggattcaccgagcgtacgatagcgcatcacacgatagtcatgcgcctggtcgccacggccgtactggtcatagatttccacaatgcgcttggacgtgacctcacgaccggccgcgcacagagcgatgaattggtcttggctctggatcatgcagttgtagctggacttcggatagcttttgcgcagttcacgcaccgcctgcgcgaccgcctcgtcgagtgcgaaaccaaaaccgatgtactgcaggatcactgcgaagaaaatggcggaatcggaacgtccgccagtggactgcacgatgttgggatcgaccgggaacgcgcggttggtgatgatgttgcgaccctgatcgtcggaaatatcgccattgtggatgaagctcaatccgttggcgtagaacggctgctggttttcgagaatcagcggcaggttcgagctggccaaacgcaggtgccacaggcctccacgagccggagtgttcgcaagctcgtcgaaaatcggatcatgtcgggctgcgatcgtgttcttgtagacggcggtgccggtttccggggtgggagcgccaccgtcacgcaggtacggcgactcgctcggcacggtgaccagcgcggagccccagccatcgttgtggatttcgctcagattccggaaatcgcgtacggcctgcatgccgagcacgccattgagactggtgttgcttccggctgccgcgaatccaagtaatctgcacatggttgattactctacagggcttgtaatgcaacgcgcgcatatggctatcgacattgcttatagcgtgcgaaaaacagcgtgattccaacgattcttcgagataagaccatgcaaaaacctacaaaatgccctacgaaaacgggctgcgcgacgatggcagatacgatcgccatcatcacgcagcccgtttcacggcttgtttcacacacgctttagccgcggaggacgctgagtcgcgaggaacagcggctgtatctcaatcagcggattgtaaggcgcaaggccgaaccatttgaccggagatcccgcaaaatgacgaatcgcatacttgacttccaaagaaatcgcgccacgctgcgacaccttcgactcaggcataagcgccttgtgtatcagcacatatcgaatcggaccgatattcggatcagcatcaagcttcggatagcggctttcctgcctcggcagatcccccgacttcgacaaatcgttcatgatctgatgaatgtaagctggaatcgactgagaaaccttgaaaccaagccgaatgcgaacacggaacatataatccgtaccgaaattctcaaccgaatactcgcgggtgaacggctcatcggcagtctcgacggaaacagcccaccaagcgcgggcacgttttggatggtcggcgaaaatcgagaagaagatatcggtatcgatacgcttcgtttccggatccgacgtgagatagacgatattgtcggcaaaatacggaatcgtatcgtcatcatgcaaccgcttcagcaccggtaggcattcggcgggctgcatatggcgacgctgcgcacgttccagcttcgtgccttcgttccacgtgtacataaccagcagaatcgcgaaggtaagcagcatcgtgaaccaaccaccatgcaggaacttcgccatggaagcgaagaagaacatgaattggatcgcaaggaacagcacggtgaatacgaccgctccgatacgacgccccgaatgccagatgtagacggcaagcagaatggtggtagtgatcatggtgatggtcaacgccagaccatacgccgcggaaatatgctcggaatcacggaatagcgccaaaaccaacagcgtggaaacgcaaagcaccgcattgaccacaggaatgtacagctgaccgcgggtacgggccgggtaacggacctgaagatgcggcatccagttcagatgggtggcttcagacaccatcgtgaacgcgccggtgatcaacgcctgcgatgcgataacgcccgcgaccacggaaagcacgacggccacgtaacgcacgctgggcgtcatcatttcgaagaacgggttcaaaccgtgcgtgcggatgtaagccgaatcatcccaatgattgagcatccatgcgccttgcccgaaataacagagcacaagcgcgattttgatgaacggccacgtgaaatagatgttgccacggccaacatgacccatgtcggaataaagcgcttcggcaccggtggttgacaggaacaccgtacccatgatggcaagcccggcggcattatggctgctgaacaggaatctgacaccgtacacggggttgagcgccgcgaacacgctccaatactgactgaggttcgccaagccgacaaccgccaggaacgagaaccagacaagcacgaccgaaccgaacgccttgccgatacgctcggtgccacgcgactgcacagagaacagcatcagaatgatggccgcggtgatcatcagggtcagctgcttgttttcagtaaaaagtttttcaaaagctggtagcgtctccaagccttccactgccgagctgatggacacagccggggtgagtacggaatcggcgaggaacgcggcgccgccgagcatggcaggaatcgcaagccatgcaccgtactttcgaaccaacgagtacagcgcgaaaatgccgccttcgcccttgttgtcgatacgcatggcaatcagcacgtatttgacggtggtgataagcgtgattgaccagaacaccaacgaaagcacgccgagcacggcttcgcggtcggcatgcgcaagtccgccctgcccgttgaggaacgtctgcatggtgtacagcggcgaggtgccgatatcgccatataccacgcccaacgccacgatcgccatggcgggcgtgattctgtttggaccggattgcagacggctccaccaacgaccgacgggacccttgctggccacctggtcaagtttggcggcctcctgctgtttctcctcgtgctgcttgatcagcacctgtcgctcttccttagtcagcaccttgtgcgaaaccttcggcgcctgcgtgtatgtggctgcgtgaaacagcggctcatcctcgtttggctcgttagccataacgctacctccaagtggcgggccttccaacccactccccaaaataaacgcaaaaaggcacgttaggagccttacgaagtcttgtcaaatcttcacattgtttcttgcgattcttgatctcgcacgaagtaaacttcctgtgggtttttttcttattttacctcttgtctttctcttactctctcttattttcggataaatcgtttccgtcctgtcgattttcggaatttgttcagattccgtacacttcgcgcgtggtctttcgcgttgcctgcgcgacttccgtcagcggtttatcgagataattcgccaacgactgcagggtgtaggggatcatgtatggcgcgttggtgcggccccgatacggcatcggacttaggtagggggcatctgtttcgaccatgacatggctcaatccgacaatgcgcgccgactcgcgaataccatcgttgcccttatagctggatgtgcccgaaaggctgagataccaaccgttttcacgtgcgatctcacctatttcggcatcaccggaatagctgtggaacacggtccgttcgggagcgccgtccgccagcagcgtttcgatgacttccttatgtgaatcgcgatcatggatctgcatgggcaggttcagttctttcgcgagcgcgatgtgcgcgcggaaggcttctcgctgcagttctttggcggcttctccggtgcggaagaggtccatgcccgtctcgccgatggccacaacctggttggggtaggcggtggcgaggcggtgcacttcggccatggcgtcttcgaagctggtgtcgtgccatggctggtatttgagcggcaacccgtctgggcccggcaccccgcggtgaccgtggagcacggattcgttggggtgtatggcgatggccgcatgcacggtttgggggtgttcgcgtgccatgtcgatggccgtcatgaggttcggcagttcgcatccgcagtcgatgacgccttcgactccgacttgttgcgcttggttcagcagttcgtcgacgctgtatacggggacttccggctgtcctttttcttgcgcttcgtggctcatggcccgcgagaacggcacgacggacgccacatgcgtgtggttgtcgatgacgtgcgcgttctcgggaagtggttgcggtgctggcgcccagctgcggtcacgatggtgtttgctcatgcctccagcctacgctcgatggcagtcttgcttcggaagccgcgttattcatcgatggcagtgggattaaccaacgcacctccatatgttttgcggcgtagcgctgaaacgctttccgcgattagtcatggagggtgagggtggtgaaggaccaggagggggcggtgtaggcgccgctggttaggtcgattgcggtttcaaccggaacggttggcgaagccttgccgatttcaccggcgtacgggtcggttccggcgagcacggtggcggttgccgaagcgcgggattccgcggaaacaccaagctcttcaagcacttggttcagatcaatctcggcttcagcgtcgagcgcgttgacgatacgcacgtaggtgacgccttcagcatcattgcgagccacggtgacggtacggcggggctcttccggcttctcaacaccctgcgcaacaagctctccatcgatatacagcttcatgctttcgccgcgatcggccacttcgatgcgcacctgccacacggttccggggaacacttcgtccatggaccattcggtgccgtcaagattgtaggcggtaccgtcgcgcaccaccttgatttcgaaagcacgaccgaaggaggtgatgttgtggttcttgccgttgatgtcgccgtggaccagctgcaagccccaacgaccctgatagtaggtgatggtggcgttgatggtgtaggcgtcagagtcaatgttgaggctcgtgttcatcggaccattgcctgcgtaatggcagtcctcaagatcgacatggcggccatcagcggtgtcaacgctgaagttggtgatgtcggcgtgagcggcaccttccaagcgcaggccaacggttggtggcagttcgcgacgcagcgtggtcttgccttccaccgcgaccggccatgcggtatcggacgtggtggtggcatacatctgctgcacccagtagctgtacggcaggtaggtacgttcgttgtcgaagtagatcagatcaggattccagctgtgatgcccgttcttggcaaacagcggcgcatacgaagacatgaccacggcatcgccgttcaattccatgcgacccatgaacgccgcttcggaaagaccgttgatcagctgcgtgttccacgaaccatactcgcccaagtacaccttcgggccctcacgatccgtggtgtcgtagtggtcgagattgtggaaccaccagctggaggactgataggaatgctcgtcaacgatgggaacgccggcttcacgcgcatactgccaaccagcctcgtagtcgggaccgctcggagccggaccgaccgtgccaaccacaacaatatccgggtaggtggccttgaccgcgtcgaagatctgctggaagcggttcctgaacacgtcatcgatgagatcttcgttgccgatgcccaaatattcaaggttgaacggttccggatgacccatggcggcacgcttggcaccccattcggtggtcgcggcatcgccattgcagaattcgaccaaatgcagcacttcatcgatgtatgccggcatgtctttctgcgcgatcggcaccgggccctgactggtgttctggcagctcacggcggcgggcagcaccggcagcggcttcgcgccaatggtttcacacaggcacaagtattcgtagtagccgatacggaacgactggtggtagccccacaggttgaaattgtgcggccgatgctcaacatcaccgatggtgcgatcccagtggtacatgttatccatgccaagaccgtgggtgatgcagccgcccgggaagcgcatgaagcgcggctgcaggtcggcgagcgccttgaccaaatcgggacggaaatgcttgagcccgttgtaggtggtgcgtggttcgagggtaacgaaatcaagatcgacggtaccttccgtggtgaaggtgagtcgcaaagcgccttcatgtacaacgatggcattgctttcaccggaaaccgtcagcgaaacctcttgcttacgccaatcgttggaatcgacggtgatatcttgttctgcaatcgcatttccatcgtcgtcaatcagagcgacggtgacgggaagtgcggaagcttcgcaattgctggaaatacgcatccatgcggagaaatcgtaggtttcgccggcacggaagaccatgccgtcccagccgatattttcaagcgaagccggcgcctgttcgacttcgacggacgcatagtgcgggttttcttcggctaccggattgtcggtgagcacgtcgaaggctgcgaaggagccggcgggcacgattttgcgccagaagctgtagttgctccagtcggaggagtcggcgcgattgtattcgaatgcgccgttctgtacgaggtcggcgttgagtccgccgtcgccggagtagctgatgtcttcgtagaagatgccccacaggtcggtgctgatgttgcgcacgcccgccttgttgagggttgcgatgagtttgtcggtcatggtgtgtccttggatggtgttggttgtttgttgggttggatggtgttgcggtacgtgcgattggttgcgattcgacgtctgtctggcaccgtttcgccatcggtcgaccgccggccgcgctcggggaagcgccgctcatcgggaatctggcgaccgtacgcatcgatgcacagcggggtgccgtcggagtagccgtgcgcatgggcgttgggatcgaaccaacccgcatcgatgactagggtgtctcagccggcgtccttgaggtggtcggccatgaagcgcgcgttggccaggacctcccgatcggtgacggtggtgccgtaggaatcccagctgttccagcccattggcggtcgccatgcttttggcagatcctcggtagtcgccattgccttctccttgtacaacgttagaaaagcgtgccgtttacagtatctgacgtcatccttgacttacttgttcgacttcatcatcttggaaaacttcagatatgtaccgttacatattttatagcatatttcagaaatcacaatcatgataggatatcggtgattctttgaaatttcaacgattaccagaaaatcatcatatataatatcgttacagaaaaacttggctgtaaggagcggtgcatggcaaacggcaaaccgacattgcgcgacgtggcggcggaagccggcgtctcccccatgaccgcatcgaatgcgctgcacggcaaagccggcgtcaaggaatcgacgcgggccaaagtgctggcagcagcgaaaaaactcgactatcgcatcaatctgacagccagcatgctcaaatcaggtcgcagcaacattattcacatcatcgtcaacgaattcgattcgccgttctattcgaagctgacgcaaacattgagccgcgagatcacctcacgcggactcacgccgttcatcgagcaaacccagtattcgccggacgtggccgaacatgcgctgaccagcaatccgttctcagggcagctcttcgacggtgagattctgcacgccaccggattgggcacgaatctaccgctcgccaaactcaacggcgggcgccctctcgtactgctcgacgcatgcgaggaaacgccaaccgtggatgccgtgaattttcccaacgaggagggcgaacgcgctgcgatgcagtatctgatcgcccaaggatgccggaatattgcgattgtcgggcatacgttcgtgccgcgcgccgagttggcgcatgcgcagaacgcatttgcattgcgacttcgaggagcgtgcgcggcgttgctggacgcaggattgccatatgacgaaaccatggtgttcgaaggcggtcgctccgacgaaggcattaccgccgggcacgcgatcgccgaacggatcatggcggcgcgaaggacgggctgcggagccggcgcgggtgctggagaccgcgaaacaggcacggccggaaccgccgatttcaacgatgcaagcggcaagattacgggcagatcgatcgaaacgaccgacaagattcccgcaatcgcgttcgacggagtgtgctgcgccaatgatttcgccgcattcggcgtgattcgcggcctcgccgactatggcatccatgtgccgcaagacgtgaaggtgatcggattcgacggcgtgacttccggaacctacgccaccccttcgctgagcaccatccaagtggatctcgaccagcttgccaaattcgcggtcgatatgattgtcgaacggatcgaacgcggcgaagtgaatgataattccagcaatgccggaaattccaatgatgcaggcacggtgctgccgccgagccgcgcaaccatcggatatcagttggtcgaacgtgaatccacgaccgcgatcatatagctatcgtgcgttccgcgcccgattgcagcggaacgcacgatagccggaaatacggcatttcagcgattggttggctcagccccgatcagtcgcggcggcgaatggcaaagatgcgggcggagggttgcttggaggtggcggcgttcaggcgaaccgtttccggatccatgcgttcgatagtccacggtttggcattgggcgcatggtccggttcggcaggattcgggaacacctgttcgatggtttgatccgcatccaacggcatgttcacggacggtgtgccgccgcgacgccacacgatgatgtagtcgggcttatcttccggctgaggttgctgatcgttctgctcggcagcctgctcattccaagcggattcgccgtacacatacgcgtcacccatatccgtttcgacatgacgcaagccgacggcaagccaatcgccgtcgaagtcgggaagtccggacggccagaacggcaccatatgctgctggtcggcaagtacacaacgatgtaaggcgatagcgtcgcgaacgagtgaaagacgcggctccgtcatgcgatcgatgaaaccagacagatacagcctgccgagcacacccgtagcaagcgtgaacacagcagtctcatcatccatctcttgctgagcgtaaccccaattaccctgctgttccggcagaatcgtcatacctgcaccagccgcaatcgcagcataaatcagaggatcgcactggtcggaagtggactgcaaatccaagcgggacaactgcgcgtaatcggcgcgcatggcaccggaaccgcagttttcgatcatcacatccggatgacggcgacgcagatcgtcaagccaatccacatatgcgcggcaatgctcgagcaggccatcgccaacggactcggcattcaaatcagtgccgacgccgggaatggtgttgtagtcgaacttgaagaacaccgcaccgaaatcgtcaatcaaacgatcaacagtacgcgtaacatgctctcgcgcttcgggagaacggaaatcaagcagataacgacccgaatcgcacacgcgaacaccatgacgctggaagaacgcggaatccggcaacatgctcgcaagcggcgatttcacgccgatcacttcaggttcgagccacagtcccaagcccatgccatgagcacgaatcgtgtcggcaagaccgcgcagaccggcgtcgccgaaacggttggtggaggcctgccattcgccgaccatgtcccaccagccgccgtcggtgctgtcgtaccagccggcgtcaatgcagaaaacatccgcgccaacgcttgccgcaccttcaatcagcggcagttccttctcaatacgagggtcaccgaacagcgtattcatgtaatcgttgtagatcacaagaccctgcgtatgctcgaactgatcgacgcgccccaactcacgagccttggcaatgcgcagcgcacgacgctgcaacgtcatttcggcaacagcctgctgccaatcgcctgcggcaatggcaaacgacacaggaacggactcgaaatcattgccttcaccaagattggtgaaccaaccatgatccttatattccggaccgaacgcagtgacgtgcagaccgggatcgtcctcgccgacttcccactcccacggaccgttatgctcgatctgccacattacggaaaaatcgcgggcgcggcgtaccgaaccttccacctgcagaatgccggccggctcatgctctcccgagctccatgtagaagtcgagctcatggcaaaacgcgaactagactgaccaggattgattttctggttgcggttacgcacctgagtgtcacgcagcggacgaacacgccaatcgttttccacagcccaagcggcatcgccccagaaaatattcgaacgatgcaccttgccgcagttgacgcgcatcggaacggtcagattcaacgatgacaccgcttcaatcggcagttgcctggcggactgcagacgcgtgtaggtgcgcactgcggaaagattcgggaacgcctcgaatacggaagtgaccaccaagcctgcattggaatcggcggaaaccgcctcggacgcggaattcgcggcgaaatcggctgcgtcacgttcgcttgccgtcggctcgaattcacgacctttcggttcaagatcggcatacggcgcgaactgcgtgatctccaaacggaacggatcggcggaacctggttcaggttcggaagcaagcgcggaaacgaatcgcaattggctgccggcaactgtggcaatcaacgtcagtcggttgtcttgcgaaccggtattggcggcacacacctcaacaatcggacgcggatccttttcaaccactggctttccatcgtcagacaagcgaccatcgatcggaaccatgttgcgccctacaacgttgcagaggcgaacgggggaatcggcggcaatgtcaaacagcatggaggccacaccattgccccattcaaggcgcccatcctgccgaggaacaaggggagtcatattgccgttctccattgccatctccttcgaattccgaatgccgcctatccgttgacgtgcatcgtttgacgtaccctcactagcttaagcggaaaacggggcaaccgcgatgtgcgtgtctacgcacattcagcaaatattcagcaactggaatgaccgttcgaagaccagcaaatacctactcgaattgcagatattccacgaattgaatcggcatatccttggattccgtgatattgctgaatccgagaataaccccttctttcggcagtcccttcatggaagtccatgttttcgaatgggacaagtcgaatccgacagcgtcgttcacatcggaaaccggattgcctttggcgtcgaccagcgcatccttgacctgctcaagatcggcggcactcatcacttccgcgggtttggtgatgtcgccgcgatcattgacttcggcgaaaatatcggtttcggcaacaatcatgttgatctgacctgccgaaacgcgagccgtcaacgatgcggaaccatcttgcgcggcattctcgctaatcgcaatggaggcatccgtccgcacgagacgctcgtcttcaataccttgcgtcttcacaaaatcagcgcccaacgcatcaatctgttcggaatattccgccatatcgacaccttcaagactcagctcggcctcgggacctttggtcacatacgagatgacgaaagcaagtaccaagccgaccactgcgataatgatcagcacatcggtcagaaagttctgcttgaagtacggccacttgtctttcggcggcagctcgcggaaggttttgaatttcgattgcttcgcatacacgttggtggatgcgagcgctgcgaccgcatcttgctgctcctgggtgagaactggcttctctactgccataccaaaccttcccgcgttgtttcatcgacgcattcacgcgtcatcttcatgcgcagcaacatgcgttgctttctgacttccctatcttccgcctcgtacctgataatttgcggctagccgccggccgaaaaacgacaagcggctagcaggaaggctgatttcaagccaatcagtccaagccctaatcagcccatttagaccttgatcatggcgtattgggagtcgtagaggcgatagtaggcgccacgcttggcgagcagctcggcgtggttgccttgctccatgatctgcccatgatcgatgtagcagatcatgtccgcgttctctatggtggacagtcggtgcgcgatgatgaagctcgtgcgtcccttcagcaggtggttcaatccggcctgaagtgcctcttcggtacgcgtatcgatattcgacgtggcctcgtcgagaatcagaatgcgcggatcggccagcagcacgcgggcgaatgcaatcagctgacgttgaccagcggaaagcgtggaaccgcgctcctccaccaccgtgtcgtatccgttcggcaaatccataatgaactcgtgcgcatgcaccgccttcgcggccgcttcgatctcagcatcggtcgcatccaacttgccgtaacggatgttctcgcgcacattgccggagaaaatgaacgtatcctgcagcatgacgcccatctgccgacgcaacgattccaatgtgacagaacgcacatcatgaccatcaattgtgaccgaaccttctgcaacgtcgtaaaaacgcgacagcagattgataatcgtggttttgccggcaccggtcggaccaaccaacgcaacggtgctgcctggctcaacatgcagatcaaccagattgagaatattgcgaccgtcaggctcgtaacggaaaactacatcgttgaaatcgacgcgtccttcgatttgcggcagttcagtcgcgtcaggcgcgttacgaatctccggctgcacgtcaagcgtttcgaaaatacgctcaagatatgcggaacaagtgatcagctgattgtagaaattgccgatgctgatcaccggattccagaaattattcgcatagccaacgaacgcgatcagcacgccggtggaaacgttcaccgcgccgaagcccgtgacgcccacatagtagatgaatgcgatcgtcatgacggaaatggtttgaatgcccggccacatgaggaactggatatgcacggccttcatccacgaggtgcgcacgtcgtcttgctgctcttggaaggttttgaactgcgccgcctcctgggcgaaggtctgcgtggttttcacgccggtgatcgactcgtgaatgaacgcgttgagattgctctgcttgttcgacaacacctgatacgcgcggcgctggaaatgctgcaataccagcacccacgcgatcaggaacgggaagagcaccaggctgaacagcgcaagccgccaatcgaccacgaacatgaccaccagcgtgatcaggaaggtgaacacgtcggaaatcacattgatcaggccggaactcaacgtgtcggaaagcgtgttcacataattgaccacgcgaatcaggattttgccgtgcggacgcgaatcgaaatagctgaacggcagcgtctgaatatgcgtgaaaatatcgcggcgcatgtctttcaacatgagctgaccgacgcgagtaatttcgacggtacgataacgcaatccaaactcatacatcacaataagtacggccatcaaccccgttaattcaccaagtaaggtgagatttttcgaaggaatcgcgctgtcaatcatgattttcgtcaaatatggcacgactaccgcaatgcagctcatcatgacgacgacggcaagaatgcgtatgattcgtgacatatacggctttacatagacgccgatgcgcagaatatcatgcaggttgatctgttcttccagctcttcatcttcgcggtatgtgttacgttttgccatgggttttccccctttcctgctttcccgcgcctacgcttcgaaaccttgcgaacgacccgcctgcaagccgagctgcctgtagtagatctcccaatatcggccgtgcgcggccaccagttcgtcatgcgtgccgcgctccacaatgcggccatgctcaagcacgaggatcagatcggaatctttcaccgatgaaatacggtgtgcgatggtgacgatggttttctgttcgtccagttcgcgcagatggcgctggatttccgcttccgtttccatgtcgacggcgctggtcgtatcgtccatgatgaggatcgacggattgtcggcgagcgcgcgtgcgaggctcaggcgctgtttttggccgccggaaaggccgacgccacgctctccgaccacggtatcgtagccttccggcatgctgcggatgaagccgtccgcgccggcgatggtggccatgcggcgaatgtactgttcgtcgtattcgcgttgttcgcctgcgccgaagctgatgttgccgccgatggtgtcggagaacaggaacgtgtcttgcgccacgacgcacacttgcgagcgcagtgtggcgagcggccagtctcgcgcgtcgacgccgtcgatgagcacatggccttcggtggggtcgtagaagcgggagatgaggttgacgagggtggatttgcccgcgccggtttcgccgagaatgccgagtttggcgcctgccggaacatggaagtcgacgtcttcgagcacgagggtgtctggttcgtcggggaaggcgaagctgacatgctggaagtcgatgctgcctgcgatgcgggttgtgttggttgttgcagcggttgcagccgctgtgctggcgtgattcgcgtcggcgctgtctcccggtttttccgtattttccggcttttccgtaatacgtgactgagcggtgagcagtttgcggattttgatgcaggatgcgttgaatcgctgccagtcgttgatcagccatccggattggcgtaccggcccgtcgatcatccacaggtaggagttgaacgccacgagattgccgagggtcatgcgcccggtgatgaccaggaatccgccgaatccaagcgtgatcagctgcagtgagaagccgagaccgtcgagccatggcatgtatttgcggctgttgtaggcctggtccatgttgcgttgcatgtaatcgtcgttgtgtttgtcgaatttttcggtttcatacggttcgcgcacgaacgctttgaccacgcggttgccttcgatgttttcttcgaccattgagttcatttcggcaagcgagttgcggatggcgaagaacagtggtcttgcgtgcgtggagagtccgcgcgtaaggatgaaaatgaacggcgtgacgcatgcgagcgcgagcgcgagccgccagtcgatggtgaacatcatggcgagcgcgccaatgaacatgaccacgcagtcaagcacctggtagctcacccagctcagcgcgtggcgtatggcatcggtgtcggaggtcatgcggctcatgatgtcgccggtacgcgtgtggttgaaataggtgaagtcgagttcgtgcagtttctcgtattcgtcgctgacgagacggaatacggagttctgcccgaagcgttccatccacatttggtagccgtagcgcgaggcgacgcgcacgatggtgaacacgatcatcatgatgcacagtcgcgtcagttcgtcgacttggccttgcacgatgacacggtccacgatgaggcctgacaatagcggaatgatgagcgccatggtgttgttgacgcagaacagcactatcgcgccggccactcgtggcaggtcgggtttgcagtatggcaggatccatttaaggttgcctgcttctgtattacgattcggatcgacgtacatacgtagcgttccttcggattgtttgctggttgtctgggttttcgtgggttggttttgcgtttttgcgttgcttttacggccattcgttgccgttacgattcacgtccgtcgtttgtcgagcgtcccgttgccgtctctctcggtcgaaacccctgttcggattcgcaaacgcgacttattctatgcgaaccgttttttgatgcaacgtgagtgatttcggcgtgtcgcaatcgcaataaaatcaacgcatgtaccgttacataaattcgctctggacgtaaaggaatatgggtgatcgcagtagcgctttctatatcgaaccggtacgatatatcgaggtgcggcattccgatgacggaacggccgcaatcgcatgaacatcatgaaaggacggcgtcgatgacgagcacacagaccattgaggaactcagcgcacaatacgcggcaaaatatggcatcacccgtgagatgatcgcccatgcggaacgttggacggaaaccgacggcgatctcgaaggcctttccgaagagcgcgtccgcggcattctcgacatgcgtttcggcgcgatcgcggttgacaccccgcgttccgaactgtggcacacgcctgacacaatcgacgtgatcgaagatattccatacctgcctgacggtggctacgatacggaagccggacagtgcagagggcatttgctcgacctgtatctaccgcacgatgcggtgctgcgctgcgggcatacgctgccggtgtacatcgatatacacggcggcggtttcacttacggatataaggaattgaaccgcaacttcaacgtgcatctggccgaaacgggcttcgccgtattctcactgaactaccgaccggccccgcaaaccgatttgaggggtcagctggcggacgttcaggcggcattgcgttggatcaaggcgcatttgactgattatccggttaatccgaacgccgtgttcctcaccggcgattcggcaggcggcgcgttgaccatgctgacgttggcgattgaaaacaatgccgaagccgcggccgcattcggcgtggatgagccttcgggcattggtttcgccggtgccgctccggtgtgcggtgcctacagttccgcatcgttggaaaccatgggaagcgaactgaccgtaggctacgatccgaatcgccgcaccggactcgaacagatgctgggcgtcgaattcttcgacggcatcgaagccgccgacccgaagttcctcaccgccgaaggcctggcgttcaacgtcaacctgccgccactgttcatcgtgacctgcggcgacgatttcctcgaggccgacaatctggcgcttgctgccgcactggcccgcaagggagccgatttcgaactgttcgacccgaagccacgccgccacgaaacgctcggccacgtgttcgtgatcggcatgccatggcttgacgaaagcgtggaatgcttcgaacgcctgcgcaggttctcgtacgagcgctgctgaatcacgaatgcctgcacgcgaccacgcataatcaccagcatcacaaacggccgaccatgcattactcacgcatggtcggccgtttgtcttgcaactcttttcggcaaaatcgcgaaacataaatcgcgaatcgcacgaatcgcatgcatcgtgttcagaaaagaagaaagccggcggagagaagggccgccggctgagagagaagagagaagaagggttcagttatggggttcttcaggaacctcgccagccgccgtaactgctgacatgttctatataagcgcccgagtcttggaggaatgatacgtgttcctgccaattagctgagaaaaatgtatcagacatgtgagcggccatacacattcgtgaattccgtcgaatgatcgcaacattacttccgatttgcccaatcgcacgtctatatcactcacccactccgcaaaaatcatccatttcactggacgattctgaaaaaacgcaaaatcatccatttcaccggacgatatgtcgagctcaagatgctgccgttgtctttctcggaataccgaaatgcattgcaaccgacagcaaatgacaatgcgctgttcgaccggtatctcacatatggaggtctcctctacgtcacacagctcaccttggataccatcgggctcggcgactaccaagacattcgacaccgcaacatcctcgactggctgctcgagtaggacacactctcccgactgcacaatttgcgtccacggatcacaaggtacgaaaaatagcgggaccaaatagttcctgcataacgtgcgccgtgttccacctatgatggatatatgaaacatttcgaatatgaaatctccggcatcgacggcagcgcagcgaaattcgtcggatattgccttgataacagcgaagaagtcgttcccgaccgtgtgcgtccgtctgtgcttgtgattccgggcggcggttacgaaatgacgtcggatcgtgaggcggagccgattgcgatgcagtttcttgcggccggtttcaacgcttttgtgctgcgatattcggtgaagccttccgtttttccagttgcgctgttggaagctgccgatgcgatgacgatgattcgtgagcatgccgccgagtggcatgtcgatccggatgcgattgccgtgattggcttttccgcaggtggtcatcttgctgcgaatctcgccacctccaccagcgacgatgttcttgtcgctcatggttacgatccggatgcggtgcgtccgaatggtttgatgctcgcctatccggtgatcacgtctggcccgctcgcccatcgcggcagtttcgattcactgcttggtgaacgccgcaacgattcacaagcgcttgaatccgtgtcgatcgaacgtcatatcgacgccaaaacaccgccggttttcgcatggcataccgttcccgacgaaaccgtgccatacgaaaacacactgatgctgatcgacgcttgcaagaaagccggagtcagcatcgaagcgcacctattcccgcaaggcgggcatggactgtcgttgggcactgcggaaaccgcatggcagggcgtcaacggcattgaaccgagtatccagatctggccgcagctggctgtctcttggatgcgcagaacgttcgcacgataatcagcgcagcagacgccgtgacatctaaccccatctagtcacgtttcccgcctgcgcaacccgcaccctgcatctgcacaacccataaaatcgggttaaaaacccgggttgtgcagacgcagaacgcaagtcgcgcagacagcacaacacccccgaaccgaccggatagaccgaaaatcgtaagctcgggggcaaaaatcagcggggctgacggaagcgacgatcgccaatcggatcgaacggtgtatgcggctcgagctgataccagtacgcgacggaagcgacgtcgtcctgacgctcgaaattgccgccctcctcagtaccgatctgctgccattccacacgcaaatcatgttcgaaataaatcggatcgggaatgtgccagcgatacaatccgcgggtcaccggcgtattcacatcccaatacgcgctctcgcgatgcgaggcgagacgctgcgaatagaacgggaaaccgacgtacggcgcacagaacgtctgctcatgcatacgcccatgctcgtcgaaatcggcgaaactccacgcgccaccgaaataatcctcggcaccggtgctgcaccacgtgggatactggtcgtccccatcgatgtacatcttgacttcaccctcgccccaccagcggctttccaacgcggtgagcgccagatacgtgccgatatacgcgccacgaccatgcacgccgtcgagcaccacatagtcgcgggccagttcggtgacgcgctcgcgacgccactgcgcatgaaaacgcatggtgccggccggaagcgcgtcatattcggtgtagtcgatctggtagaagaacgcgggaacgtcttcattgtgatcgttgcggagcacgatgcgcgcatgttcgaacggcatggagaagtagcagttgaaaccgcgattgggcacgaccaccaccggcatcgaattgactcggcaggcctgcgcgtggccgcagcagaagaagtcgccgaccgggcattgcacggacggggtctcctcgccatcccaatagaattccaggatcaggttgcgaagcacgttcggaccggtagacgacgtgcggtcggtgaccgtcatccaaatatggcggatcacgcccggaccgtccacatccatcaaagtgacgctctcccccgctttcacggtctggatgcacggactgcccttgcgcgacgggccaagtgcactggctgcagtggccgcagcgcccttgccgcccgtgggattctcggcgttcacgcaacgtgtgcgccctggtgccgcaaccgcaagcaagtccagcggactgcgcgcggcgaacgcacccaacgaatcaacctgcatatcgtgacgtgagctgttttgcatggtgctccaatcgttatctcgagtcataagaaaccccttttcccgctactttacggcaccagcggtaatgccctgcgacaacttgcgctggaaaataatgaagaaaataatagtcggcacaatgctcagcagcgaagccgaagcaagtgtggtcgcatccatcgtgcgttggccctgcaatgtggcgagcgccagcggaatggtctgcacgtcgtcgcccatcaggaatgccatcggaatcatgtattcgttccacgtccacacgaagaagaacacgaacagcacgctgatggtcggccaggaaatcggcagcaccaccttacgcagaatctgccagcgcgaggcgccgtcaatggctgccgcttcgagaatggcctgcgggaacgtaccgtatacggacgacagcagatacgtgccatacgcactttgaatgatggtgaagatgatgatgatcgccagtttggtgttgtacagtccgacctgcttgaacatggtgtacagcgggtagagcagcgcttcctgcggcatcatattggcaagcatgatggcgagcacaatccaagtgttgcctttgaccctgccgatgccgagcgcgaaggagttcagcacggaaagcacgacggcggccacagccactaccagcgaaataaccaagctgttccagaatttcagcgggaacttggtggtggtccagaaggagatgatgccgtccatggtgaaatgcttcggcagcgaaagcgggcctgttgcattgtaatcggcgggtgttttgaacgcgttgacggtgagcacgagcaacgggaaaagcacgagcagtgcggctgcgatgagcacgatgagggtgatccagtcgccggtcgagcgcacatgttgggttttcttggatgctttccgcgctgccgatgcggtcatggtttgcgtcatggttgtttcctcgactttcgaagtcttgcgagtcttacatgttacgggtcagttgcggtttgaaccgttcagaccagttccttttcgacgtgcttctgcaccatggtgaacacgatggagaacacgatgatgaccacggtgagcgctgtggagatggccgcgccgtagccgacttgttgcacttggaagaatgaattgtaggaatagtatgatggcacggtggttgccgttcccggcccgcctttggtgagcagatagaccggtgcgaaggttttcagcgcgccgatggtggcggtgaggatgaccaccagcagctcgggaatgatggacggcagcgtgaccacacggaatttctgccaccagttggctccgtcaagaccggccgcctcgtaaagttcaggatccacgcgctgcagaccggacatgaagatcacgatcggatagcccaactggatccacaccagaatgaacatcagcaccggaagcgcgctatcagggctgccgagccagttatgctgcaacgatcccaggccgagcttgacgagcagcgcgttcaccgcgccatcttccggacggaagatccagcccatgatgatggccgcgacagcaaccggcagcaactgcggcaggtagaacatggctcgcaggaaggaagccgtcttgccgccgaatttcttctgaataacgtcagtcagcagtgacgaaataaatagtccaagaatcgtaggaataactacgatagccacaataatccagaatgaattagcgaatgaaatccagaacgtggaatcagcgaacagacgtttccaattctgcaatccaacgaatttaaccgggccgactccacgccatcgagtgaaactcaagtaaatgttccacacgaatggaataacgacgataacgagcagacctaccagtccgggaacaagatatggtacgaattttgcggaacggtttccgggaagccttgacattgagactcccccgtttttggtcttctttgacattttggcttttcctttggttgcgctgcgttgcctgtgaatatttacgattgcgatattggttcgcaagttgtaatttgcgataccgcacgggattattcatgattgatactgagcaaaaccggaataatcccgtgcgatgtcggatatgagatcagatatacgatcagttggtcttgacgcccatgtcttccacaccgacgtcgtacttctcgtggatacccttgagcacgtcggccggcttcttggtgccgttcaccagttcctggaattccgccggaacagcatcggtaaggttggaagcggcgtaatccgggtagtagctgagcttgccatcattggcgtaggaggcgtattcctcgatcatggccttgctcttctcgtcgttgatcttgctggcgtcgcccgccaccggaattccgccggcgttgccgaggtagttctgcacatcgtcggaaagcacgtagtcaatgaacttcgcagcgagatccttgtggtgagagcgttccggaatcaccagcagattgcctgcgcagccaatcgcgaaattcgattccggcatcaccgcggcgtcccaatcgaaagtggtgatctgcttgacgaaacgtccctgattccaggtgccggtctgatagatcggatactcccccttgatgaatgcctgcgtggtgtcttcggccttcataccggtggcgttgtgggagatgaagcccttgtcgagccagtcgttgatggtgctcacggaattggtgagaatcttggagttccagtcgacatcgcccttgtagagctgccagttgtcgatgaatttggcgtcggcctccttggaaaccagctgccaccacagccacatcacgccgtattcctgcgcgtcggcggcgatcggcgtcactccggcatccacgaatttctggcagacgtccacgaactcgtcataggtggtcggaatctccagcccgtacttggcgaacagatccttgttgtagtagacgcgctggaattccgcgtaactggtcatgccgtaccaggtgtcaccatccatgatgccgttttcatcatacttggccacggccgcattggcgccggtcaccttcttgtcccaaccgtattgatcgacgtaatcacccaaatcggtgagcagccccatggtggagagcacgccggccgaaccgttgccgcgattggattccataagatccggcgcctcatcggaattgaggaattggctgccgttctgcgcgatctgcgtgaacgacttgcgttcgaaattgattttgacacccgtttccttttcgaaggcttccgcggcgcgacgccatgcctgggtctggccagcgtcgtcttcctcgtaataccagaacgacaggctgtctggcgtttcctcgtcttgcgcggtgtcgctgccgcatgcagcgagcgtggtcagcgacattgccgccgcggccgcaagtgcgatgcctcgtgtgatcttcatggttctcctttgttattggtggttgtgttgttgagttatgtctcaagttgtttttcagttatgaagattgatatgtgtcgcctccttttttcgaaacgtttcgacgatggccgcggattggcgcttttcaattcggcaatcaccatcttcgcttcggctacaacgccttcacttactttcgaatcgtttcgattatggatacgggaatccgtccgcctttcacggacatactcctacaaccttcttttcacacgtcaccaactttggtaacggaacctcgactatgcatgaccggagcggacagctccaccaatcccttgatgtcgcgatgctcatcgatggcgtcgaccagcagatccacagccttagaacataattcctgcggcatgaccggcatctcggtaatcggctgcggcatcagctctccctcgaaatacgtgccgcacgacaataccgaaatatcatctggcacccgcaatcccgaagcctgtaattgctgcaataccaacttcagcacattggcgttcgcctggttgacaatcgccgtggggcgctcatccaaagaacgaagctcacgcacgaattccgcggcatcaaagcgatcgtcacgatgcttggaggattcatgaatcgtcatgcccaactcttcggcacgttccagcaaagccttgcggaacagcagcacatagcccgaaccgcgatcgtaatcggtctcattgtcacgcaaaaacatagcgctccgatgccccttggaatacaggcaatccacagccatacgaccagccgtggcaaaatcgatatcgacacaggcacagccttcatgctctgcagggtaaccgatggccacacagggtttggaatatgagccagcctgggcggtacgctcgtcatgttcctcaatgtcgagcagcaccacgccatcaaccaagttgctttgcgtcacgcgccgaatgtcggccaccgcgtcctcgccggtaagcaacagcacatcgtagccacggttctttgtctgccatgcggtctgcagaaagtaagcgttgtatttggcctgattgatatcaccgcgaatcggcgcgctgagcgcaaaaatatgattacgcataccacgcattttacgggcgctggcatccggagtatatccaagtcgttcaacggcggccatcaccttatcggtggttttggcggagatggaacgcttgccggaaagtacgtacgaaacggtgctgactgacacccccgccccccgagccacatctttgatgcccgtcatcttccgcctccttcggctctccaagtcatttgcgttacacgtcatgcgtaccgcagctctcgtccatcgttcaacaaagccatccgccgagccttccggaatttcttccgcagaatcacgctcgtattttatcgaatcgtttcgtcgaaacgtttcactaatcgtaagccagcaactcagctttgtcaaacgtttcgacacacctacccgtcattcctcgaaatgatggacaccaggatgctgcgaccccgttccttcatatcatgattttgatgtaccgaccgttgcaatcttgagtcccgtcgcacgattgcgatttggtttcgaccttacgattttattttccgctttttcccaaatcgtgaggtcagcaagccaaaaacgtgcggccatcctccccaaacactaggacgtgcagacggaaacgcaagttgcataagaatggaggcatctacaaccgccgcccgtacacgtacacacgggctagagaagtctcaaggctacagcgggcgggactcgtagatcatttggcggtcgccgaagtagagggcgtcacgccaagaggccttcttgcgggccgcctcctgctgaggctccttgatcggcacgaagaaccaacggaccagaccaaccaccatgtcttgcacggaatgccagatgccgatatacgcggtcaacgcccagaacgtcacgatcgcattgaaaccggcgaacaccgcgttgccccaattgtgcgaaagcgtatcggcgtagaacaccatgcacgagtaaatgatgatcacccacggcatcgtcacatacaatgccggagaagcggtacgattattgactttcggcgtacgcgcgaacggaatcttcgtgttcgtcatgccctgctgaatcgacttgagcgtgccggaaagattcaccgtcaacagcacgatgttgaagccgtaaatacggaaaatatcggaacgtttatacccgttgcgtttcaaatcgctcgacatggtggcaaaatacggcagcgacgcgagcaccacccacgggctcagcaaccgctggtcgaacggatatgccaagaggaacatcaggccgaaactcgaccatgcgatggacgccatatagttcacgcgcagcgcccactcacccagcttcacatcattgccctgctgatgccgcgcgtgcacaatacggaagaatttgccgatgatcagcagaccgccattcgcccaacgccgccgctgcaccaccaacgaaccgaaatcaggcggggtggcactatagctcaaccgctccggatagttgaccaaatgccagccgaaataacccaaatcgatactggattcggtgtcttcgatcaccgtgcgatcctgaatatacgttttcaccgtgcgcgtgccctcagtcgacaccacgcagatatcgtcgagcgcggccttgcggatcaccgcgttcgcacctacccagaacgtggcgtcatagtaggtcatgccctgatgcagcatgtgctgaatgtcggtggtggcggccgcgatgcgttcgattcgcgtcggcgcgccacgatacgaggaatacggggtttggatcacggccacgcgctcattgccgggctgttccatctggtacaccaagcgcaggcagtagtcgcgcaacagcatggaatcggcgtccaacgtcagcacgtattcggaattgcgcatcacgaaatcgggagattctccctcgcgcacgtcacgcagaatcaccccgtccgacgtttccacgcgcttgagcgagtgccccatcaatccgatgaacgaattcagattcatggctttgttgccttcacgggaggtcgacgcatacagcttgcgttcgaacgaccatccttttgcggtgaaaatgcgtaccaaacgttcgtacagttgcagaatgcgattcgcgtcgacatgctgctgcagggtgatcgattcgttcaacgcctgttccgtcaaacgcaggtcgcgtgcaagaccgcgcaatacctggtcgcagaagaaatcgtcggtatgatcttcgaccagccatgtgtcggccttatgctccaaccattgcgcggccgcacgatagtcttccgcacagcgtgcgaccacactacgccttgcgtccatctgatcggcgagcgccgcaacggtttcgtcgcgcgctttggtgaaacgttccgcaggtgccgccaattcggccaatactttcggcatgagttcgcggcttgctttgagaatcgctcgcgcttcgtcattgttaggatgcggaggatcgtcgattaggagtacgactgcaaggtcgggaaattcctgcaatgccgccgaccagatcgttttttcgacgactttcggctgttccacgtacgaaggaatcagcactgtgattcccttatcgtagttgtgtgcgaaatggtcgtcgagcatcgcccgaggcacgcgttcatgccggatgaaacggtatagcgccccttgccgtgtggtcaagtagacgagcgcgctgaaaatcagcgtggtcacaatcgtcatgtacagcacgccttcaaccacgaaacgtaacgtgagtgaaggattgttgacgaacaacgacagaatcatcgtgatcatgtagatcagccatgaaacaaccgtgcagatgatggcaacgtaaccacgcacaacgcgcgttggcgaaggcttggcatgcatgatcgcaagcggttgcgtggaggtttcagcaccccactggtgcctgcggtcatcgccgtcaaaatcccctatttttgccaccatatacccctttgccttatcagcgctgcctcacctgcataaaccatacatcactgttgaaatcgtcgtactagccacagactacactccctaactgtaagcgagatataagaaaaacagcgcacgagaggaaagcttaatcccccgtaaaatcccccgcatatgcactgaagcccagcgggacacagcctgctagacgccccaatgtccccatcagcattggtgacctgacgatttcgaaagggaatgatgaaacccctgtttccaggaagacgattttccttcctccgactgttcatagcgatactgtgcatcgcgctcgtcgcggccggcacatggtcgtggatcacgttcacgcgaacggcggctaagaaattgccggaaccctggttcggcggctatgtggacgtgaccgcaacaccctcatacgagttcgaatccaaggtaggcaacgtctaccggaatgtgattctcggattcgtcaccgccggcgacggctgccagccaagctggggcggctactacacgctcgacgaagcggcctccacgctcgatctcgacagccgtatcgcgcaaacctacaaaaccgatcgcacggtaaccgtcagcttcggcgggcagaacggcaccgaacttgccagtgcatgttccgacgtcgattcccttgccgacgcataccagcaggtgatcgaccgctatcacatcacctcgctcgacttcgacatcgaaaactcgaatctcgacgggtacagcgaaaccgcaacccggcgagcgcaagccgtggcaaaactcatcgccaacgaaaaagccaaaaacaaagggaaagacgataccagtcacgatctgatcatcagtttgacgcttccggccgacgcgaaaggtcttacaacgcaaggaatgcaaaccgtgaacgcgtttctggatgccggcgtgacgctatccaccgtgaatctcatgaccatggatttcaacgtggcgtccacgtcgatcacgcaatccatgctgatcaaaagttcgctgaacgcggcccacgcgcaatacaaaacgttgctgtacagtcgcggcaaactcttcagcgaccatcagatctgggagctgttgggagccaccgtgctcatcggccagaacgataccaaaaacgagtatttcacgctcgacaatgcgcgcgaaatcaacacgttcgcactggaaacaagcctgggccacttaagcatgtggtcgctgaaccgcgaccagcaatgcggcgaaaactatacgaacaccaacacgctcaaaacgttctgcagcggcatgaaacagacggacggcgaattcgccaccacattggggtcaggattccgaggcacgccgggcacgctcgtcgacttcgacaatgccagctggaattcctcgcagcaggcctaccccacgtgggagccagacgtactgtacaagcaaggcgacaaggtgatctggaacggcaatatctacgaatcgttgggcaacaacgaaaacgagcagccggacagcgccgaggaaggcacgaacgcaccgtggcgcatcatcggaccggtgctataaacgcttgccgcagcgagacgcgaccacagacacaatacaaggcaggaacacaaggcagtcgctacttttcagtaaaagtggcacgcaacaggggaacgaaatcaggcaatcatgacatcgaagcaatcaaagcatcaggcagccaccggcagccagccaaaagacggcatcagaaaaccagccagactcaccattctggccatcatctatgcgttgtgcattgcggccgcaatcgcattccatgcacaggaaggcgtgcagcaacttatggaagaccctgcgcgcatctgcatatggtcgctgtgttttctgccgtgcctgatctaccacaaaaagcgttcgtcgtatcgcgttgccgccgaacacaccgtgctgccaccgttgaccgtcatactgctggtaaccggctattttcccgacgtggccatgttcctgatcatcgttaccatcatcacgtcgatcatcaccgcacgcagtctgaaaatcggcattcttcgcgccggaaccacgcttgcgccaatcccactgatcaaaatattatttgcgaacacttctcacgtactgtcaattatcatcagccagaattccgtcaatgctgcgattaatccttatcaattccagcattggttgctgccattactgattatgactgttgcagtgccgattattcgattgatttgtgatattgtaacgttcttttttgtacaaattccgattcgtaaagccatgcgcgagtattcgctgtctcacattcttgccatggctttggctgatttgatggcgattgtgtggattcctgaaattctggagttcgccaatattggctcggatactgccaccgtgctttccgtgttcatgctggcgctgatcgcctactcgctgttgctgatgacggtcgatacgatgagccggctcacgcgatcccgaagtgcgttgaaatgcatagcgaatgtaagcgacgcgctgccgttgccgaatcaagtgccggaagagaccgtcgtaagacgcatcaatcgtggcctcacccgcatgcgctgtttcatcagcaatgcaaacaatcttaataaaagagggtattcctaccgctattccgcgcctatttccaccggctcgcgacagtattatctcgcgatggaacgcagtatttggaatcgtccgttcatgtcgaccgacgagacgatattgctcacctgcggcgaagtgcttaccgaatcgttacgcgtgaacaaggaagtgacgctgctacgcaccgaatcggaaacggatacgctgaccggcgcactcacgtatcgtgcgttcatcggacatttgaagagtctgcagaccgagaatgtgcataatctggttgccgtggtgtatttcggcgtggagcatttgcgcaccgtcaacgaacattatggacgcaaaatcggcaatgccgtgctgcgatccgtgggcatgcgtttaagccagctgctgccgggaaacgccacgctttcgcgcgtgaacggcgcagaattcgccatgatcgtaaccgatgtgacgtcaaccagcgatgtggaggagttggccacacgcatgcgcaatcttgccgtcatgccggtatacaccgaagaaggcgaggtttccgtggacgtatcgagcagcatttcgttctcgaacgcgacagacggcttctccgtgctcctcgccgatgcgagcgcgcacatctacgagtcggagagctccaatctgcccgtagtcgacggcatgacgtccacgctcgccgcgcagaatggttcgggagactatttcaacgcttccgacgtgcttcgccatgcgatcgaagacaatacgatttccgtgctctaccagccgattttcgatgtgaatacgaaacgtatcacttcgctggatacgattgtgcgcgtgcatgacgcgaagggccgtacgctggcaccgtatttcgtaacggctgaagcgcatcgtctcaacatgagcgtgcagctgacgctcgacgtgctggaaacctgcgtgaaagacatgaccgcattccgcaaggtggcacccgaattggatattgtggacatttgcatgaatggttcggaattaggcgcgtccatcttccacgagcgcttggagcagttgactcatgagcagccacagctgcgtttcggcctgcagttgggatcgcatgccattcatgtggtgcatgatgaagttgatgatgaggttgccgctcttgccgctttgccgaacgtcgagttgggtttgaccaatgctggcaccacgtattcggaggttgccgcgttcgcgcatctgccattggatttcgcacgattcgacaagacggtggttcgcgatttccgtacgcctcgcgcaaagcagatcatgcagcgcacgctcgagatttcgcgcgataacaatgcgttccatgtggtgttcgatggcgtggagtccctggaccaggttgagttcatccgttccatcggaggcacgctcgccgagggcacgctgttgagcaacgccatgagcgccaacgagttcctcatgcgcctcgaaaccatgggcacttcattgcccgaagccgccccgaggcaagctgagtaaagaggagtctcgtttgtcgcacgattgcttcatctcgtgaaacgcttggaggaaatatggcgagatgggagcatgtgtgctaaattaattagtaaacgtgtttagccaacgatggctttgaggaggattcacatggccactatcagagagatagcgaaacgggtaggtttctcccaagccactgtttccagggttttgaaggacgatcccactttttcggtgaaggattccacccgcgagaagattctaaacgccagtctggaaatgggatacaagaacgtaccgcaataccagcgcatcaccattccgcaggatgttgcgattctcgacaatgtcgtacccgacaagggcttgcaggacgcgtatttcgacgagctgcgcgaagtgctcgtcaagcatgccgaagagcagcgtatgaacgtgaccatgcacgaggacgtggattcgctgatcgccgatgccgataaatacgcgggatttatttcgatcggcccgtccccactaaatcacaagacgcttcaccgcttgcataagaagctcccccacggcgtattcatcgacatcaatcctgcgccggcattgttcgattcggtacagccggatttggaacaaaccatattggatgcgatcgacgcgcttatggggtcgggttgctctcggatcggcttcattggcggcttgggcaacattatgggcaagcatgaatatccggaagatattcgtacgttcgcattccgcaattgggcgttgcgcttgggattggatgcgcaaggattggtgtatgcggacggcccgttcactgtggaaaacggccgtttgcaggggcgtcagttggtgcaggatcatgcggacgatctgcccgacgcggtaatcgtcgcagccgatccgttggcggttggcgtgctgcaggcatttgccaccgaaaatgtgatggtgccgcgagatatcaaagtgatcagcatcaacaatcaggagatcgcaaaatacacgtctcccgcattgtcgtcgtacgacattagccaggacgagcttgcgaaagccgcggtgcttatgcttgccgaagcgctgaccgccgaccgcaaaatcagccagcatatgcgaatctccaccagtctcgtcgcacgcgacagcttcaccccgcaagactaaatataaaaacttgagatacggcaagggccggcatcctattgcggagccggccctgcaattgtgcttcagtaatctcgcttcagtaatctcgcttcagtaatctcgccttagcggagagggcgagcgtcacaccagacgtgggtgacggaccaagtggcgggatcgagcagaagcacgtcggcagcgtagccgggagcaagcagaccgagaggttgcttggtgaccgggttcgcgcggtcgaaaccgaatgctttggccggagtcaacgtggcggcctccaccgcgtcggcgggcgtgaatcccaattcgagcaccgcacgctgaacagccttttccaacgtcagcgtggaaccggcaatcgcaccattcgacacgagccgagcgtgaccatcgatcacatccacatccaacgcacccagcagataatgaccgtccgggcagtcggtagcagccatggcatcagtcacgaatgccgtgcgatgcggtgcgaaaccaaatcccaaacgcaccatcggattctgcacatgaaaaccatcattgatcaactcgatagtgacgcgtggatcctcaacagcagccggaattggaccaggctcgcgatgatgcaagccattcatcgcattgaacatgtgcgtcataatgcccgcgcccgcgtcgaaacccttgcgagcggtcgcataatcggcatcgcaatgtcctaccgcaggaaccactccggccgccgcgaagcgacgaatcgcatcaatgccgtgcggcaattcgggggcgatggtgatctgacgcagacagccgcctgccgcttgcaaaagccgatcaacatattcgggaaccggatccttcaaacattccggatcatgcgcacccttgcgagacagcgcaaggaacggtccttccagatgcgcgccgagaatgtcagggcgggcgctcatcatgccgtgcacggtttcgagattggcgcacatcacgtcaagcggattggtgatcaaactgagcacttggcgggtggtgccgtgcatcatgtgacctgcacgagccaaacgtatgccctgcacgccatcatcgaaggaactgccccacgaaccgtgcgcatgaatgtcaacataaccgggagtcatcatgcgacctgcagcgtcggttatggaaccggccgaaccggtcatggcattgccggaatcagccgaactgaccgaatcggaatcagtatcggcattcaaaccgacgcttgcgcaagccgcagcaaaatcagcgtcccgattcccagtcgcaataatcgcgctaccatcggaaaccagccaataatgttccgcaacacctcgcgcatcgactttgcgcgcattatgaatcgcaaacggacgggccgactgcgccaacgcaacgtccacctcattcgcaaaccgctcacgagactgttccatcttcataccttccaattcactcacagccattttcctcaattagcatccaattcttccattcagtggaagaattaccccgctgacaagcccatcagcaacccaatccttccagtcagtggagaaatcctcccgctaacagccacctcagagtcccaattcctccagtcagtggaggaatctggactgccaaatacccccgtactgcccaaaaccttccagcgagtggaggaatcctcccgctgggaggccgaaaaacgtccagaatgttccagcgagtggaagaatccggacgctagcggacaccgactgcggagcagcaatcagatgtgctgccaggcgggcttgtgggcgtaggcgtaacggtagtagtccttgtgacgcaggcggctcgcggcctcctcgtccacaatgatggtggcgtgcggatgcatttgcagcgcggacgccgggcagaacgcactcacaccgccctccaccgtttcggccacagcctcggccttgcccgaaccgaaggccagcatcaccaagtggcgggctttgagaatcgtgccgataccctgcgtgatgcaatgcgtaggcaccttgtcgatgtcgtcgtcaaagaatcgggcgttatcgatgcgcgtctgctcaaccaacgttttgacgcgcgtgccggaagcaagtgacgatcccggctcattgaagcccacatgcccatccgtgccaatgcccagaatctgcacatctatgccaccggcctcttcgattgccttatcgtaggcggggccggcagccgcaatgcgttcgccgtcgctcagcggcgccccgtcgagcacgtcaccaggcacgtgcaccaaatcagggttcagtccaagcggttccacaaccgtgcggtgaatggtggaatgatatgactgcgggtgatcaagcggcaatcccaaatattcgtccaatgcgaaaccacgcacctgcgatacgtcaatatgctcgctgtgcacaatgcgtgcgagcgactggtatgcggcgagcggactggatccggttgccagtcccagcaccgcattcggcttggttttgatgagatcggcgactgaacggccgtaaatatcgcctgcttcgcgctcgtttttcacgatgatgacttcggtcatgatgttcctttcattgacattggattgacgtttttcgttttgctgatttcttgaggatttgtttgatgatttatttgctgattcggcgaagctcgtcggctgctttccacacggtttcctgaatgcgatgcagttccgacggttggcttgtcgcgttccattccttcgcataggcctcgcaccagcattcgagctcgcgcgccagcgcacgataatcggaaggccgccaatcgccagcgccatgcgcatcacgcacgtcatgtgcttcggcgagcgcgaatcccactcgattgagcagcagctgcccttccatggcgatgcgtacggcagcagtaatgcccggatttcccatatgtgccgcaatcggcgcgatgtcgaccatgcattgttgcaatgcacgattggcttgcggaattcgttcgattgtcgttgccatattgcgcatcatgcgattgcgtgcttcacgcacagtcattgcgtttccacagtcagataaatgatcaaccaagcgatcggccaggcagggaatggtttgcgcaacatcggtattgcagtttcccgtgccgtcatccaattcgagatattccacaagctcacgccaagtgaatacggcttgcgcggaagcgctacgaagcaatgcaacgaatcttgcgctgcaatcgccatattcgacgcgcgaaacacgctcaagcaaatcatcttcagcagtatctccggcaggattccacgcatattgcgcaccgaatatcatgccgggcacggccatgcgcggatcgttgacatgcccaaaatcgccccaatcggtgacgagcatgccttccgcaccgcagtcgaggccgtagcgtgcgatgcgtgcgatgttgttccacgcatcgtcgatgcgcgggagcagcgcattccacccccatacggccgggcatacgatttgtttggctccggcttgcgccacgagttggattttttcgtcggttgcttccggttcgtactgccagttcagcagggtgacattgttcggcagggtttcgaggatttccggcatttcgatggcgatgtctccccagaacatgggttcgcggccctgcttagacaggtgttcgcagagtttgcccacgtatgttgcgtacaacgctgcgacgcccacacgttgcgcttcctgcttcgacttgcctttgccgaggtcgaaggtttcgtcggcgcagatgttgaatcgcttcgaacggaaaagttgcagatacgagtcgaccagttgcgcagagaatgcgaaggctcgatcgtcggcgacgttgagcgtgtggtgcctcatgcgttcgatgaagctgaacggccggtctgcgtcttcggggaattcgccaagttcacgcagttcctgcgtgcgcatcgccacatattggtgtccgaatgtggagactgacggcacgagttcgatgccaaggttcgcgcagtattggtcgaattcgagtgtgtctgccggcgtgagcgggcttgatccgcgccatgtttcgctcataccgtcgaatgcgaacgtatgctcgatgtacagctgcaattggttgtatttgtagaggcagagtttgtcggcccactgtttgagccatgcgagcgttggcacgcggccgcgcgtcgcgtccaaataatatcccctgatttggcatgcgggggcatctgcaatctgcagttccggcagtacggcaccgttttgccgtatgagttgacgcagggtctgcacgccgttgcgcacaccctcgaaatcgcaaccggtaatcgtaatgccgtcagtgttgatagtcagcgtgtatgcgccggcggtaccgccatcctgcgaatcgaaatcccgcgaatccgcaatacgcaatctgatgaagcccgaccacatatcgcccgtcgcaatatcccaatcagtgcctgtcgcggaacgtatgtcggcaacaagctgatgcgcaagcaggaaatcgccatcgccaatcgcaatggattcgttcacgcgccccgcatagggcaacagcaccgtgccttcgccgaccgtcatgctgttcggttcgggaatgatcgcccatttgcgggtgttctcgcttgccatcgattcgcctttcgattgtcgattatcgatttcaattctcaattgtgattctcggattgccgggattgccggatctggatttccggaattgttgcgcttgttccagtctgtctgaagtatcacgcattcacgattgcggttgcgctcgttttgccgcgagcgccgcgccgattgcgccgattggttggtcaatggctgcgattctgatgttcgatgcgatgtcgagtgtggtcaggaatcggcatccttcggctctgcggctcagttcggcttggatgacttcgatgagtgcgtcaccggttttcgccatgcctccgccaatgatgatgcgttgcggatcgtaggcttgcgcgacgatttggatggtgtcgcccatggcgtgggccaccatggcgagcacgtcgttggcatgcccgtctccttgccgcgctttgcggatgagatcaggcatgggcgggtttgcggagggccaaagttttgccacggccccgccggatgccacggtttccaagcatccacgctgcccgcatgggcattcgaatccgttggggtcgatgggtaggtgcccgatttcgccgatggatccgctgtacccgtgttcggcttgcccgccgcgcacgagtcctgcggccagtcccgtaccaaagttgaggaatacgacggttgcgttgccgtcgacttgttccacgaattccgcggctccgaccgcagccgcgttcacatcgttttccacgtgcaccggagcgtgcatgatcgcgctgacgcgttcgccaagttccaacgtttcaatatcaagattgacgacgttgctcacttgcccggtcgcgcagttcacctgccctggaatgccaatgccgatgggcagcgcttcgttggacagtatgcgggcgacgcgcacgatgtcggttacgacattgctttcaccggagtgcgatggcatacggcagacgtcaatgacgcggtctgttgcgtcgagcagcacgccttcgattttcgttccgccgatgtcgatgccgacgcatccttgcgaacggccgttatggtgcagtcttgcgttcattgcatgtacctgcctgaaatagtggggcccggattacggttgttctgttgatccaactccatgcgtggcgtttgcatgccacgcatggagttggatggatgcccgtcaacccttgaccgcgcctgccgcaagaccggcctgccagtagcgctgcaagccgaggaagagcacgatcaccggcagtacgccgagcagtgcgcccatcatcagcgatccacgatcgttgaaggttgcgagcgataccatgccatacaggccgagcgtgaccggcttgagggtgtcggaggaaaccatcatcaacggcagcaggaagttgttccacgttcctacgaagaggaacaggaagatggtcaccatggctggggcgagcagtcggagcacgatggtgaagaagattctcgcttcaccggcgccgtcgatgcgggccgcttccagcagttcgttcggtacggaggtttgcgcgtacacgcgtccgaggaagaagccgaatggcgaaacgcagcacgggatgatgatcgccagcatggtgttggtcaggtgcagtgcgtggaagatggagtactgcggaatggtgagcagtgcgaccggcatcagcatgcatcccatgaccacgccgatggcgatggccttgccacggaagttgaattttgcggtggcatagcctgccatcaccgaaatgatggtgccgatcagtgcggaaaccccggagtagatcagggaattcagcacccaacgccagaattggccacgggtccaccccataagcttcgaatagttggttgcgatggcgtcgggaatctggtcaagtccgacggcgaaccacaatccgttgctgctggtcagctgcgatggtgttttggtggatgcgatgatggcccaatagattgggaagaggaagtagatcagcgctacgacgagcacgatcacggtaatggttttggtgatcggcgatgggcgcatggagcgcggcagatcgtgttcggccgcttcgcgttgcttttccatcatgcgttccgcttttctgcgggcgcgttcgtcttttcttgctgcgactgcgttgctcattgttcgttcgccttcctctcgaccagtgcgtagatcatggcgagaacgcctgcgatcagtgccatgacgatggcgaccgccgatgcgggtccgtcaccgcccggagtcagcgtgccttgggaagtgttcatggccatcatcattggcgtataggttttggagatgcccggatcggcggtctgcatgatctgcggttcgttgaatagctggatcgtgccgacgatggacagcaacatggacagcagcgccgcggaacgcacgttcggcagtttgatgcgcatggagatctgccatccacttgcgccatcaatgcgtgcggcttcgtacagttcgtgcggaatcgcctgcagtgcggccaagaaaatcagcatgttgtagccggtgaacgtccatgtggtgatgtttgccatggaagcgagcacaacgttcttgctgaagaaatcaacgtttattccgatggccgcaagacctttgacgatcggcgaaatctgaccgttatacaggtacacccaaatgatggatgcgaccacacctggaatggcgtacggcaggaagtagccgagacggaaacccgtgatgtgcttgaccacgaacgaatcgatgaccatcgccaaagccaacgcgatgatgatcatcagcggcacctgaatgagggtgtaaatcagcaccctgcccacaccggaccaaaaattgccggacgtaagcacgtactcgaaattctggaatcctacgaatttattcaccaattcgccgccgccgtacgcgccgccgccctcggtgacctgacggaagaagctggaatagatggcatagaaaatcgggatgatgaatacaatggcgaacagtatgccgaatggcgccatgaacgcccatcctgttcgattctcgcggcgttgcgcatcagtgcgctttggtttcgccgcttgcgttgttgcagtcatgatgtacctatctttcgcatcggatgccattcatcgttgatggcatctttcacagttcgaatcgccgtatccaaatcgtcatcacgggagaggagtgccggtttcagccgctccgtcgaatcagctagatcgattcatagggaatattcacaaggaatattttcataaggaacggtgtggagccgtgtgttgcgttggctccacaccgtcgttggaggggttatggaatcagagcgggtgatccctggttccatacgtcgatcacttcgctacggacaggccgtagttcttgagggtgtcgatggaggtctgctgtgccacagggaacacgtccgccaccttgccggaaccgtcggctgccttgtcggcggcttcctgcatagctgcggagaccgcggagtagcccggcatgtagttgaatgcgaccatgttgtcgttggcagtagcgaattccttcatcacgtcttggccgccgtagaattcgttccaggattcaggggtcttcgcggtttcggtgctggcggccacaatcagaccttgggaggtcagatcctcaacctgagtgttgaaccagtcgaggaattccatggcttcggccttgtgctcacaacccttgagcactgcgacgccggaaccaccgtcagggccggtgctggtgccattgccgaaccagtcaccgatctgggtgacacgccagtcacccttgccggtgtctcctgcggagtccttgaatagcggagcctcccaagcggcaccgatgttgccgatcagcgtgccatcctgcagggatgcgtcgaacgacggcacccaacgcgggttggtcagcgtggccttgttgtcgatcagttcctggaaggtttcagcaaaagcctgcgaaccgctgccgttggtgttgaccacccaagcgtcattcttgacggtgtaccacgggtcggaagcatttgccaaacctgcgaagatgttgccggcctcatcggcttcgtaatccatgatgtacttgccggacgcggccgcggtctttgccgcttcgatcagctcatccttggttttgggaaccttgatgcccagctcatcgaaagccttctggttgtagaagtacacaagcgggccggtatcttgcggcaggccgtaggtcttgccatcaacctgcatcatggaatatgggccttcggcgaagtcgcttttgtacttcgcggcctcttcggtcacgtcttcgagcaagcccttggtgaacacctcaggcacttcggcgtagccgacctgtgcaagatccggagcattgccggccttgacgtcggtttccagcttcttgatcatatcttgtgcggcaccatcgaacttggtggccttgacctgaatgttcggatgatccttgttccacttggcaacaatgtctttgaccaaagtcatgccttcggaatccggaagacggtgcatgtacgtgaggttgacgacctccccggaatccccgccggtgctggccgtattggaaccgcatcctgcaagacccatgcacagagccgcgaaagaagctgcgcaaaccatcaaacgctgagtgtgggatcgcatatctctctccttcgtgagattattccggcacctccttgcaccggatagtcacagcatacctacgtaatccttttttgtcaagtttccttacatttaaatccggcacgcgattgctattccacaaaaaagctgaaattccgccatttagtgacaatcgtaaagcaatcgcaattcgaggaaaaatgccgtatactcttgtttagtaatctttattgccaataaaaattacataacgcacttgtatcgccacacactacaatatgtatcggctccacacaagaaagcgaggacatcgtgagcggtacccaagcaaaggcatcaccttccgacattcgaatcagcaatatcaccgccgcattcgagcagcttttccccgcaacgcaaatgtcgcgagccaatatcggcaaactcatcggactttcgcgcttcaccaccagcgaagtgaccggcgaaatggtcgacaatcgcattctgcgcgaactcggccccgacaatcgcgaagggcgcggtaaacgttcacaagtgctcgccatcgacaccgatttctggcgaatcgtctccgtcgacctgtcgaatccgatgctcgtcaaaggagcgctggcggatctttccggcagaatcgtggaccgcaccgagcttcccgtcgaccatggctgcagcgtcaatgacgtgatcgacctctgcaggcagctcatcagctcaacgccactgccgacccttggcatcggcatcgcggtgaccggcattgtggaacccaacggcgtggtgcgcaaatccgtgcacttggggtggagcgaactgccgctgaaagccgaagtggaaaacgccaccggagtgcccgtgatcgtagacaacgacaccaatgcggcacttgtggcggaacgattcttcggcgactgctctcccaattccatgctcatctccatcgggcggggcgtcggcgcggcattatgcctcaacgacgtcatcatcgaaggaagttccttcactgccggagaaatcgcacacgtggtggtcgacccgaacgggccaatctgcgaatgcggcaaacagggatgtctcgaatcattcgtttccggtgacaggctgcagcaacgcatctcgcaggatcctgccgcacgtacgcatattctcaccgaagcgggcgcgttgctcgggcgcgtcatggccataccggcaggattgttggatctgcgcgatatttcggtatatggtgcgccggaaatcgtcaatactcaattcatcgacgcgatggaaaacgaaatcagccgcaccgtgaccacggattatcaggaggcgccgcaaattcaccgttgcaggcaaggcgaggatctcaccctgcgcgggcaggccaccatcgtgatccgcacactggtgccgacgatccacgaacgcggctccctcatcggcgaagcatagctccggacgccttagcgcgacccaaaacctccagtcggtggaggaagctacccgctaacagacctgctaacgtccaaaaacctccagccaccggaagaatcgccccgtctgcaactctccgagcatccatatccctccagtcgctggaagaatccggaccgcaaaacacccccgtactgtccaaaaacctccagcgagcggaggaatcctcccgctgacaggccttttatcgtccagattgttccagtgagtggaggaacccggacgggatgagaggcgaggagacgaaaagacatgaaaggccgcctgcagcggatggagtgcttcaggcggccctggttgtcggaaaggagggggaagttcagttatcgggattcaggctggcccgccggagtcgcggttccagcagttccagcggtttcagccacggcaaccgcctcgacggcttccacggtctgagcgtcgtcggcttcgatctcaccgttggcgagcttcacttcgagctccttgacgatctcatcgtgcatcttctcagtgatcttcaccttgaacataaacacgatcaggctcaggatgatgagcacgagcggaatgtagaaggcgcagatcttgaagatgtggatgttggatgcggtcatgtcggctgcggtcgcattgccggtcatgccagcggccacggcgatgatgccgacgatgccgttggacatggcgccaccgatcttgtcgagcatcgggcggacggacagggtgacggcctcgttgcgcttgccgttcttgagctggccgtattcgatggagtcggtcagcgacaggatggcggtcatctgaatgagggtacccggcacgtagaaaagcaccagagccacgaacaccatgatgatgttgtcggagaagatgccgagcatcacatagccggcgatcatggagatcatgccaccgatgtacaggtaacggcgcggaatgcgcttgttcaggatcgggtacagcggagccataaccaagcctgcgaccagtgcgatcacgccggtgagggagtatgcggcctggttgtcgaggatgaacttgaacaggaagatcagcacgccggtggtggccacgttggcgatggcgtacagcaggtagctcaaggcaacccacagcagctggtcgttctggaagatggccttgaaggcttcgatcgggttgccgttcttctgggccttggagcgcagggcgctctcgttctccttggtgccgaaggcaacggtccatgcggtcaagaggccgagcaggccgacgataataccgaagcaggtccagccggactggctttcggcgagctcaccggtgaacacccagctgaagtaggtgacgatcgggatgaccacgacggtgatgccgttgtagccgatggagccggtgaaggagccgagtgcggtgtaggtggagcgctcgtgggagtcggagctcaatgcagggatcataccccagtaggagatgtcacgcagggagtagaacacgtcgagcacgatgaaggtgatgacgaacagtacgatgaaccacgtggtgttcacgttcaccaagccgaacaggccggtgtacactagcacgatcagcacggacgaaatcgcgccggcgaggaactgccatgggcggaaacggccccacttggtggtggtgttgtcgatgatgttgcccagcagcgggtcgatgaagatctccgcgatacggatcaccacgaccaggccggtgatgatgccgatcagcttggtggcgacgcctttatcaacaccagcgaacaaggagctcgtcacatagacgacgaagtaggtgctcagtgcgttatagaacgcggactggccaaggttgccgcacgcgtacgctacgcgctggccaaggttgccgcgacgagccgtgccgttcgcagtagtggtcgtattgctcattatctcttctccttagaagattttgatgagatcacccgttgacctcgaaaattgagtatacgttgtttactatcaaaagtaaaattccttagcaaacaaagcctccaaacggcgtgtcacaatcgcagttcttacgcttatcaaataccgacatctgcaatcatgattactaccgccatttgccgtcacctatcgccatataagtaaattcagttgcaaataacgcaacacgcagatttgcaatttaagtaaacaacgtttaccatgctagtaaaagagtttattactctgagtacacaaaagtacacaccaactaaacctacatcaacaacgaagttatgtttcggaaacgaggaaatcatggcagataagatcaccaccgcatccgccgcgtggctcaccgaccccacggtgttcgcagtgaatcgcacgccggcacattccaatcacgtaaccttttctcacattcccgcgatcggcgagccgagcgatttgaagcaaagcctcgacggcgaatggcgcgtggaaatggtgcaggcctccgacatcgatcttgaggaagagccgttcgcagccgaggatttcgacgattccgctttcggccgcatcgacgtgccctcccacctgcagaacgcgggatacatgaaccacaagtacgtgaatattcagtacccgtgggacggccatgagaatccgcaggagccgaacgttcccgaaaccaaccatgtggcactgtatcgccgcacgttcaccgtcgccgagcgtcttgatacggcccgtcaaaatggcggcaccgtcagcatcacgttccacggcatggccaccgcgatctacgtgtgggtcaacggcgtgttcgtcggctacggcgaagacggctacaccccgaacgaattcgacatcaccgaagcgctgcacgacggcgaaaacgtcgtggccgtcgcctgctacgaatacgcaagcgcatcctggctggaagatcaggattactggcgtttgcacggcctgttccgttccgtggaactcgccgcacagccgcatgtgcacattgaagatatgaaggtcgaagcggattggaatccggaaaccgccaccggttcgctcgacgcgctactcgcggtgcgcaatgcgaagaatgccgccaccgtgtcggcgacgctgaaggatttgagtggcaatgtggtgtgggaaaccgcattggccgcatccgacgaaaccggcatcgtttccggctcgttggacgtcaagccgtggagcgccgagagcccggcactgtacgaactgcaagttgtggtgatcggccatgatggcgcgatcgttgaaaccgcaacgcagcgcgtcggcttccgtcgcttccgcatcgaagacggcatcatgaagctcaacggcaagcgcgtggtcttcaagggcgccgaccgccacgaattcgacgcgaagcgcggccgcgccatcaccaggcaagacatgatcgacgacatcacgttctgcaagaggcacaacatcaacgccatccgcacctcgcactaccccaaccaggaatactggtacgacctgtgcgacgaatacggcatctacctgatcgacgaaaccaatcttgaaacgcacggcagctggtgcctgccgggagacgtggtcaccgaggattccgccgttccgggcagcaagcccgaatgggagggcgcgtgcgtggaccgtgtgaacagcatgatgaagcgcgactacaaccatgcttccgtagtcatctggtcgctcggcaacgaatcgtatgcgggagacgtgttccgcgcgatgagcgtccacgtgcacgaactcgacccgaaccgaccagtgcactacgagggcgtgacccacaatcgcaagtatgacgacgtgaccgacatcgaaagccgcatgtacgcgcacgccgacgaaatcgaggaatatctcaagtccaacccgaagaagccgtatatttcctgcgaatacatgcacgccatgggcaattccgtcggcaacatggacgaatacacggctttggaacgctatccgcaatatcagggcggatttatttgggatttcatcgaccaggcgattcttgtgcgcttgcccgatggcgatgaacgtctctgctacggcggcgatttcggcgatcgtccgagcgattacgagtttgccggagacggtattgtgttcgccgatcgcacgccgtcgccaaaggcgcaagacgtcaagcagctgtatgccaacgtgcgcattgtgccgggtgaaaccggcgttgagatcgcgaatgacaatctgttcgtttccaccgccgactatgtgttcgttacgcgcgtgcttgcggatggcgagccggtatggcaggccgaacagcgttttgatgtgccggctggcgaaaccaagcacttcgatattgaatggccgttggaggcctaccgaggccaagccaacgagctcacgctcgaagtgagccaacgccttgccgccgcggaagagtgggcgtcgaagggctacgagctgtcgttcggccagaccgtggttgcaggctccaagccggttgctgccagcgagacgaagcctgttgacggcatcgtgaccgttggccgttggaatgctggcgtgcagggatccggtcgtgagattctgctgtcgcgtacgcagggcggcattgtttcgtacacgcttgacggccgtgaattcgtgctgcgcaagcccacgctcaccacgttccgcgcgctgaccgacaacgatcgcggtgcaggccacggttacgaccgcgcgcagtgggtcggcgcaggccgttacgccaagtgcgtcaacaacaccatcgaacaggtcaatgacgatacgctgaaagccgtatacgagtacgagctcgccactccgcagcgcacgcacgtcaccatcacgtatgtggcagacaccaccggcaagctgcacttgagcgtcgactatccgggtgaaactcaggaagccccgaccattccggctttcggtttggaatggacgctgccggtcgaatactccaacctgcgcttctacggccccggacccgacgaaacctacgccgaccgcaagcatgccaagctgggcatttggaacaccaacgcttacgacgatcatgcgccgtacctcatgccgcaggaaaccggcaaccatgaggatgtgcgttgggctgagatcacggatgatgccggtcatggcatgcgtgtgagccgtcacggcgaatcagcgttcgcgctcagcctgcagccgtacagcgcattcatgttggaagaagcccagcatcaggacgaactgcccgctccgaagcacatgttcctgcgcgtactcgccgcgcaaatgggcgtcggcggcgacgattcctggatgagcccggtgcacccgcagtaccacattccagccgataagccgctccacttggatgtggatatcgagctgatctgacacgttggggcatgccggttgccccaacaattacggggggtccgcgtattctgcggaccccctgcttgcgttattgcgttaccgcgttaccgccaatttgcattggcgctcattgcctcatatcatgctcaccgctcaccgctgcggataggaatcctcaaagaagcgacgctcgagatgcacgatggtgcggaacacgtcggcctccgagccatccaccgacgcatactcgttgacgagcgcgatcaggcggcccgtccaggcgcggaaataatcgccctcatgcaaatcaacccaacccttgtgcgccggaatctgctgaacgacgccagcgtcgatggtgcgcttggcccaggcaagataaatccattccatgcagcacagcgcagtaatgagttcttcccaagttccctgaaccagcttggtcagatattcgcaatattcacgatttgccggagtctgctcggaattattgtattcttcgtcagtaattccgtattccttaaggaatccggtaaaatatgttgcttcattgtcagcaaaccattgcgattgtttcgccagcatatctttggtttcctgacgcggcgcaagttcaatcgcatgtgccatgatgccctgattaaagaacttgaaatcctgaattaaataagacttcaaaatcgattctggaagtgtatcatccagcaattcattcacaaaacgcgaattgattgcctgattccattcgtcggccgccgacatatacagctgatcggctacggaacccggctcggctcccaaccacgcataatcgccgcttgcggactgcggcgcttccggaacatgattcatggtcacaagaccccctcggttaatgcggccaatgcaaacgcaacgcacatctcctcgctccgttccgccgtggctcgctgtgatggcgccataatagccgccgttcccaacgtaccgaacgcgccaccgaaacgcaagaagcagaacgcttccatgacagccatgaccgcactcaatctcggcgaatcattgcgcgaatttgttgaggcggcgatcgtaggtcatgaggccgttgagctcttcttcgacgtcggaaacctgcgtatacacgtagcccgccaatccgcgtgattccaacgattccgccgaatcaagcacggaacggacggcagtgcgccaatcctcaatcgaatcgtattcaccgtagccgtacgcgcgcgaaaccgcagcatgatcggcaaccaactgcgccaatcctccgaattccgaaatcacgaacgcacgaacgccatgctgcgcaaccggcaacaccgcgtaatgcgcggcacgacgacgccgcttatgccgcttttcatattcggccacatacccacgcaacggccccttatccgggtagatttccagcggacggaagtagttgtgcacgctgtgaacatcgccgcaacgctggtcataccagccactcgtggcgtcgatcgggcgcgtcgggtcaagcgcatgaatgcgttccgccgcatcgcacgcgtcgaactgcccccacccttcgttgaacagcacccacgtgacgatcgacgggtggccggcaagcatgtgcaccatggcatcgcaggtgcgcgaccagtcgcggcggtacgtcgaatcgtcggcaccgagcgccgcgaaatgcttcgccgtgtcgtcgcggtacttgttccatgtggcacgcatgagcgtcggcttgcggttggtgacccacgcgttgtattcgccgccacccgacaccgcgtcctgccataccagcatgccgaggcggtcgcaatggtagtaccagcgcgccgactcgattttgatatgcttgcgcagcatagtaaagccggattccttcatggcggttatgtcatgcaccagcgcttcatcactcggcgcggtcagcaggccgtccggccaatagccctggtcgagcacacccttgaggaacaccggcttgccattgagatggaagcgcgcgatacccttcaaatcaggcttaatctcaaccgtgcggaacgcgcaatacgagcgcacaatatcttgcttttcctgcgatttcgcgggtttctcttgaatttcctgcgattcttgctgcagcttttcctgctttccctgcgatttcgccgcaccaaattccagcgtcgccgtcacgtcatacaaatacggatcgttcggcgaccacaagtgttcggcccgcgttgcgatttccgtgcgcaccttacgcatgccagccggcagcagttcgtccgcgacgatcgtgccgtccgcgggatcggctacgacgatatgcagtttggcattcggcttgtctccgccgatttccgcgcgaataaacaatctgccgtcggcggcgcccttcagcgtaagcgtctgcacgtacgcttccggcacgatctccatccacacgctctgccaaatgccgctttgcgcggtgtaccaaatcccctcgcgctcgattttctgcttgccgcgcatttgcgtgcccgaatcgttcggatcgtacacgcacaacgcaatctcgaaagcatcatcgggatcgacgaatgccgaaatatcgacgtcaaacggcaaatatcccccgacatgcatccctgcaaactgcccgttgataaagcaggcgcacacgtaatcgaccgcttcgaaatgcagaaccaagcggttcgcatcgccgatctgccgaaccgcttcccctcccccaagcgtcacgggatgcaccaccgtgcgataccagatcatattgtctgggtaaatcgtctgatgcacgccggaaagcgcggattccggggagaacggcaccaaaatcttgccgtcgaacgtttcggggatggccgcttccttcactgcctgcaccgcttcgtcacgggtgagcacagccgcggatttgcgccatttcgagccgttgccgctttcgggaatggacacgatcgcgtaatcccagaatccgttgagcatggtgtgattgccgcgcaccatggttgggcgcggatgctcgttcaggattggcgtgcggccgttttccagtttgcgttcgccgtcttttgcagggcagaacgccttgtgggcgtcgttggaagacaaccattcgccggcgatctgttcgccccaaggcgtccacaactgctgcagcggctcttgggaacgcattttcgtaggcgcggctttcagcactcgcttgacgtccaacataagagcctccctgcagcatcgcatttccctcaacttccccattgtaacgagaggaatggcgaagagaaatagcgattgttacggattttgaaatcgattcaatccggattgcactatagatttgtaaaatcgtatacagaaagtcgaatattgcgcattagatttacaagtcggatttgcaaaatcagatataaaaagccggtgcaagaacttcgtaattccttgcaccggcaatcagaacaactcaccttagcggcaaatcaggccaaatcaagccgaatccccaggtgaatcagcgaatcagccttccagcttggccttttcggcggcaagacgggccgcctcggcctcacgacgagccttcagctccgaatcgaagcgagcgagctcctcttcaacggcctccggcggaatcttcgcgaaaatcggatgcggcttcggcactgcagtgccggccacgatcggctcggaagcccacggatgcacggtttcgcccagcttgtagtcgccggtgatgatcggatacatgaagcccggcttgtcgagatcctcgacctcttccaagcgcggcaacggcgagaacgtgcctgtgccgccgagagcctcccacaccttctgcgcggaatgcggcaggaacggggccagcaggtggttcgcgtcggacacggcctgggcggcaacgtgcagcacggtgccgaggcgagccggattgtccttgatcttccacggttcggtggcggaaatgtacttgttgatgtcgccgaccacgcgcatggcttcgctcagcgcgttcttctggcgatggttctcgatcagcgaaccgaccgtgtcgaacgcggccttggtttcgctcagcagagcgcgatcctcatcggtcatttcgctctcatcgagcgccggaatctcaccgaagttcttgttcatcagattggccacacggttgacgaggttgccccaggaagcggcaagctcctcgttgttgtggcgcacgaactcagcccatgtgaagtcggaatcggagctttccggaccggccacggaaatgtagtagcgcacggcatccacagggtagcgggcgagaatgtccttcacataaatgacgatgccacgcgaagacgagaacttcttgccttccatggtcatgaattcggaagccacgacctgctccggcatgttcagcggaccgagcttgccggtttcgccgcccttggagccctgaccgttgtagccaagcatttcggacggccagatctgggagtggaacgtgatgttgtctttgcccatgaagtagtagcccggggtttccggatcattccaccatgcgcgccatgcttccggatcgcccttgcggcgagcccattcgatggatgccgacaagtagccgatcaccgcgtcgaaccacacgtacagcttcttgttcggattgtcgatccagccggcaaccggaacgggaatgccccagtcgatgtcacgcgtgatggcacgcggcttgacttccttgaacaggccgatggagaagttgatgacgttggtacgccagccttcgcgggtcttcagccatgcgagattggcttcggcgagcgccggcaggtcgaggaagaagtgttcggtttcctcaaagcgcggggtttcgccgttgattttggaaacgggattgatgagctcgtccgggtcgagttcgttgccgcaggcgtcgcactggtcgccgcgggcaccgtcggcaccgcagatcgggcaggtgccttcgatgtaacggtcaggcagggtgcggccggtggacggcgagatggcgaccttctgggtgcccttataaatgtagccgttggcgaggcactgcttgaacagttcctgcaccacctgctcgtgattgccggtggtggtgcgggtgaacaggtcgtagctcaggccgagatcgcacagatccttggcgatcacacggttgtaacggttggcgagctcctgtgcgctgacgccttccttgtcggcttccaccaggatcggggtgccgtgctcgtcggtgccagacaccatcagcacgtcattgcccttcatgcgctcgtagcgcgcgtatacgtcggagggcacgccgaatccggcgacgtgaccgatatgacgggggccgttagcatacggccaagcaacattcaccaaaatatgactcatggtgcccgattatacaaagcgccatatcccgcattttccatgtatttcggtagttggatttttattggaggatggacgtgcgatcatcgatttcaatcgtttgaaatagtttgcatcataatttgcatatctgccgatctatccacattgttgcattacgtaacaatcattttccacatatccacagattttcgggggctggtggcgcaacggaattcgaatccgctacggtaccgtcatggacactccaccaccccttctgggcaacgatgaccttccgggcccgatgtgcctgaacctgctggcctcatccggcgcgctgtgcaagctcgacagcgcgaacgcctattcatgccacgattcggacacgttgtacgggcggtcctgcatcatcgcgacattgctgccgagccggtccgtggcatgttcacgcaccgccgcatgggtttggctaggcggcaccttccccgaatccatcgacattatcgcgaaagcccactatcgagcgctacgttacggccgtaaaatcaacgttttcaaccgtctcgcaccaaacgaacacaccatcaaagtcggtccgatcatcgtgaccacgcctgttcgcaccgcatgcgatctcgcattgaactgcacccccgaaagcgaatcgttggtttccgaaatcatctgcatgctcatgcaggaatttcatttccgctccaacgattgcatgcaaatcatggaagatgcgaagcatattcgcaacgctccgcaggcacggaattacattcttgcgattgacggcaaaggttacgaacacgggaaccgtaaggattgcgaagaccgtaagaaccgtaaggatgccgaatatgtgcgcggcgcatagcaggcataaggcgcacggcaggcgcaaagcaccgccataccagcccaagccacgaccgaaaccactgatcgagccgccatctcccccgattctgttgacgccgctggtggcatgcagtcccagcactgcgcaggacgtgctctggcatatcgcggaatacgcgcctcgactgcgcaaatggctgattgctaatccttccgcaacacctgcgatgctggaatatcttgcgcaagtcggcggaccggatgtggcacgttccctgcaaatactgttggaatcgttggaatcgcgcgcattagatgcgattgtgcatgatggctaaagtagcacaatcgcaagtatgcagcgggcaatcgcgcggtaagcgatcgtatggcaagcgatcgccaaacggcagacaatgcgaaaagcttactctttcatggcaagaaccgcattgtagacctgcttgcgattggcaagcgagccgtccgcaaggggatgctcggcaacgacctgcgaaatcgcgtctttgatgcgcagattgtcttcctgcgcacggtcgatcgacagcaccgccaagtcttcgacgctcaacgatgcgggggcagcagcgtcagcctcctcttcggaagcgccggcaacgaccaacaccatttcgccgcgcggcggctcgtcgatcacgctctggcgaatctgctcgatggttccgcgacggatctgctcaaaatccttggtaagttcacggcaaagcgccatcttgcggttcggaccgaacacgtcaagcaggtcggccatggaatcgtcgatgcgatgcagggtttcgtaaaacacgatggtgcggcgttcagaacgcagggtacgcaggtattgcacgcgttcggaatgcttgcgcggcaggaatccttcatagcagaagcggtcggtgggcagtcctgaaaggcacagcgcgtccagcactgcggacgggccgggagcgcaggtgacgggcagaccacgttcgatggcgcgacgcacgatcgcgaggcccggatcgttgatggtcggcatgcccgcgtcggacacgaccagcacggtagcgccggtttccacctgatcgagcagaccgtcggacttgtctcgctcgttgtgatcgtggtaggccaccacgcggccgttcacgtgcacgccgagacggttggcgagcgcatagagacggcgggtgtcttcggctgcgacgatgtcagcgcgctccagcagcgcaatgaggcgtgcggaagcgtcggcagtattgccgatcggcgtggccgccagcacgaccgtgccttgcggaacgttggttccgctcacgagagcgtcaagtcccgcatcgccgtctgcgttttcatcttcacgttcgcgcttgtcttcgcattcgcgctcattcatgcgttccatgccttcagcctatccaacgcaaaggaaaatgaacggcctcccactttctgttgccccaaaaatgggagacagtcatttgaaaatctgccctttttcaatcgcgcggccaccaaggcaaaatctcccagtcgcgcaacacagccacccaaaaccagccgtcaaaagaaacaaacgccgaccgcagttgacactttgcgcctgtttgtgcagatttgccaaccgtcgggcattactaggcgccgcattagagggccactggtaggctgacattggttccgcgaggccaacccacacaaggcagcctgaaccacttaattttggacgtttagatgtaaggtactcacagagagcatttcatgggaattatcaacttcttcattaatctgctcaaggatccgcgcacggcgatcgccagctggatctccatgggcgtcgcccccacgcttggtttcatcttcctgattgtgttcgtcgaaaccggcgtcgtgttcttcccgttcctgccgggcgactccctgctgttcgccgccggcttcttcgccgcgcccgacgcccagaccggcgtttccgcactaccgctgttcgcgctgctgcccgtggtctggtgcgctccgatcatcggcgaccagtgcaactactggatcggccacttcttcggccgtcgcatcatcgaatccggcagagtcaaggctatgacccccgaacgcctcgccaaaaccgaaggcatgatcgaaaagtggggcccgctcgccgtgttcctcggccgtttcttcccgttcatccgcacgttcatgccgttcatttccggcatttccggcatgcgttggagccgtttcaccccgttctccgtgctcggcggcctgtgctggtccaccctgttcacgctgctcggctacttcttcggcggcattccggccgtgcagaagcatttcgagctggtcatcattgcgattctcgtgctgtcgctgattcctaccttcgtcggcttgctcaaagcaaagttcggcaaaaagaaggctgataccgcgaccgcggaagcctgatcttacgttttctccttttcttgcgattgcggtgtctttcgatttttcggaaggcaccgttttcgtatgctttcgcatgcttttcctgcaagggatattccgcaacacgcgaatctcgcagattgcattcgtacagacttcgtactagaatcgcgagagttgtcttgcttagcgtgttgctagacatgacttggggccgtagctcagttggtagagcgcttcgttcgcatcgaagaggtcgcggtttcgactaccgtcggctccactaagcccgctgcattcattccaccgcagcgggctttttcttttcctagccaccagacaaatctgccatacgtaagcgagatggggcgaaaaatcaggcctgggatacgcgctgacgcacgaaagcgtcgagcgaggccgcgtcaatgccctcgtagcccttgatcgaggcgaactgcgggccgttggaattgtcgatctgcatgaacccggtctggccgatcgtcgtcgcgccggaggcgacggccgaacgcaggcccgacatggaatcctcaatcgcaatgcagtacttcatatcttccggagcgatacccaagcgacgacccgcctccaaatacggggccggagacggcttcttctcaacatcatcatcgccgcacacgtagcccgcaaacgcgccagccggcgcttgggcaaccagattctccgcaagatgacgcggcgacgtggtgaccagcatcgaaggaacgccagcgtcacgcagcgcgacaagcacgtcttccacgccttcgatccacggaatgcgctcgaattccttttgggcgacgtaatcgatcatgccctggccgatctcttcaatcgacagctggcaaccatgctccaccatgcgacgggccacatccggaaccggcgtgcccgaaccctgccaggcgagctcctcatcccaatatccgccatgcgcggcggcgattttcatctcaccctcatgccaatacggttcggaatcgatcagcgtgccgtccatatcccaaaacacggccttgatcatcaggttcgtctcggtcatgatgttccttccctacgaccgtcggacgcggagcaccggatttccgggcagcgccgtccatcgcgacttccactgccatttcagcagagcggcaagacggcagcattcgcgagtcgcggcaaaacggcagacaacaaacaggcatacaagcgaggcaaacgaaaagcgcccggacggtcctccatccgagcgcttcccatatcgacgcaatacttcgcgcctacgtattcgcaaaatcatccgatttttttcacgaattatcggcaacccccatcgctataatccatgaaattcgaaaatttcacttgtatcgggagatttgaaattcactctccctgattttcactgttttccacagcggtttcagcggccttttccgcattttccgccttccagcgagcgatgcaacgttccacgcgcttgtatccgatgatcttcggatcaagcccggcctcgcggaaaatcgcggcaggcgagccaccttcggcatacctgcgcatgcaatcatcgcgaaactccttggagtaacaaatacgatactgggtgaccgattccacggcatccagagacccgagatacttgcgggtcttagctgtgaacgcaactcttggcactgtacgctcctaacctttcctgttctcgccgcatatcttaccccctcctccatgattattcatgggcaaagagaaccatctttcaccgaagcaccttgacgaccggaagaatgacagttagaacgcggatgctcaacattatttcccacaacaacgacatcgtcgcaggaagcaatgcatttggtaaaactatataacaaaacaggcacatctgttgcaagatatgcctgtttttgaatttttttcaatgttttctgaaaatcagtcaatcccccaaagcacgatagacctagaaatcggctgagaaacgggtttacccctctcaatcccctcgttttcgcctgcgacacccccaccgcgcgtgtcgtacgcatcagccgcgacacgcgcggcctccacggactcgcgcgacggcagctgacgggcgtcgacctgaatctgccgacgccacatgcgagcgcggcgggaacgttcgatttccacaatgtcaccgtccgcatcggccgcgaacacgctggaaccggccggccggcgcaatcgctcgacttgccggcgcagctcgcggttctcctcttccaaggaaaggatccgcgcgatgccagccaggttgatgccttcttcctgactcagctgctgcgctttcgcaaggcgcgagatgtctcgcagcgaataccggcgagcgccaccgtccgtgcgttgcggcaccaccagccccaaacgatcgtattggcggagcgtctgcggatgcacgttggcgagttcgccggcgcgaccgaccgtgaacatcggcagttcgatgtcgaaaccaacttcatccgccccgtccagatcggccctgccggccacgatcgccattgcgcacatgtcgtacagcattttggcctgccgcgccgcacgggcttgggaggtccgggatgcgcgtgccatggcaatcagcgctccttggcaagttcgtcagcgaaatcgccgcactccttgtcgaattcctttgccgcatgcttgactttcaggctcggcttgtcgggaatgcggatttgcacacgcccgatcagatcgccgtcgccctgcctgttggccacgcccctgccggagatgcgcacttcggtgccgctggacgagcctgccggcactttgaaggtgacttcgttgccgtcgatatcctgtgcggtcactttcgcgcccgccacagcctgaccgacggtgattggcagatccatgatgatgtcacgcttgcgcaggctgaatttcggatcttcggcaacgttgatctgcaggtacagatcgccgttttttccgccgttacgacccggcttgcccttgcctggaatacggattttctgcccgtcacgcacacccgctggaacatgcgtcttgaacttttttccgtcggcagacagcgaaaccgttgcccccttgaccgactggcggaaagtcaaattgatcttggaattgcggtcttcgccatcttccggctgcgcagcctgctcgtagctgcccccgtaggggttgccagccccggcagggccaccagcgccgccaccgaacatcgagaaaatatcgttgatattcggattgccgccaccggtctggaagcggatgcgcgagccattgccgcccgtgccatacgctccagcgccagcgccaccgccgaacattgatccgaaaatgtcggagaatgcccccgcgtcgaatccgcccgcaccggaaccgcctgcgaagcgcgcgccacccatgccgaactggcggatggcgtcgtacttctggcggttgtctttgtcgctgagcacgtcgtacgcttcggagatgtctttgaacttctcctccgcctccttggtcttgttcagatcaggatggtacttgcgcgccagcttgcggtacgctttggtaatctcatcgtccgtggcgtctttggagacaccgaggaccttgtagaaatccttgctcagccattcattctcagccatgatgtgcctcctttcacgaggttgctgatgtcaaatgcctgttgttgttgaaatcgctgtcactgcgctagctctgcggggatgccacaaccacgcgagccgcgcgaatcacgcggtcgccgatgcggtagccggcttccaccacggtgtcgacggtttccttctcggcctgcggatccggcttgtgcaggatcgcgtcatgcttggtcgggtcgaaatcctcgcctttttcgccgaacttctcgacgccgaacttttcgaacgccttgtcgattttggcggaaacggctttgaaggattcgtccatttcgctgtgttcgcgaatgcgatcgatgtcatcaagtgctggcagcagtgcggtcagcacgtcgatgatgccgtgctggcggaaacgttcctgctccttctgcgaacgattgcggaagttgatgaattccgcacgttcgcgctggagggcttccaagtattccgccgcttccttcttggcctggccaagcggagtcagcgtatcttcaccatcttgcgttgcaccatccgcagcatcgccgttttcttgcgattcggaagatgctgcgttcgctgcagtttcggaagttgcactagctgcagaatcgccattattctgcgattcctgcgatgcaccggctgcaggggcggcctgcccggacaggttgtccatgtcgggcaggtcgttcagatattcgtccttgttgaagtcggacatgattacttgttgtccttgtcgtcatcgtccacgacttcggcgtcaaccacgtcgtcgtcagcgggagcggaaccggcggcgcctgcggcacctgcagcgtcggcggcaccctgctgtgcgtagagggcctggccgatcttctgggcggaggtcatcagctcgctctgggcggacttgatcttctcaatgtcctcacccttcagggcttccttgagctcgttgaccttatcggtgacttccttggccacatcgtcggagagcttgtctttattgtcgttgacgagcttctcggtctgataggcgaaggattcggcctggttgcgggtttcggcgtcttccttgcgcttcttgtcttcggcttcgtgagcttcggcttccttgaccatgcggtcgatttcgtccttgcccaggccggaaccgccggtgatggtcatggactgttccttgccggtgcccttgtccttggcggacacgtgcacgatgccgttggcgtcgatatcgaaggtgacctcgatctgcggaacgccacgcggagccggagcgatgccggtcagctcgaaggtgcccagcggcttgttatcgcgagcgaactcacgctcgccctgatagacctggataagcacggacggctggttgtcttcagcggtggagaagacctcggaacgcttggtcggaatggcggtgttgcggtcgatgagcttggtcatgatgccacccttggtctcgatgccgagggacagcggggtcacgtcgatgagcagcacgtccttgcggtcgcccttgatgacgccggactgcacggctgcgccgacggccacgacttcatccgggttcacggactggttggcttccttaccgccggtaagctccttgacgagctccttgacggccggcatacgggtggaaccgccgacgagcaccacgtggtcgatgtcggaaacaccgatgccagcgtcgtgcagcacgttgttgaacggggtgcggcagcgacccagcaggtcggaggtcatgctctcgaagtgggcacgggtcagggtttcgtccaagtgcaccggagtaccgtcaggggtcatggccaggtactgcatggagatggaggtgctcgaggaggagctcagctccttcttggcctgctctgcggcttccttcaggcgctgcagggcgatcttgtccttgctcaggtcgatgccgtacttgttcttgacttcgccgacgagccagtcgatgatcttctgatcccaatcgtcgccgcccaggtggttgtcgccgttggtggcctgcacctgaatggtggagaagctgtcgtcgtccttgccgatctccagcagggacacatcgaaggtgccgccaccgagatcgaagaccaggatggtttcgtcttccttgcccttttcgaggccgtaggccagtgcggccgcggtcggctcgttgatgatacgcagcacgttcaggcctgcgatggtgccggcgtccttggtggcctgacgctgagcgtcgttgaagtatgccgggcaggtgatcacggcgtcggtgaccggttcgccgagataggcttcggcgtcgcgcttcagcttcatcagcacctgtgcggagatctcctgcggagtccacttcttgccgtcgatttcaacggtccagtcggtgcccatgtggcgcttgacggagctgatggtgcggtcgacgttggtcacggcctgacgcttggcgacttcgccgacgaggatctcgccggacttgctgaatgccacgacggacggcgtggtgcgagcgccttcagcgttcacgataacggtgggctggccaccttcaagagttgcgatgcaggaattagtagtacccagatcgatgccaactgcgcgtcccataacttgtctcctttgtagataggttcgctatgcgttttctgttctgttcgttctttcgcccgagtttcggttttccgtctctcgaactttccaaaacttgagcctacaccactcaactttgaatcgcaagcgattattcccaaatctacaaaaaagttgagcgaagagagctcaactttttgccgggtgcaatcttaagcgcaatctcaagacacgatttcaaggtgagatcgccatcaaacccgatcgtacggtgagataaaagatccggatcacactgcgacgcgtgcgatccggatccaatctgcgatcttcagaccacttcagattttcagcggctgatcttggcggtcttgacgatcatcgcgattgcggccagcatggcgatcgcaagtgcggcgatggtgatcgcggcaccggtgttgccgagcacaccggacttcggattgttgctcaccttgccggaagcgatcacgtcattcttaccgtcacccggcttctcatctgaggaatcgcgggccggagcttggaagtcgacggtcacggtcttgccggactggcggccggtgacggtgagcgtgtactcgttgccttcagcaactttgtcgagcgcgatgctggtggtctgagcggtcttgacgcgcacgccggaaaccggagtggagctgtcggaagcggcgagaacgttgccggacttgtccttaagctcataggagagcactgcgtcgccgttgaatccggtggattcggccacatacttgccgtcggtgagcttcacttcggtcttggcgtcgttggagagcgacttctgatcgtcggaggtggaggcaaggccgagggtgttggcgatggtgtagaagttgtcggtctggtcggtcaggccaatcacgcgctgggcgccagggccggaagcggcgatgcgcagctgggtgccggtgtgagccatgtcgccgccgttgtagccgccgtcctcatcgcgggagtcggcttcagcggtgccgtaggagacgaccatattgttgccgtcagcggtcttgagcacggtggagagtgcgtaggccggctgagcgttgaggatctgggaagtgtgggcgtggtcggcggtgacgatcacgagggtgttggtcaggtcaacgttcttcatggcgtaggcgatggcctgatcgaaatcgtcggtttcaccgatctggccgcaagcgttgccagcgtggtcctgcttgtcgatggaagcgccctcaacctgcaggaagtagccattcgcgtcgctggccgggttggcttcgagcagatcgagcgccttcttggtcatgtccttgagcgaggagccctggttgccgagccacttgtcgttcatagtgcacacggtcgggttggcgtccttggccggatcctgcgcggtggccttggacgggttgaacttggtaggcatgttgccgtcgctcatcagggcgagcaccggttggccctccttgtattcgagcgcgttcattgcggccgaatcgttttcgacggtctggtagcccatttccttggcctgctcccacacggtcttgccagcgtattcgccgccctgcacggtctggcggaagtacttggagccgccgccgatggtcacgtcagcgcgggtatcgagcagctgctcggaaatggaaccgatgccgccgttttccttgagctggttggcgaggcagcgcttgagcgcgtcgttggagctgccgtcggtcttgccctgtgggccgtagcagccacgctcggtggagtgcgattcgagcacggccggggtggcgtcctggatttcggcggtggtcacattgccggtggccttgcccgccgctttggcgagttcgaacaggttgagctgcgggttgccgtacacgtcaacgtccacggcgttgttgtaggtcttggtgccggttgcccatgcggagccggatgcggaggaatcggtcactgcggtgagcttgcccgggttcgggttggcgttgaggctgccgtcggagttcttgccgactgcgctgtcgccgctgttgccgcccagcgagaaggtggtgtactggccggtgccggcgttggtgtcgccgagttctgccgactggccgactgcatcgaggccttcgaagtggccgttcgcacccttgagataatcgcgggcgacggtgatttcggaatcgcccatgccgtcaccgatgaacaggatgacgttcttggcgttgccgttgccgatggcagcaatgcgctgtgcgccgccatgctgagccagttccgcaacggacttgccgttcaggttgtaggtggtggtttcgtcagcgagcgccggtgccgcgagtgcgccgagcgttgcaacggaagcgattgctgcaatcgctcccttgagagcctttcgattgctcatcttgttcttctttcttcagcctgtgctgtattgcgattcccacgctaggttccgcaaaccaacttccgaggcgttttagacgaacacaatatgaactctcgtcttcacaaagtgaacacttatctcaaatcctctttccgtcaaccatcatccccaataccccctaaatgctgaattatgactcatgcttttcccgcatgaagtgcaaacggtcaggcagaggcgcgggcggaacgagtggccttgacagctacgaagaagctgcggatcaggagcacgcacaggtagatggcgaacatgatcgagccgacgcggggcgacaccgcgcccgcaatccatgtgccgaatggcgcggtaacggcagctaccaagccaataatcagcgcggccttcacatgcaccagcttgcgcttcaggtttgccacgctcgtggtgatcgagttcgggaacatggccagcagcgacgtgcctcgcgcaatcagatcagaagcgttgaacagcatcgacagtgcgggcacggcgagcgccccgccgccaatccccagcagtcccgccaagatgccaatcaccacgcccagcagcaccaggcagactccggtcagcacgctcatcgtaatgtgctggtctcgcgacggcacgaaacttatctggttcaacaccacaaacacgaggaacactacgaaaatccaccgcaatacgagttccggcaatcgcgaaagcaaccaactgccaatctgcccgcctacgaacatgccgcaaaacagcagcagcgcggcgagccagtccacgtttccgcaagtcgcgtacgaaatgacgccggaaatcgaggtcggtacgatcgcaagcattgacgtcgccgccgcattgcgttgcgtcaagccgagccataccagcgcgggcacgatcaccgtgccgccaccgataccgaacattccggacaatagccccactgccacgccgacgatcaccagcaccgcaatgcctcgcgcggattcgtcgagtcccacaggatccgcaccaaatagccgatccgctttctcgccgaatttcccgctcggctgcacactcgatcgcacactttcttcagcgcgttcaacactttcagcattcgaaatattggaaatatccgatttcttcatctctcccctaccatcgcactttcttcatcttgcgataattgcgatagttgcgatagtacattcccgcacatttcagcaccgcaaacccggcacattgcgagaaagcaagaagagaaaaagccccctcccatgccaagatttgcccaacgttacatgcacccgtttgcacgcgcacattgcttcggattcggtatgcgatgcccgcgcacgagcagcctgcgcgagttcaccctacccccccccagcccacaaccgtacggccgtacttttccagccataccggcaaaagtcatattatggcacacacttttccggtcatactagtaaaagtcgtatctcagagcacacttttaaaggtatactagtgaaagtcgcattagaatacatacttttccggatacactagcaaaagttgaacatcatgaaacttaaacccaggccgcagtacctcagcaaactcgtcgcggcgcaagacaacagcctcatcaaagtcatcacgggcatgcgccgctgcggaaaatcatcactactcacactcttccgacagcatcttctgcagcagggcatcgccgaagaccacatcatcatgatgaacctggaatcgttccaatactcgtcattcaccttcgaagacctgcacaacgcgatcgccgaccgtatgcagcaagacgaccactattatctgctgctcgacgaggtgcaactggtggacaagtgggagcgagccgtgaacgcgctccacacggatgccgacgtggacatcaccatcactggatcgaacgcctacctgctttccagccagctggcaacgctgctttccggcagatacatggagatcaatgtatttccgctttctttcgcggaattcatggcgtacgccgatctgaccgacgagaacgcggccttcgaaaggtacacaagatatggaggattgccgccggtcgtgaatcaaggcaccgatcaaaacctggcatacaccgtgctttccggaatttacgacactattttggtgcgagatatttcgcaatttctgcaagtaagaaatccactagttttcaacgatgtcgcacgatatttggcagataccgcaggatctccagtctcaacttcgaagatagaaaatcgattgagaagcgcgcatcgaccagcttcaaatgagaccatcgaacgatatattagtggacttctcaatgcttttcttttctacaatgcgcaacgaattaacgttaaaggtggcgcatatttacaaggattagctaagtattatccagcagatttaggaattcgcaatatgctgctcggatattccatagaagatttcggatttcttctggaaaatgccgtacataatgagcttaagattcgcggatatcagattcgcgtcgggaaaatcggtaaagctgaaattgattttgttgcgactcggaaacatgcagatcttacggaagagaaactgtatatccaggtgagcgccagcatattggacgagcacactcgcgagcgcgaactgtcaccactgctgaatgcacgcgatttgtctgcgaaaagaatggtgctgacgctagatcgtttcggactcggcaaaagcgacggcgtgaccgttgccaacgcaatcgactggatgctcggaaagtaacgccattccaagacttccttacgttcacacaattcaagtcctccgtctgcacaagtcggatttgggagcgattccggggtgatgcagacgcggaacgggattcgcgcagacggcgacaacagacagcagcgggctgcatatgcaaatacccctgcactagtaccgtgaatcaaaaatggcaagtacgagggtatttggagcaacaacgccctctcaatctgttttttattatactgcaaacgttgtcaaaacccatgcaccacgcaggcttatgcgttcagcacgtaatccagcaatccctcataatcggcgccggtaaacgaacgcaccgcatagctcgacgtttccggatcatctgccggcgaaatctccgtgcggaaatacacgccgtcaatgcccgcggtgcgagcgccaacaatatcgttctgctcgtcattgcccaccatcagcgcatgcttggcggtcacgaattcgcggtcgagcgccagcatgtacaagtcgcgcgcgggcttgcggatcttctcctcgctggagatgatcacatcgtcaagcacgccggcaagtcccgtcatttccagttcggcacgggcgtagcaggattgcgcgttgctcagcagcgcggccgcgacccagtcgacgttgccattgtgcgcataggaaatcacaccggaaatcgacgtcggtacgatcgccagcatggaggtcgccgccgcatggcgttgcgacagtccgagccacaccagtgcgggcacgatcaccgtaccgccgccgatgccgaacatgccggacaacaggccgacgatcatgccgacaatcaccagcaccatcatgccgtgaggcgattcatccagcccactcggattcggcccgaataggcgatcctgcccatcattttcagtcatatcgtccccatgacgcaaccctccttccatcttccgctatcacgcccgatgttgctgcagtcgcacgcagaggataatggccatctactattgggcatgtccgaagccactattgctcccaaaaagagcgtctacttgtatcggcaaagtctcgacacatgtcgcaatacggcaacaaaaaatacgccaacacgcataaaccctccgactttgacagtagcgaaccggttcgatacaatcaatctcggaccggttcgacacagacgatgaccgtctgcaagaatcaggccacggtcagattgtatcaggcaagagagggcccgcatatgaccttgacaagtgatttccgacgaaggaaggtcgcaaggaggaaaggaaaccccatgaagaatctcacgaaaggcatcgccgctgtcggcgcgttggccatgttgacgggcgtcggcgcctgcggttccaacaccgcggacgacaaaggacatgtctatttcctgaacaacaagccggaagttgtcaatcagtggaacgaactcgccgaaatgtacaccaagcaaaccggcgtgaaagtggatattcagagcgccacctccggcagctacgagtccactctgtcgtccgaactcgctaagaacaacgccccgaccatgttcggtatcggcggcttcgatcagtatgccaaatataaggactacctcgaacctttgcaggatactgaggcttacaagcttctcaacgatcagggcaagcagatggcccacaaggacggcgacaacgtgtacggcctgccatatgccgccgaatggttcggtatcatcgtcaacaagaagctcatcaacgagtatgccaaaaaggactacgccgtcatcaagtccttcgacgacatcaaggactacaacactttgaagaaggtcgccgacagcatgcaacagcataaggatgatttgggcatcgacggcgcgttctccacgccgggtctggactcatccaactactaccgatatgcttcgcatatgactcaggtgccagtcgcctacgagtacattgacgagggcgtggacttcgagaaggaactcaagggcacctatctcgataactacaagaatctgtgggatctcgagatgaaggacaacccgaccgaaaacaccatgcttggctcggtgaattatgaggactccaccgccgagttctccgccggcaaggtcgctttctacccgaatggtgtatgggcctatagccagatcaaaggcaacgaagttgccgatgaagacttggccatgctgccgtactacatgggtttcccgaatgagagcaagtacgccgcgaactccatctatgacatctcctggtctgtgaacaagaacgcttccgacaaggacaagaaggccactgaggatttcatcaagtggatggtctccgacgaggatgccaagaagattctctccaaggatatgggcttcgccgttccgttcaccacctttgactccgaggatttccagcctgacaacccgctgaccaagtctgcgctcaagcttgagtccgatggcctcactccaattcatggcgcctatattccgggacaggcatgggctgacggcgtggccaatgcactgctcgagtacgctcagggcaccggtgactggaatggcgtgaagaaggcatatctggacgattggaccagcgcctggaatgattatgaaaacaacttcggcatgcttccgccggcccacaagtgattcgcctatgggccgcggtgaatcgcataacgccattttcacctggtccataacggcatgaccacagtctccatcggctttctcgctcgccgatggagactttctcatattcaaaaaacaaacaacgtctgtgaccgaagctgatacgcacagatatgaatgtatcgcgcaaacagacgcagcatacgccatgaaaggaacgaacatgacactagaatccttgaccaagatacggcacgaatcaagccgcgcagtcaacgcggaaaacccgaccggcgaaccgggcaaaggcggcatagcggccagtgagcttggcccaagtcgcaaaggcagcccttgcctacgtaacatacccgtcggcgcaacggcgactcttgctgatatcaccggccccggctgcattcgacacatctggataaccgttgacgagaagaccaccgatgccgattgttttgtactgcgggaccttgtgctgcgcttctattgggatgacgaggaggaaccaagtgtggagtgtccgcttggtgacttcttttgctgcggattcggccgtgcgtgcctagtaaattccatgcctgtcgccgtagtgccgaaccgcggtttcaacatgtacttttcgatgccgttcggcgcacgcgcacgcatcacgctcgaaaaccaacacaagaacgccatcagcgcatttttctaccagattgactacaccgtgaatgacgagccgttcgacgatgacattgcctatttccacgcacaatggcggcgccagcgccttactgaaaaggggagagactatgtggtgcttgatggcgtgaaaggtgaagggcattatgtaggtacctacctggcactgaccacgcttgagcgctactggtggggtgaaggcgaattcaaattctacatcgatgacgatgaagagtaccccacgatctgcggcaccggcaccgaggactatttcggaggctcttggagcttcgccaagcaggtcaatggcaagaccgtggagcaaaactactgcacaccgtatctcggatacccgtattactcttcacacgacgagctgattcacaacgattatcacaatgatgattgccccccgatgcgtggcttctaccgttggcacatccccgatccgattcgtttccgttccaacctgaaggtgaccgttcagcaaatcggtgttggtcaccgcggattcttcgaacgtcaggatgatgtggcatcagttgcctactggtaccagaaggggccacacgctccatttccgcaactacctagcgccgaggaacgctggccgcgctgacgtcatccataagtagctcacctcaagccgcatcccttgtctctcaggggatgcggctttttgctacagtcaatcgtttgatgtacaacttttttagcaaacgcttgcatagtgtgtcgcctaattttatgcctaaaaatggcagcaaatagcggattgcccggtattgcaacgtgataaatcaacaaaatactgccatcgtttgcaaaaaagatgaaagtgatgcataataggggcatcggcagaaagcagcactatctcagtgcacatatccaacggggacgttggacccgatgcagaaaaggaaggttcgaagatgaatcgtaaattgaagtccgcactagccctcattgcggtcaccgccatgtctgtcacgacatttgccgcttgtggcagctcatcgagctctgattcaagcaagggcaaggtatactacctcaatttcaaaccagaagccgccgacgagtgggccgatttggctgcggagtacactaaggaaaccggtgtcgaggtcaacgttcagaccgcggcctccaatacctatgagcagcagctcaagagcgagatggctaagtccgaggcaccgaccctgttccaagtcaacggtccggtcggttacgccaactggaagaactacactgctgacatgtccggcacagaggtatacaagcaactgcagaaccaagatgttgccctcaaggatggcgacaaggtcgttggcgtaccgtacgtcatggagacttatggcctaatctacaacaaagacatccttaacaaatacttcagcacttccggcgccaaggccaagtccatcaaagacatcaactcctttagtaagctgaaggccgttgctgacgacatgcagtccaagaaggatgaactcggcattaagggcgccttcacctctgctggtttcgactccagctccgattggcgtttcaagacccatctagccaacctgcctctttactatgagttcaaagatgacaacatcactgaacagccggccactatcaagggaacctatctgccggagtacaagaacatctttgacctgtacatcaccgattccaccaccgagccgtcccaactaagctccaagactggtgacgacgccaattccgaattcgcactcggcgaggccgctttctatcaaaacggcacttgggcatggtccgatttgcagaaagccggcatggaggccgattccgttggtatgatgccaatctacatcggcgccaagggcgaggagaaccaaggtctggcaaccggctccgagaattactggtgcattaattcgaaagcatccaaggccaatcagaaagcgaccgccgacttcctgaagtgggtcatcacctccgataagggcaaagaagcgctgtctcagaagatgggcttcaccaccccgttcaagaccttctccagcgtcaaatccgacaacccgctggtcactgacgccatggacgaccaaaagtccggtaccaccgcagtgtcttggaacttcaccatgatgccgtccgaacaatggaagaacgacctcggctccgctttgctcgagtatgcccaaggcaccggcaattgggatggcgtcaagtccgcgttcgtggatggctgggccaaggaatatgccaacgcccacaagtgaccgcaattgacttcactgtctgattctctccttatagaaaaccgctccggaaccaaccggagcggttttctatgtatcggtaagcgattagcccttatccaaggacactcgcgaagtgctggagcgaacgatcagttgcgccggaaacgtctgaaacggcatacccgtggtcttgcgattgatcaagtcaagagtcttacaagccgcctcgtgtgccatgccaatcggatcctggcgaatcgtggtcaagccgatatcgtgcgcatagaagctgtcgtcatagccgatgacggaaatatcagacggaatacggtagccacaacgcacaagctgataaatcagtggaatcgcgatgccgtcctcctgacaagcgatggcggttggcatttgcggcaagctcagcaactcggagacaatcgtgctaatgcggtcctcactttcctgcgcaaccaacgtagttggcgtgacaccctgttccagacaggccttgacgaaggagtcataacgttgctgcacactgaagtgcaaggaaacctcacgcgacgtacgtacgtagacaatgttgcgatgccccagcccgataagatggcgcgcaaccagacgcgaaccttgatcatcgtctatccccacggccgcagtgaaaccgtattctcttggattcacacagttgatgccgataattggtacgccggtgctggccagctgtgcgctttcctgcgcatcgacatcgatggaagcaacgatcaccgcgtcggcattgcgacgaaccggcagcatatcaaagaactcacggcgttcctcgatactggagatctggaagatcgataaatcatagccgtctgcgtgcaaaacctggttcaacccttcgatgacggaagcgctgaaccatagtcggatatggtcgctcatcagcaaggcgacacgcaatgctttgccggacttgagcgcagtggccgaacgggagatggagaaactcatctcgtcggcgatgcgcaacaccctggaccgtgtcgcctcagatacgagctcaggtcgggtgaatgatctggacaccgtggaaaccgacacctttgccgctttggcaacgtcttgaatattgactgacatgcacaactcctttatggcagtagatactacaagacacaacgtgttttgcaaaaaatatccaaacgtttgcaacgacacgacaatacgtatttcttgcttatttccaagggtatccgtatactgataactgttcacatttgataaatgaattgacgttgcatgaaaatcatgacaacgtttgacttttatttatctgtgaagtagggtattctcgaaccggttcgaacccgacgttgcggtcacggtcgaactgtcgttgaatcactcgaggggtgttccccgggtgtacccaaggaggagaaagtgggcatgaaatgattacgatgtccggcaaggcaattcgcaggtggtgggcgctgtttgcgctacccacgttcgcggctttcgtcattggtttcctggtgccgttcgccatgggcgtgtacctgtcgttctgcaagttcagcacggtcactgacgccacgttcgtgggcgtgtcgaactaccaaaacataatcacggatccggagttcctgcacgcgctggtgtacacggtcctgttcacgattgtgacaaccgtggtgatcaacgtagtcgcgttcgccattgcgtacatgctgaccaaggccatcaagggctccacgctgttccgttcggtgttcttcatgccgaacctaatcggcggcatcatcttgggctatatctggctactgctgctcaacggcgtactggcgcactggggtcgttcgatcacattctcgggcgtgtacggcttctggggcatggttctgctgacctgctggcagcaaatcggttacatgatgatcatctacatcgcgggtctgcagggcctgcccggcgatgtgatcgaggctgccgcggttgacggcgcgaactcccgccagacgctgttcaacgtgacgattccattgatgatgccgtcaatcacagtgtgcacattcttgacggtgaccaacggcttcaagatgttcgaccagaacctcgccctgaccaatggcgccccgtcaaatagctccgagctcttggctctgaacatctaccgcacgttctacggacgcgccggcttcgagggcgtgggccaggccaaggccgtggtgttcttcatcatcgtggccgtgattgccctcatccagaacaagctcaccaccagcaaggaggtccaagcatgagcgacaaggtcaagcatcctgtattctggacggttttcctttccatcgtctcgctggcatgggtctatccaatcgtgctggtgctgatcaatagcttcaagcagaaggcttacatctcgcgcaacgcattctccctgcccaccggcaaggccttcgtgggactggagaactacatcagaggcatcgagcgcacgaacctaatcagcagttttggctggaccgtagtcgtcacggtcggcgcggtcctgctgatcatcgtgtgcacgtcgatgtgcgcttggtggattgtacgtacgaacaactgggctgcgcgcctgctgtacacactgttcctgtttaacatgattgttccgttccagatggtcatgttcacgctttccaagctcgccgacatgatgggcctgaacaccccatggggcctgtggattgtgtatctaggcttcggtgcgggcttagccgtgttcatcttcactggcgtggtcaagggcatcccgtccgaactcgaggagtctgcgatgatcgacggcgcgtcggtaccgagaatcttcttccaaatcgtactgcctatcatgcgcccgagcctgatttcagtggcgatcctgcagacgatgtggatctggaatgacttcctgctgccgtacctgacgttggacatgcgccgtttcaagacgatgtcgattgcgattcagtacctcaagggtggttatggatcagtggacatgggcgccatgatggcctgcttggtggtggcgattgtgccgatcatcatattctacctgtgctgccagaagtacatcatcaagggcgtgatggccggcgctgtcaaaggctgattaacttcatcgcatgaggggtgctgtcggaattttcgtcggcaccccttttcttcatatccgcagaacacgcacgtcaaccgttgcaaacacttatgttaacgtgtctctagcagttgtcatgacagcaatgtcgttcgtcagtggaggattctctatgaaagcgagcatccaagccgtggccgccgaagcgggagtatcgatttcgaccgtctctcgcacattcgccaaaccgaatctggtgctgccggagactcgcagcaaagtgatggcagccgcggaaaaacttgactaccgcatctcccgctcagcggccgcactgaaaaccggtcaatcgttccgcgtcgcgctgttgatgagcgattcgatttcgacttggttcaattccaatacctatgccggattggattccgtgctgcacccggccggatatgacatttccatcttcgagatggccgacgcgcacgaccgccatgagttcttcgcaacgttgccggtacgccgcaacgtcgacgcggtcatcgtaaactccttcaacatcgtgcccgaagaggtcgaaaaactttcgaacatgaaggtaccgatcgtcggcatcaacattccatcaatcaacggattcaatgccacggtgagtatcgacgaccgtcaggccatgcatgttgctgtgaagcacttgttctccatgggccaccgacgtatcgcttatgcgtacgagacatcaaatgacaataaccagaacatggtcttcagcgcagaagcgcgtctgcatgggctgatggaaactgccgaagagcgaaagataacggtggaacgcatcgcaatccgcaactatgaagacgccaccaacactattctcaattcattgctgaccatggaccccgcccccaccgcactgtattgcgaaagtgacgagctggcattgcctgtcatctataagttgtgccagtacgggcacgccgtccctcaagagctctcggtcatcggattcgacgacgtaccacttgccgcaaagatcggcctgaccacgttgcatcaggatccgttcaacatgggcgaaaacgccgcacgtaagatgctgagtgtcatgtccggaaaaacaccgaaaccgctgcatgaaacactacaggcacaactcatgatgcgtgaaaccaccgcattcatcgactgaccaagccactactacctcgccaaagggttctctatggcacatatgctgtaactgactgcccaaccggctatgaatccgaaatcaccattcagagtgaccttggcgcatcggcatcatcatcgaatctctaattctgtccggaatggcaggaagatggcattttcgaaaaccacgacacgcagatagtcatgacatcacgaccggaatccgaccagcaattcaccaagaccctgcaggatgacctactcatcatcgacactccggcccttcagcctgcctatggtatgcgccccctcagcaaagaaggtttgagtgtagtggttaaaggccctgcaccaagccagatgaacacatacgcattacggtgaggttcagcatggcaaatcttcgcggtaccggtgaagctcaacctgactagtcctatatcgtaatacgcaaacggggcttggcagataaaccgccaagccccgtttgcgcattcgatgagactctattgcgctcaatgagtggtcttatattcagacgcccaaccatccacaaatgcatcatgcacggtgtcccatgtaccggtctcctgcgcatattccaacatcgcgttgcccagcgtcaacacccactgagtgcttggcaacggatagatcacaatatcgtacttatctgccttggcataggcatcgttggcgcgatgaatcgggttcttggtctggtagccggccttcgcatacgacttaaacggtgtttcgaaacccgcctcattcgtgatgatgtcacgtgcctcatcatcgttcaggatgtagtcaaggaactgcttggtggccttctgatctttttcagaggcgttcttgttcatcgcaaagtacaggaagctcacggtcaggcctgcattctcctcacccttcacacccatatagatcggcaatacgcccatatcttcatcggcgacctcttgatcgcgaatctgcgaatagccccaagagccattctgcaagaacacggcctcacccagtgcgaactcggagttggcgtcgtccatggtggcactggcgagctgcgtcttcggaatcgtggcgtcgttgatgtacaggtcgaaaatgttcttgaagttcgatacgtacttgtcggaaatggtggccggcatttgcgtgacaccctgatcgcgatactcatagtagacggagatatgcgccagttgatcaccgaaacgtttgatggagctggtgtcgaagccggcggaggtgaacgcacctttcacgcccatctcatccttatgtgcttgtatttcatcggcaactgtcttcagtgtcttgaaattgttgatgctgtcaaccgacttaatgcttgcccaggaagaatcgaagtacttctgcagcagcttcttgttgtagatgatgccatatcgttccatgacgtagggcacagcaccaaccgtatcgccatccttcagcgcatagtcggggttctcctgatccttgtagatgttggttcccgacatgtcggcataataatcagtccaattcagaaagtcgttgttgtcgacatcgaacaacgtaggcgcctcggatttggccagctcactcttaagcgactgttcgtaggtgtcggatgacgcagtggcgatatcgacctggataccggtcttcttggtgaacttttcggccagttccttgaactggtcctgttgttccaccttcatgctgagaaaatatacatgccctttgtcagcgttgacatttgagccgccgcatgcggagagcgcaccaacggacatggcgagcgccgacactgcggcaatggtacgagtgagtttcttcatgatctcctccaaaaaataatgattctgacagcgtcgtcagatgatgacaaacgtcgtgcatcgtgcgatatgtggtaccgaagtatagtttaatcgcttaagcaaaaatgagaggaaaagccgcaaggagagccgccgaggcgaaaagaaggtacgaaacgacctcgacgacccgtaatcagtcaaaaagaaatcagattggtcagacctccttcaatccgcgagcgatggagacattgcgcacctcaacgacgccgtcggtggcgaaaatgctcagcgactcgccggggcgctcatacatgcgcacgttcagtgccactccatccacatacaacgtgccgatagtgtcatcgacgatgagttgcagatgatagttacggcctgcctcgagcttgataggtcgctcaagcccgatgttcatgacattaaaccatgggaagttcggactgccttcgaacacatagcgattttcagctacggggaagatgaactggtatcccagcgcggtatcttcgttctcgttgacacgcaggccgaaggagcgagttccttctgagaaggtgatgtcggcttcgaacgagaacaaatcaccgcagccaagggcgagtaccgcctcctgtcgcgcaccagtaccatcgatggtcacattgccgacattctcgcgctcattgaatgcattccacacggtatcgggaatgcgcacaccgagcgtgccgtcttcgcgctgatacacctcgtgcgccacgaaagttccggcccattcgaagttgctcctgtcatcgcacttctctttggtgccgacccagccaaacaggatgcgttggccattcagttcgaaggtacggccggcatagtaggcactgccgtcgaatgcatcgtccgacggtgcaatccatgggccgtcaaggctcttggccatacgatagaccatcttgtgcttgtcgctgtattcggtgacgatgtggtaccaccagtcgcccatcttgaacaggtcgggcatttcgtgcatggtgtacaggtttggagcccagaaatcaccctcaaatttccagtccttgagatccttagaggtgaacttcacggtacggccggtctggcaggttttcggaccgattttacgggcaccaagaatcagcagatactggtcatgttcttcgtcccgaatgacccacgggtcacgccagtcatcagggtcatagccctcttgcggcgtaaaggtgatagcatcctgtgttttggtccagtggtacaggtcgtcactgaccgcatgcatgagcacctgcgcaggcctgccctgtgcgggataatcgcggttatagccggtgtagaagatgtggtactggccctcgccctcaaacaccgagcccgcgaagatgaattgatcctgtgcgtcatatgcaccacgggggattgccactccatgattctcgtagtttacgaaatctttggttgtggcaagatcccagccgaacggctctccgaacggctccgggttgcgattgtcccgctggtggaacaggaagaattcgtcgcccttgccaaatggcatgcagtcaccgaaccaagtgccagggaactggtaataaagcttcatatctttacctttcttcagctgctttgcctttcgcccggcaatcgtctgcgattaccttttgaaggaaccagtattacttcgcattattcagtttaagcgcttaaactgtttaagcgattaagcacaaatatagcacttaaaatcaaaatgtcaaacgattgacgcagtcaccttgcacaatgccgtttttccaccgtttcgtgagtgtttccacgagtgtcgcagcactacgacgaccatgctacaacctcttcaccgaatccctagataccgccggacattgcacaaaaatcggctcgaacgtcctcgtcactacatgttcatcaccatcatcctcattgcggccgcactgccgcaacaacgttcgcacgcccatcacaccgagctcatattgtggcagacccacggtggtcagcgcgggatgcatgtgcgcggaaatcatttcctgattatcgaacccaaccacggagatatcatccggcacacgtttacctaactcacgcaacgcatcgtacaaaccaagcgcagtgcggtcattatggcaaaacactgcggtcgcatccgtcgccatcaccttttccgctgccccgtatccaccttcttggtcagcgttcgcaggtaccaccagtgacgaatcaaaatcgatgccgaatgccgcaagcgccgctttgtatccttcaagtcggccaagcgacgcaggcgagggcgtaatggcgttaacgaacgcgatacgccgatgtccggcctcaagcaatagtcgcgtggctgtggccccaccctgaacttcgttcggcaccacagcaggaaatcggccgcgttcgtcatagcagttcaccaacaccgccggcaccttatcgagttcgctcggtggcgtaattgattcatgaacccacttcgagtagatgacgccttcgacctgatgctcaagcatgaacgcgaaagtcttacgttccacatcttttttaccgttggtgttaaccaccagcagaatcttcccgttacgccaagcctcatcctgcgcaccttggattacctgccccgcgaacggagaggtagccacaccgtcgctgatgaagcctatgatgtcggaacagccacgggccaacccccgagccaatgcattgtgatggtaaccgagcgaatcggcggccttacggactttgcggcgcgtggattccgggatacgcacattacgattgtcattcaccgcccatgaagcagtcgcgatagagacgccggccgctttggcaacgtcttgcaacgttactttcgccataccgtcccccgaccatcagactccggcttgttgacgtatttggcgaacgcatgttcgagaatcgggacgtgaagcataagcacgctgccatacccaagcaccaccagcaaaaacagaccctgcggcatgtagaaccaagagccgacaatcagccctaggaacgcaacatcgattatcgccagcgcgatggtcgacgcgacattagtcacgccgaagatgaatgcattggcgagggtgccaccaaggctattttcgaaacgagcctgtaacgcccagacccattcgaagcccatgatccatacgatggtgaaaccgaattttggaattagcaacggtacaatctgcagaacgacccacgcgtaggacagcactgccagcgccacaccgaagattagccactgcaccgtggacttcacaaaattacttttgaatgatctgaaataattggtggtgacgtgtccctctcccgcaagcgtcttgcgagcagcgtcgtggccggcggtcagcgcggcaccgacagtcacaagcggaatgctggtgacaagcatgagaatattgatccacacaccgtcggtcagattgttccaaccgcgcatgagacctgaatcaggtgacaggaatttcatatcgctcctttgtgcaaggccatgaccgccaacgttgtgttcaatcttaccaagactccgccatgtccgtgacaacgtaatcacaacacacccgtgatgcattggcaccattggtgatatcgttgtcattagctgttcataggcgaacaatcactagaacagggacatatcgggacaaagacgtaaggacaacatcatgaccgcgaataatgaacgtgcggattggtggaagcaggccgttgtatatcaggtctatccacgatcgttcaaggattccgacggggatggcttgggcgacatcgccggcgtctccgagaagatggactatctgcgggccctcggcgtggacgccgtctggctgagcccgttctatccctccgaactcgccgacggcggctacgacgtgatcgactaccgtgacgtagacccacgcctaggcaccatggacgacttcgacgagatgacgctcagggctcacgaggccggcatcaaagtaatcgtcgacatcgtacccaaccacaccgccaacaagcatcggatgttcctagaggctcttgccgcggggcgcggctccaaggaacgcgaccgctacatcttccgcgagggacgcggtgagaacggtgaacttccaccgaatgactggatctccctgttcggcggcccagcctgggagcgtgtggaagatggccaatggtacctacatatcttcaccaaggaacaaccagacctcaactggaagaacccggaggtacacgaggaattcaagaaaacgctacgcttctggtccgaccatggcactgatggcttccgtatcgatgtggcgcacggcctagccaaggatcttgaatgcatgccacttgaagagatgggcaaacgctatccgattcacgaatcgctatgccatgacggcactaacccgatttgggatcgttttgaagtgcacgacatctaccgcgagtggcgcgaagtgttcaacgagtacgatccgccacgcttcgccgtcggtgaggcctggtgcgtaccggagcatcagcatctgtacgcctcccccgaagagctgggacaggtgttcaatttcgagttcgccgaagccaactggaacgccgccgagatgcgtaccgccatcgaggagggcttggattcagccacacattccggcggctccaccaccacgtgggtcatgagcaaccacgatgtaccgcgtcatgccagccgttacgccctgcctcagatcaagacccccagtcatcatcaggtagccaaggactggttgctgcgcgacggcacctcttatattgaagaccgtgaactcggcaccaagcgctcccgcgccgccatcatgatggaaaccgggctaccaggttctgtatatgtgtatcaaggagaggaactgggcctgttcgaggtagcagatattccttgggatcgtcttgaggacccaactccgtacttcaccacccagcgttattatgaaaagggccgcgatggctgtcgcgtgccgatgccgtggatcgccgcggacaagccgacgccggcttcctggaatgagagttttggcgacggagcctcctttggcttctcccccgtcaccaaggtggatggtacccaatccgaacgcccccatttgccgcagcctctctggtacggcaatttcaccgccgacagcgaagcacaggatccggattcaatgttgtcgctgtatcgcgcagcactcgccgcacgtcaggacatactcaccgccacggcggatacctcctgcactctaatcgacgtaggcgatgagataatcgcctacacgcgccctgccgccgatggtcgcacattcgcctcctatacgaacttcggtaagactccagcttcactgccaaacggagagatcatactggcgtctggcgatgtatccaacgggcaattgccccaagacacaaccatctggatgctgctctaatccacacattgaatgctcccgtgttacccccccaatgaagcatcagcaacacgggagcattactgtcacaagaatctccctcggccctccgtctcgcagcgtctggccacggctgcgcatgcggccaccgaactaagcgatgggttgctgggacaggttgcgtaggttacatggcatgaacggagtgacgattcaagattatggccagagcagccggagtgtcagtggccaccgttccctgggtggcgaacaacaaaggtcaacattccagaatccataagaagccgagcacgcaaggttgcacaacaatttggatatcgccccaacgcattggcgaagggttgggtcagtgggctctctaaacttattggcttcatcagcgatggcgcgccccatgccggacaagtcattcgaggctcgcaggatggggcatggcatcaaggtatgattctgctgatcgtggacaccaatggtgaaaaacgttgaaccgcaggcctttgaatccaagatggaccaccagatagatagcatcattcattcatcttgggcgcaccggcaggtaactcctcccgaaatcttacgcaaaaccagagcggttctggtgaactgctctgctaggcacgctgaatttccatcggtggtttccgatgaaatcggcggcggtcgctcggcaaccaaattgctattaaaatcatgtcaagagccgtcgtgacacatattgccgcgacggctcttgactcagctatgctaaggaaacggtctgtctcaagcatccatgatggcagctaacgatttgactcgtggcaaatcgaacacttcgtcggtgtgcacgacacgtccatgctcatcagccagcggaatacgccaattcggatactgatcggacgttccaggctggttctgggtacgacgctcgccgacgccatcaaccagtgcggcctgtattagcaacgatggtgatttacgcagcatggcgtgcatggcttcaacaatctgcgggatgtggctgtccgcatcgtcagcttcctcatcggagatcagaccaagtgtccgcagacgattgagcatggcctgacgttccgcggtggccgatgcttggaaggattccaccgattcggtaagcagatggagccgctcacgcaactgtacatgctcgaactgcaggtaccctgcggtcggtggcagatcgtgcgtagtgacggacgctaacgcatacttgcgatagttggtcggatcatcgtatggatcgcctgcgttgggagagtcatccactcgtgcgaaccactccaccacggtaccaagcacaccatgtgaagcaagcaccttgcgtacatagttcggcactgtacccaagtcctcaccgatcaccaggccgtccgcacgggaggcttcgatggtaaggatggctatcatcgcatcaacgttgtatgtcacgtaggcaccgttcttggcgccttcgccctgaggaatccaccataggcggaacaggccgagtacatggtcgatacgcaccgcaccggcgtgagcgaacatggtatgcaccatgtcacggtacacaccgtaaccggtggcgttcagataattcggattgaacggcggctgaccccaatcctgcccctgttggttgtagaagtcaggcgggcagcccacggtcacgctaccgacagcgaatcgttccggattccaccacacatccgcacctaacgaatgcacacccacggccatgtcctgcatcaagcctaatgccataccggagttcttggcaatctgctgagccgccgacacttgttcgtcggcaatccactgcaaccagcactgaaattcaaccaaatcggcatgctcacgtataagttcggccacttccggcgagtcacgattggtgtcgttaaaccaggaagtttcccacggcgcaccccacacctcgaacgccacagaccaagcagcgaacgctttcaaatccggaccggcctgctccttgaaccgttcgaaggcagactgacgctcaacggaacgcggttgcctgaagatgattttcagcgcctgtcgtttatgacaccatgcggaattgatgtccatcggattcacatcatcattggcagccgacacctgcgcatgcagacgcgccacctccgccttatcggattcacttagatcagcgtattcggcgatatcctgcggacgaatatacgtgacattcaggaagcgacgggattccggcaggtacggcgaaggttccaacggcgggatcggcgcacatgcgtgaatcggattgatcagcataaagtcggcatgcgttttttctgcagcgtccttgaggaggtgtcgcaaatcaccgtaatcgcccacaccccacgattcggaggaacgtacggaatacatctgcgccatccatccccaacgttgcctatcggccaccgctttcgggaccggaatactggcaggtgcacaaatcagcgtcgcctcgccatatgcgtcgccagcattgatacgcaacgtgtgatagccagagggaatatcatctggcaggttcaatctcaatgtaccgtcattctctgctaataggcacatcgccagattgcctgcgtaggcggtaccgtcttccagcagcaggcgcaatgtaacgttccggcctgccggacgaatcggaatggcggtaggcgtaccgaggaatttaacaatggtcgacggcaccagcgtagtctgggtcttacgcacagttgcctcatatgatttcgtaaccgcctcatcggtggaggcatccacgccaagcgcccgcagtacggagacgagtacttcgtcgcgaatctccacataagcgcccaactgatcgatgtatgatgtcgaaataccgttggctttggctagctgaatcaacggacgtgcaagacgttcggcgctttcttcgtttctgggtgcagcgactggtgaattcggcatcttcgctctcctttgctggctgatcattgccagactgcgtaatcatatgaatccctgagcctgttatcactatcatgaacagatagtgcaacaggaatgtttctcatctttagaatatcgcagattgacatcgtttgcaataccaacaaacggcatgttgcggcgcttatggcgacaccacgtcaacaatccgcatccttggatattgttttatgacatacgtttgcactacgacgttttgcacactgcccgcattcatcgtcacatgagcggactagaacagtgcaaacagcgacaacatcaccggatgtaagatcagaatatgacgaacagcacggcaatgaaaatcgcgccgatgccgtaagccatgatgagcatggagttgtcgctgacgtcacagcatacaacactatcgatatgcagtaccgcttacatcgaactgacgtatttcctgcagagtgagcgacagccaatgcatggccctttaggttcgctactcgttgattgcccggtcattgtcacgcaacaccaactgcaccggcgcgtcggtctcacgtaaggtcaggcgagcatgcatgatttcatgcggctgaccgagagtctccccattaatgagtgtgagcgctttatgtgcggctttacggcccatcagaaacggatcttgtttcatggtagtcaggttcatgatatccgcatactgactgtcatcaaatccgataatcgaataatcccgcggcgtgagcttgtcataccgttccagtcgcacaatcagcggaatcgcaatggtgtcggtttgacaacagattgcatccgggaattgatcaagcgccaacaacgaggccaaggcactgtcggcgtagccaccatcgcgcggcacttcaagcaccttccagtgcaggtcgtggcttgtctcagcggtctgacaagcatggatgaaaccctgacgacgagcatcgatagaggcattaagcgaatcggcggcgcgcgagcagatgtacacgatgtatttgtgaccgagattgatgagatgctgcgtagcaatcatcatgccctcgtcgtcgtcaatgcatacggtggcatcgaaatcttcacgtcccggcgtattgataccaacgatcggcacacgaatgcgcttgagctgctcaacttcacgcgaatcgacggcgaaggaagcgacgaatactgcatccacattgcgacgtaccggcaaagtggtgaagaaccgttcgcggttctcagcggtatcgatatgctggaacagtgaaatgtcatagccagcaccatgcatgacatcatccaacccagcaagcaccctgttattgaaccaactggtgatgtcttcattcatcagcatcgccgcacgataggtcaggccagacttgagtgccgtggcggaacgggaaatgttgaaatcaagtctgtcggcggtttccaacaccttccgacgtgttttatcggataccaagtcaggacgcgtgaaagctcgcgacaccgtggaaacggagacgcctgacgctttggccacctcacgaatgcctactttggtcatgatgcccctttgctacttctcgtcttgcacggcacgcgacacattcgttgtgcgcgcgcgaacatatctacgtatatcatactgccaacgttgtcaaaaatgaaacggttaaagaagacaccgtacttcttatccacaattgcaaacgaatgtaaaccagcaggaatggatacgccgcacatgattctaataatgtataaatcactgtgattccagtgtgtaaaagtttaaggtaccgcgtagcgagtcgcatcgcctgctcatcgtcgatggaaacagacaacgtaaaggcgctttcaggcaatgcattaatgccgacaagcggtaggttcgcactttgcaaacgactcgcctcatcagggtctatgtcgaaggagggaatgattacggcatcagcgttgcggcgaatcggtaggttctcgaaaaaagtgcgcctgtcttccttggtggagatggggtagacggagatgtcgtaaccggccggattgaacactgcatcaaggccctcgtaaattcgtgcgttgaactatgacgcaaagcgatcgttcagcaatagggcaatacggtacgtccgcccggcctgaaacacagtgacggagtgagagatcgaaaaattcagttcatttgcggcagccagaaccttgtcacgtgtcttcttcgctaccacgtcaggatgcttgaaagtacgcgaaaccgtagcgatggagacaccagccagctgcgccacgtcttcgatattggcctgcatgcgcactccttgcatatgattagcgccgtcttacggcgattgtctcattatatgctgaatgcgtttacatcattgtcataccgccgttatgacggctgattgtgccagactgctgcaaatgccggtaggcaaccgaccttccatccgatatgtcttcagcagttccaacgctctatgacattgtcacccttgtactggctcaggatgcagtaatgcgcggtatcgagccgcagcagacgggcgaaatgcgggtcgacgcccaaccattgcgaagtaaggatgcgcagaatatgcgcatgagccaccagcagcacatcgtggccgacgttcagcaacggcaatactcgttcgatggcgtcccgggtacgcgcggcggcctcctccacgtcctcgcccggaccgttatgcaccggaacctgctcgccggacggcaatgtctcaatccaatcgccttcaagtccggggttcagcgaacgcggaccatcccgccatacgtcccaggcgaaaccgctggcctcgctgacctgctggcgtgtgcgcccctcggcgcgaccgtaatcccattcggcgatctcgggcaggatcctgtaatcgccgtaaccggcgagcgccgcggtctggcgggcacggcgaagcggacttgcgaacatgcagcctggatcgaaaccgttcgggaaggccgaacgcaaacgttctcccgcggattcggcctgtagccgaccggtgtcggtcaatggaatatcagtgcgtccggtatgctgaccggattcgctccacaccgtctgtccgtggcgcaacagcaccaagcgtccgggcgcaacaacggaagcgtccttgcttccaacatgattttcagtcatatccctactctaaccgaccccgcccatgaacccctgcacttgctccctcgtgtcttcggaaatcgcaacatcattccgctacgcgcttcgcccatccggattggcaggaaagcacgtcgatcacgcattactatggaaccatgagtgaaacgccagatctggaatctacagcggaccgtgtggtagcggccctgcgcaacatcgacgggaaagtgaacgccaagcgcgatcagagactgaacgatcccgattccttcggtgacaaaatcttcaaattcgccatgcctacgctagtcggactggcgttcggcaaggtgttcgagatggcgtggaagcagagcgttggccgcaaggcgacccttcccgacggcaccaccgacgcacgcaaggacgccatcctcggcatcgccttcgccgtcatttccgcagccttaggcgcactggtctcgcaactgtccgaccgcggttccaaggccatcgtcaaccatcgccacgccaagcgcaggtagcacgatcatcaccgatcgtccgacttgccctccgggaagatgatcttgtatacgaagaagtagatcaccatggacacgcctccggtgatgaacgtgaccagcagattgtatacggctggatcgaaccgtacctgcgccaacggcagccacaggccgttgatggcgttgcagaacaatgagatcagcacccatgcgatgaagtaccacagtatctgatatgccacgttgccatgtgatttgaacgtcacgttgcgttgcagcgggaagttgacgcactgcgccacgaatgatctgatctcatagctcaggaaatatccaaggccaccgccgatcaccacttccccggccgcattgcgcgccaccccatagccaagcacattccacgagtagtcgatgcctgcgaacgatatcggaatatgcggccacatgaatgccgtggaggccagcccctcgccaaacagatacggcaggaacgtgaacaacgcatattgcagcacggtgaccgccagactgaacagatagaacacgcctatctgccagacccattttgcggccttcggatgattcctcgcaaaggttcgccaaggattgaccgccattatctcacctcgattcgagccgtggcctcaccgtacggactgcttgccttcacgctgaggattcccgtctcgcaaggcctgatgatggccatcgcctcgccgtagtaggtgtcggcggtatcgctgcgatagctacgctcgtagtatgggcaggcgctgccaaaacctaggatttcgccgttttccacttcgatatgcacgtcacctcgcagtaatggtttgacggttcccgcagcgtcggcatacatgaaccgcacatatgcgagcccgtcaccgagcgcgatgcgctccgcttccggcacggcatgcaatctcgtttccttgcccgccgtggccagtgatgttctcgcgatttccacgccgtcggcgtcatacgccaccgccgtcagactgcccggcctgtagacggccgtgaatgtcacgcgagcgtcacgtccgacacgagccgacccgatttcacgcccgttcagcaagagtttcaccctggcggcacgcgcatatacctccacttgcgtgcgttcaccttcctgaccgtcccacgaccaactttcgaccgcattggtcatcttccaggcggacggcgaatgttcacggccaagaccgaccggcaccacgccgatcgcaatcggtttcagaccgaatgcgacctgagtgtatgaagcctccgccaaaggcttgccggtcaggtcgaatcgaccggcgcccgcactcacccagccaagtgatccgtcgaagttcttggcatattccgcatactcctgcgagccgataccgacttccccgagataatccataccggaccatacgaaatcaccgatcagccgcggattgctctgcgccaaatcccagaatcgcgccgcatccgagcagaaggtttccgagccgacgatcacgcgattcggatatctgttcaggtcatgcctgtatcggcggatgccgtagttgtatccggcaacgtccatcacggcgaacgcgccgcgcgtcttccaatcgcaaggaggcaaggtcgcaccgaacttcatgaagtcggctcccatgatgcctgcgagccgattgaagaattcgctgccgaccgccttcttcttgccggaatgttcgatttccttcatcgctttttcgtcggtatacacgccaagtcccatggatgacaagaaattgaagaagatattgacgccgcaggtcactggtctggtcgcatcgagcccatgcagatattgcgtcatggcatcggtcagagcgatacctcgcggctgcgcggtttccgacacttcattgccgatcgaatacatgatcacgctcggatggttatagtccttggccaccagatcagccagatcatcacgatagttcgcctccacttcagtgccgtagtcgtagcgggtcttgtggatgtaccagccgtccacatactcgtcgagcatcaacatgcccagtcggtcataggcgtcaagcaacgccttggaacaaggattgtgcgcggaacggatggcattataaccgccgcctttcagcaacgccaccttgcgttcctcggcagccggatatgcgcatgcacccagcagtccgttgtcatggtggaggcagcaaccacgcaggatcacacgttcgccattgatacggaatccccgtcgcgcatcacattccaccgtacgcacgccgaagacctcacgttgctcgtcatcaccgaaccgcaccacacaggtgtagagattcggctcatcggtgttccacaggcgaacatcgggaatcacgcattcctcatgcatgagattgccctgcccatcgagccgatccgacaacgccttgaattgcgccatggacctgccatcgacatcaagaacgctcacatatacgactcccggatggctggtgcgtacgtcgaccgcgatgcgtctggtacggtaatcgaccgtcgttatgcgcacgccgtcgggcatgatatgtcgctccggcatgacacatagccataccggacgatagatgccggtaccggaataccagcgacagttcggctggtcgctgttatgcgcttcgaccgtcaacacgttgtcgccttcggctatgtactcgctcagatccgcatagaagccggaatagccataatcatgggagacgatcagcctaccgttcaatcgtatgcgggcattacggtagacaccttcgaactcgagcagggtgagatcaccggaagatctgcgaatgtcggcggaagagaaatgcttggtgtacaggtagtcgcgagcgctgtaccagccgctgttcactccggatgggctgtcggcgcttttcggatcccactgcatggcgtcgtggggaatggtcaccggcacttcctcggcctcggatgcggccggacggcacatccagccggtattgaatgggattctgttcatgatggtgctttcaaagacgttcacgaaggaaggtcgtcattcgggcgcaagaacgatcgtggcgccccttcgcccgaacgacgtctgacaaatgacggagggccggcagcctacttacgcttacgcatgaacgacgacaccatgagcatcagcacggtgactgcggtcagcacggtcaccgtcatgaccggaccgaacaggctctggtcgccgaacatgttcagattcatgaaatggccgacgaacgtatacatgcattccatgacgaacgcacaccatgcgatcatgcctatcgccggcgttacggcaatcagccagtcattgtcaagaggtatggtcgcggcctgcgcaagcacgaccaacacaagcggtgcgatgacccacacgttgtatgagccggcggcaacggcatacatggcgtaggcaaccagtgagacgatggccatcacaccggcggcgagtcctaggtaaaagccgatagttctgttggagaacatggatggagttctgctattcataatgattcctcactttcccgtcgcggtttcggattcgaccttgaccgtttcccgcgcattcttgcctcgacgtccggaacgccacatcatgtaggcgcagccaagcgtcatcaacgcaaacgccgcatccacaccgaagatcgcgtaacgccaccaaggggtgactttgaccactttggcgttggcatccaacccgttgatcaggctggtacgagtcagcgcatagtggaagttcttcattgaggtgcgcagatagccgagcatatcgccgtcgtcattgtcttcgatctgattcttgatgcctgcggccgcggtattgcccggatcgatgcagtaggtggtcacgcctgctgccaatgatgacgggaaatgcgacttgtaggagccgccggccacgccgtcggtttcgatcatgcccttaaagccccattcgttgcggatcacctgagtggtcagcgcggtgctggctgaggaccagaccacaccgagtctgttgaacgacatcatcaaagcggtggcgttctcgttgctgacgatgccttccacgcccttgagcgcaccctcgcggaatgcctgctcgttgaagaacatgttcagaccttcgcgatacagctcctgatcattgcctgcaacatgcttgacaccctgtgcgaagcctttcttctgagcagctgaaagttccacgaggttgtcaaggtagaccatgatgctgtcttcggaccagtattcgccattgcgcccgccgaacggagtgcggtgcagattgccgccaccaccccatccgaccggggtcttggcatacagggcttcctcaccgaccagttcgccacgacgttgcatgcgtccataatcccaagtgctggcgagcacattggtcgccggatacagggtgacgtcacgggcgtcaccgtactctttggcgtaggtattgccgccgacgctggcggtaccgtcaccagccgcatacgccggtcggttcacggaagccgcttcggccgtgccgaacaaatcggaaagctgggtggtcatctcatcgatggtcatttcgtcaagatatttgttccaggtctcgtcatcgttgtaatcgacgtctttcatcatcacgaacgtcagaccattgtcggctccctgcgtgtagtcgctgacggacttggaatccttggactgccgatacagatcacccttaagcagttcgatcatcttgccggtagcggtcatcttgaccggttcggtcgggaaggtgcctttccaatcggaacgggtcagataggtgacggcaccatccttccaatagttcgcgtcggcatcctcgaaccggttggtgacccgttcgcccgcatcggatttggcataggtcttggtgtcgacgtcgtcatacgaccaccggtaggttttggccgcatccccttccaccggcttgccatcgaagtcggtcataccagtggcgttttcggccgcaagtacattattcaaagcatcatgcgcattgtcgccaatggtgaaatagtagtcaccggcgctcagaatatagcccttggccttggtgtagtcatagctggccaacaggtagcggtccaccgtaacgtccacggtttcggaagcacccggctgcaatgtcttggtacggccttagccggcaagctggatggcggatttctcgaccagattcttccgctcatattcaccatacggggtctgcgcatacagttccactacagaggcacccgcaatatcaccggtgttcttcaccgttaccttggcggtgaattcatccttgtcacggtcgtagctcacaccgtcgagcgtctgttcaaaagtggtgtagctcagaccgtacccaaacggataactgacttcgtccgcatagttccatgccgaggcaccatgtgaagctccgaccgagctggccgctccgctgcccggattcgtcacggcgtccgcgtagcgggtctcatagtatttatagccgacatagatgttctcgggctgtacggtcacattatcgatattgaccgtcttatcgctgactgcggcgttcacttcatcgacgttcgtccattggtttgagttctggctggaagtgtgcgcggccggcgacgacatggaatcgacggcatacgtgtcggtcaaacggcccgaagggttggccttgcccaccaacagattggccactccttcgaaaccacgctgccctggattgccgatccacatgcaggcatccacaccgtagtcatcaagccagccgacctccatcggaaaggcggaattgagcagcacgacggtcttggagaacttgccggaatccttgatcatccgcagcaggtccttctcgtcctgatgcagactcagagcactgatgccctccggatccttcatcatcatctccttgtcttcaccgccttcacgggcaagcatgacgatggcgacatcgtggtaatcgtcctgccagctggccttgagctgatcggtatagaacgatgccggctcctcgccaagcaccggggcgtcattcaacgcgccattcgaacgtggatcgccggaaacctgcaggttgttgctggccacacgcttggtatcgctcttcgaataggcgtcaaacagagtgttgttcaccgagaaaccggcatgttccagtgcggatttcagatcaatcacatatttgccgatgtcggcggcgctgttggcgccacccgggctgtagaccggctgcaccacggcgtggccgaacaacgtgacatgtttgtctgaggcaagcggcagcgtgccgtcgttgttgcgcaacagcaccgaaccctcctcctgctcaagcacggactcgccgtacgcgtcggcgatgagcttctgtagattttcggcattcaagtcgccatattcgctggcgtagtacgtagtgtttccgccgccttcaccggcgacgattctcgtgctggacgttcccagcgcggagttgatcgttcccgcatacatgtacgagcattgcgtcccacagatgccaagcaccagcaatgtgcctgtcaccgatgtgagccctcgccacagcagaccggaattccctttcatctcgactccttcgttgtcacatgttgataccgacatcaatgtcaattccatggtgcgcggcacggccaccccctaccttcccggatggcgtaactggtcattcccaggggcataactggttctttcgccattcgacccgagcatgtgacgtttcctataatggaatccgtcgcaatgaggaggcatgaacaccgtgaggatcgcaatcatcgacgatgacgccgacgaacgcaagaccctgcaggcatcgttcgaacggcttgcgcaggagagcggatccgcaatcgtcatcattgaatttgccggcgccgatgattttcttgacggctacgaccgctccttcgacctgatctgcatggatatcgacatgcccggcaccgacggcatgtccgccgcacaacgcctacgtcagatggacgccgaagttccactggtattcgtcaccaacatggcgcagatggcgattcatggctatgccgtacatgcgttggatttcatactcaaacccatcaactactactccttctccatcaaaatgcgcggtattctggcactgatcggcaatcgtcgtaggaaatcgctcgttttcccgacgacggacggttttctacgcatttcatccgacaatctctactatgtggaagtgcgtgggcaccatctgtccttccacaccacacaaggcgtcatccggcaacgtgactccctacgcaactgggaagccaaactggagggattgccgttcgaacgctgcaataacagctatctggtcaatctcaagcaggttacggccgtggccaaggactccgtgcaggtcggatgcgactggctgccaatcagccgaaccaaaaagaaaccgtttatgaacgcactcaccgaatacatgggaggcaccagcgtatgatcgaccacgcctggctgcaggtttcctacatggcacagatcatcgtggcctgcctactgttcatgattccggtcgcaaaacgacgtcgtttccccgcacgattcgcttcatgcaccattgttctgctaatgatcgcctatatgttcggcgccgccgtcacggtacccgacaacctgctgttggccatactgtattggcctgcattcgcggtcatatgccttcccgcagtggcgttgtgtctgcaggcgggattgtcggaagtactctactgcaccatctgtgcgaacgccacgcagcatgcggccaacgaatgctatctggcgctcagcatcgcactcggacgcacaacgccgatctgcccacgctcctcaacggactgttgaccacggtgatctatatcgccatctacggcgcgttcttcatcatgtttgcacgcaaactcgcagtgcatggacattatcgggtgaatcgcaatgacctgttccccatggcctgcattctgctgttcgtgtgggtattgggcgtgttgtgccatgatgatgtctcgctccatggcgtggtctaccacatcagtgacgcattatgctgcttttacatcatgtgggctcagcgcagcaatcatgacaaggccgaactgcagcgcgaactcgacggcgtacgatacacgctgctgcagcaacagaagcagtatacggtcagccaggagacgatcgacatcatcaatcgtaagtgccacgacctgaaacatcagattcgcacgctgcagaccatgcaggaaagcccggagcgtgacgcatacttcgccgaagccgaacgggcgatcatgatctatgacacccgcatcgacacaggcaacaaggccctcaataccgtactgatggaaaaaggcctgtactgtcaatctcacgatattcaactcacctgcatgccgagcggcgattcactggacttcatgcaggtcgcggatatctatgcactgttcggcaacgcgctcgacaatgccatcaacgccactatggaactgaatgacccatccaagagggtaatcaacgtacgcttctcatcacaaggcaacctgatgctgattcagattcagaactatcatcagcgtcggctgcgttttcgtaatggcctgcccattacgacgcatcaggatgccacccgacacggattcggcatgaaaagcatgctgcacacggtcgaacagtacggcggcaccatgcaggtggatgataccgacagtgtgttcacgttgcggatcctgctgccgaagaatccggaatcctctaccggctgaaccaaggcatccttgcgtaatcctgcaaaacggacgaaaatgggtgacatgagcaatcttcttcacaatgccactgttgacactctgctggaacgtcgttccatccgcaaattcaagtcgaagccgctgggggatgatgtaatcgaaacccttgaaaccgttgcacagcatgcggcgagcagccagttcctcaatgactggtccgcaatccgcgtgaccgatcccgcagccaagaagcgtctcgccgaaatcggcggacagccgtatatcgccaccgcgccactgctgtatgtgttcgtacttgacgaacaccgcaatgccgcaatcgcttccacaaagggcgtagataccacttccgacacgtttacgctgaatggcagttaccgctactcacaggcccagaacgatgccgtactggccctgcatgcgatggaaacggccgcatactcactcggccttggctgcgtgattcgcggctcgctgctgaatgacgttccggcgctgatcgatctgctgaatcttccggaatacacgtaccctgtgctgggacttgcgatcggtaagcccgatcaggatcctgcacttaagccgcgtatgccgcgttccatgcagttctttgagaatgagtatccgccgaacaatgagacgttgcttgccggtttgcaggatttcgacgaggaagtgcatcggtattacgatttacgcaataccgagcgcccggttgatacgttcagcgatcagatcgcatcaaatgcggtcgatcccggtgtgaccagcaagaccgtggctccaaacgccaagcgccaaggcttccgcctcgaacgctgacggaactactacttgcggcgtggtttgtagccttttttgcgggaatgcggtttaatctgctgattgaaaggcacgtacgtgtagctggattgtggatcgcgatgcgtgagatgccaagttccgcagaattcgcaccgatagacccaaagttcagtgccgcgttcacgccaactttggtcggcggcctgctgggctgttgctttgtcgtgatacatgattttgttcgattcgacacagcgtttgggtacgaaataatgcatagttcttcagtctattcaaccatcggataagcgcaagaggctcccctgaaattcctgaaatccctcggcgttctaggtctcccggcgcgtggaataatccggacgccgagcaacgggaaaggcccgacgggaacccccgggcaacgtgctccggccggctggccggcacaacaaagcataaaaaaatgggggttcccggagccgaagctcgacgggaacccccaacgaaagaatgcggcggcgtgctactctcccacaccctctcgagtgcagtaccatcgccgtgccaggccttagcttccgggttcggaaagggaccgggcgtctcacctgggccatgatgatgagcaccatttcacagcacaatcccgctggaaaaacctcaacatacctcgcggcaggtcaacatccgggcgtgtcgcacacgagacgaacgaatgacagaaaggtacaagacaaacagcgggcaaaacatccagcgggaacagacacaacacgactacgcctgacacacatccagcaacgtcaattcgtccgaccaacttacgccttgccacacaacctgcgagcgactccgtctaccagcgcttgccacagcgcttgccaccattgccggacctgccaccggcgccccacggcccgcgcccctcggcatgcagcacacccagatgatgcttcatggcgaccagcatgatgtgcgtatcttccaagccaagatgtcgttcgcttttggatgcatccaacgcgccctgacgtttggcatacgcatccaacgtattgttgccgtgcggatgctcatcatcgggaatcgacccctcatcccaacgacggctcatcggcaatgtgtcgatgatcgtgatattgccggcacgatagctttccgcatatccggcgacgttcagcatgaaaaagctatgctcgaaccgggcgttatgcgcaacatatggctgctgttcgagtcgttgcagcaatccgatctgagcttcgggccattcgtcgaacagacgaaagtccgcgctggcgcgatcgcgcacgtcaataccggtaaggtcgagaatcagaggattgccaagcagcgcattctgcgtgggaacgccgaaggaaagacgtgcctggccatatgcatcgccggtctcgtaataatcctgttcgtagcggtagcccgcgggctcgccggcaggacgaggcgagatcatgttcatgaattcgaatccggcatcgatgatgtacacgcgagccggatccgtacccgtagtttcgatatcaatgcccatcaccgtgtcgacgtcacggccgggaaggtaggcgtcacgccaatccgactttttgtaatccgccaaacgtcggtcctgcgcggcttccgccgagtcagcggaaccgccagcggatccgagggaaccatagtcgaacaccttcgagcctcccggactcgtcaccccgctcaaattcgcgcgtgacatggcgtaatcgctggcacgcttctgttcacgttccgcggcacgacgttcggcacggccattgacgatctgcgcggtacgatcctgaatatcgttaagattcacgaggctttccgctccggcaacagactgcagcacgggcactatcacccgctcccgccgctcttcggcaatcgtccacaatcccatcgcagcaccaatgcgccgcaacacggcaatttcgtcgcacaacctacggttcgcataggcgagcgcgcgaggcaaacggtatgaagcgatcagacggtcgaaatccgtcatgaaggtggtattgcattgcgcgatgatggattcgagccggtcacggaccgctaaatcctttttcagcagattatgcaactgttggacggatagtaccgaatcctgcatgggatccgttttctccgaggtcgacgaaaacgtggtacccgcggcattcagaacggcgatcaggtcgatgccttggcttttggcggctccgatgccgcgttccaagtcgagagacatgacccaatgccagtcgatgcgctcattgtcggcgtttttcggcatcgatgccgaccattggctgatgtcttgtttggcttcggtaagccaggaacggcccgtctttgcttcgttcatactttgcatggtagccgagagggggcgcagtacacgtcggcgcgtacaaaaaaccatgatgcttctcggatagcgcaatcttaagttttttgagattcgaaaggttatcttgggttcgttttatttcgttgattttcggtaagagaaagaacaatgctacgaaaaacgattatgttcaccaagcattcgtcgtcaggatacgatcatgcgcgttgcagacggagcacgacgtcgcgtacgaaatcattccatcgcaacgcgaacgccgatattgtcgataatgccgcgaaatgcaaacatggttacgctcatacgtgcgtctgccgtggggagtgtgatgcgtgcgcgcgttgcactggttatgcgcatggtggtatgacgaaaaaatgacggtatgacaaaaagggagaggcctgtgggcctctccccctgcaggatattccgcggattgcgcaacgataggattccgtgacaatcggattccgcagcgtttttcgccgcgcatgtatgcgatttgcggcgtgcgctcctggtttacagttcgaatccgagttcggcggcggcttcggtgggaaccggatcgtcgcaccagaaatcctcaagattctcgttggtggcgaggctgcggatttccgccttgtcgatatacagttcgccgctcagatggtcggtttcgtgctggaagatgcgggccggccagccgtgcagatgttcctcatgctgtttgccatcttcatcctgccagcgggcgatgatgtcgagccagcgcttgcgtaccgcctgatagccgtcgaagctcaggcagccttcgtagaagctgcgggtttcggtgccgatcggctcatagctggggttgatgatgacgtggaatgggaattcggccgcttcacgcgggtcatcgtcatcgtcgtcgcgcacatggtcttccaccacggcaagcgccagtccgaggccgatctgggttgcggcgagacctacgcccggcgcttcgatcatggtgacgcgcatggtttcgatgagcttgtcaagtgtcttgcggctcagttggccttcgtaggctgcggtctgctggcgcagtaccggttcacctgcctgcacgatgggaagcagctgttccttgccgccggttttgatgagtttttcgacctcgcggttgagctcgaggttgactttcgagttacgtccaaacatggggttccttcgcggattggttcgggattttggattgccaaatactgtgtatcggcggtgtgattacaaggcgagttcttcggccacgactttagcgagacggtcgcagacctcgtcggcctgctgctgggtttccgcttcagccatgacgcgcacgagcggttcggtgccggagggacgcaagagcacgcggccggtgtcgccgagcattttctcttcgcgttcgacggccgcctgcactttggcgttggttttggctgcgagcttgtcgacgtttggcacgttgatgagggtttgcggcagttgcgggaagtcggatgcgagttctttgagactcttgccggagttgaccacttcgttgcacaaggtcagtgcggtgagtgtaccgtcgccggtggtggcgaattcgcggttgatcacgtggccggactgttcgccgccgagcgaatagtcgccgcgcagcatttcctcaagcacgtaacggtcgcccacgccggtttgcacggttttgatgcccatggaccgcagggcgagcttcaggccgaggttgctcatcactgttaccacgagggtgtcgtggttgagtttgcccgcgtttttcttggcacgtgcaagaatacccatgatctgatcgccgttgaccatattgccttcgccgtctacggcaaggcaacggtcggcgtcaccgtcgaatgccacgcccaagtcggctccggaggctttgaccatggcctgcagctgttcggggtgtgtggatccggcgttcttgttgatgttgtagccgtctggcgaagcgttgatcacgatcacgtcggctcctgcgcggcgcaacgcttccggcgcgaccacggaggtggcgccgttggcgcagtcagccacgactttcaagcctttcaacggtgtcggctgggacttgtcaggcccgatgggggcgattgtggataccagatggtcgatatacaggttggttgcggttgccgtgtcgtggctgatacgtcccacgcctgcaccggtcgggcgttcccaatcctggccgagcacgttttcgatttcgtcttctttggtgtcaggcagtttgaatccgcctcgtgcgaagaatttgatgccgttgtcgggcatggggttatgggatgcggagatcacggcacccatttccacgttcagcacggaagtcaggtatgcgacacccggagttggaataatgcccgcgtcgatcacgtcgaatccacctgcggacatgcctgcggacagtgccgctgcaagaaaatcgccggaaacgcgagtatcgcggccgaccagtgcacggcgacgaccgtcgaattcgcttttgtctccatcatcgccaagcacgcgcaccgcagcatcgcccaaatccaacgcaagctgtgcggtcaaagccctattcgccaatcctcgaacaccgtctgttccgaacatacgtggcatgagtctcaagtcctcgctatctcaagttatattgccgtgcaccatcgtactcaacgggttcaccattcaacaaaatagtcaacagcatgttgcgatacctgcatactgcagtatgcgatgtcaggcaagccgcagtatgcaacgtcgtgagatttccgcaatctcaagtttcttgcgatctcacttccatcctccgattccgaccggccgggtcattatgggtccgaaagacccattgtccataaccgttatgggactttgtttgggatggcttgtctagaagcaaacaagcccggactggcagcgggataagtcacgccgtcagtccgggcttatgatgcaatatcacaagtgatatcagaagtagctgccaaaaacagctactgtagtggtgccaggaacggcatcagagggacgcgttgaaatcgcgcaccttgagcgtgcggtgcgacgattcgacattgccgcgcacaatacgctgcaacgcgttgtcggcgtccgcatgcgaagccagccaagcatcaccgagatccaccagcgtggccggatcggcatagctcggatacaggccttccagcagggcctcagccatgtggaaggtcttgttcttccaaatccagtcagcaacctcgaaatacttggccgcatacggttcagccaagtcggcacgtggagtggatgcgaagccgcgggccacggattccaactgcatgttggtcagctcgtcgttgtgcaaagcctcgttccaagcccattccttggcttccgcaatgcctgcgaccgcacgtgcacccaatgcgaactcacggttctcagtggtttcgcgcttggcaagttccgcgtcgatgtcgctctggccaatggcgttaatcgtgctcaacgcgttgatgatggtccaacggaaattattgtcaatctccaagccgtcaagcttcacggaaccatcgagcagacccttcgcattcgcttcgaacgcagcatcgcccggctcaccataacccaagtaagcggtgatcagctggaactgctcgtcggaaccggcttcggcagcctgagccagcttgaacagttcggcagccacatgctccaccacttcggcacggtcggccggagcggtgtaatgccatgcggtggtgctaacctgcgccaaagcgtaacggaacgtggtggactcatgttccgtggcgagcgcagccaaagaggtttcgatgaactgctttgccggcaattcgccgtcacgagtcatatcccagaatgcaagccaaatcacggaacgagccagcgcatcgtcgaaacgatacaggttctccgcagcgaacttgaggctcttctcatcgaagcgcagcttcgtgtatgtcaaatcgtcgtcattcaccaaaatcagcgccggacgtgccttgccggcagccgcttcgacaatcgtcagttcgccgtcaacatcaagttcgaactggtcggtacgcacgatcttgccggtctccggatcctcattgtagaagccgacagctagacgatgtgcacgcagcaccggatgttcagccgaagcggactggcgcaacgcaagctggcgaatcgtaccatcctcgttttcctcaacttcggtagcgatggtgttgatgccggactgttcaagccactgggcgctccacgccttgagatcgcgaccggacgtcaactcgagttcagccagcagatcggcgagcgtagcgttggagtacgcatgcttgtccaaatagttgttgatgcccttgaagaacttctcacgacccacatagaacacgagctgcttcagcacggaagcacccttggcataggtgatgccgtcgaagttgacatacgtgtcgttcagatcgttgatcggcgcgacgatcgggtgggtggtgctcagctgatcctggcgcagtgcccagctcttctcgccggagctgaacgtggcccaagcgtccttccattccgtggcttcggcagtggcaagggtggatgtgaactcagcgaaagactcgttaagccacaggtcgttccaccacttcatggtcacgtaatcgccgaaccacatgtgtgcaagctcgtgtagcacggtgacgacacggcgctcggcatacgcatcggtgaccttcgattcgaacacgtactggtcgcggatggtgaccatgccgatgttctccatagcgccggcgttgtattccggcacgtaaatctggtcgtacttggcgtacggatacggcacgccccaagtcttcgcatagaaggcgaaacccttcttggtgatgtcgaacaggtagtcgacatccttggcgaacgcttcggcgagcgcctgacggcagtacatggacatcggcacggtgcgaccgtcttcgttggcgtattcggtgtgccattcggcgtacggtcctgcgcagatggcggtgaggtaggagctcatggtcggcgtggattcgaacacccacagcttggtggtttcggcttcgtgcgtgccgagcgtgccctcttcggtaacggtttcattgtcggtcacggatgcggcaggcatgttggaggtgacgatccacgacttggctgcaagcacggagaaatcgaacacggccttgatgtcgggctggtcgaacacggcatacacgcggcgggcatccggcacttcgaactgagagtacaggtagatgttgccgtcggaagggtcgacgctacggtgcaggccttcaccggtgttggaatactggcacagtgccttgacggtcacttcgttgtgcgcttcgaggttcttcagttcgatacggctgtcggcgaacgcttcggccggatcgagagtttcgccgttgagtacgatttcgctcacttcggtggcgatcaggtcaaggaagctggtagctcccggctcggcgtcgaacgtgatggtggtttcggaaccgaaattcttggctccacgggtcagatcaagtttgaccgtgtaatgaaccggtgctgcgataacgcttttgcgttcttccgcttcgattcgggtgagatttgctcctggcatgtcactccttatttgtgttgagattcctatttattgaataggagacggcgcaaccggttgtgccggttacgccgtccttcttttgattatgtaatcaacaattattgacgatctgtcgatatttcaatattattccaatattgatttcgctggaatcggcgatattgcgaaaaatattgactatctgtcgattcatcattgcgctgcgttcaatcccatcgcttcgtcaacatcctgtgcgatatcggcaacgaccggaacgatcatcggcttgcgatgcagctgacgtgcgacccagctacccaacgtacgacgcatgatctgctgcaacttgtatgtatcgtgcgtgccagccatcatcgcatcctgcaattgctcgacgatctgatgacgaaccttgtcgaattcgctttcgtcttcggccaccgcgttgagatagatcttcggacctgcgacaacgtcagccgtttccgtatcgacgacgacgaagctcgacacgaaaccttccgtgccaagaatacgacgcttctcaagctcgtcctcggtaagttcgccaacggaatcgccatcgacgtacacgtagccgcatggcacggaaccgacaacagcagcttggccgtggtacaaatcgaccacatcgccgtcttcggcaagcaccacattctgcggatcgacgcccgtcttgaccgcgatcatgccgttggccaccaagtgacggttctcgccgtggatcggcatggcgcacttcggcttgacgatgttgtacatgtacagcagttcgccctcattgcagtggccggacacatgcacggcggcattgtctcgattgaccacacgagcgccaagctgcaccagcttgttgatgatcttgtacacgccatgctcgttgcccggaatcagggagctcgcaagaatgaccgtgtcgaattcgttgatggtgatgtcgcgatgattgccgtcggcgatacggccaagcgcggccatcggctcgccttgggaaccggtgcacatgtagacgagcttgtcgtcctgcacatcatgggccttcttcaggtcgatgaccgtgtcttccggaagtctcaagtagcccaaatccgcagcgatggacatgttgcgaaccatggaacggcccacgaacaccaccttgcgaccgtacttgtgggcggcgtcgacaacctgctgcacacggtgcacatggctggagaagctggccacgatgatcttgcgtgtggcctgggcgaacgcctgatccagcgccgggccaatggtggtttccggcttgacgaagcctggaacctcagcgttggtggaatccatcatcagcagatccacgcccttttcgccgagcttgccgaactccaccaaatcagtgatgcgatggtcaagcggcagctggtcaagcttgatatcgccggtatcgatgaggcttccggccggagtctgcacgaacacagccagagcgtccggaatggaatgcgtgacgttcacgaactcaagattgaacggaccgaccttcagcttgtcacgacccttgacctcaaccagtcgcggattgatgcgatgctccttgcacttggcttcaacgaaagccaacgtgagcttggaaccaatcagcggaatgtcggggcggagcttcagcagatacggcacgccgccgatatgatcctcgtggccgtgggtaagcaccagagcctcgaccttgtcgagacgatccttgatgtagtggaagtcaggcagaatcagatcgacacccggctgctcctcttcggggaaaagcacaccgcagtcgatgagcagcaggtggccgttgtattcgatcacgttcatgttacggccgatttcgcccaggccaccaagcggcacgatgcgcatggagcccttacggtacttcggcggagcgatcaacacgtcatcctgctggggcgcggtggtctgcggagcaagacgggaattgcgacggcttccagcagaagagcttgccgcgctggagttcttgggacctctggagttcttcgtgttctttgcggccttcacgtttttcgtgctcttcgagcccttggaggagccgctgccgttgccgcgagaaccgccacgaacggaaccggacgcatcgcccgcacgattgccacggccagaagacttcgccttcttggaagtcgtttcagccttgctgaccttctcagagctcacagacttcacggattgcacatccgcggtctgcgtgttttcagtgcgcttggcagctttgctgccgcgcttgtgcgtagttactgttttggtttcttctatagccatttcctagttggatttccattactaattgtctccgcctgtgcggaaacgaggaattcagttagtttgccgtattacggcaaacccagcaaacttgtgatcgcaacaatgcccggaatcagcgcaatcgccgacaatcaagcgcttcgcaatcacaagtttcgcaatcacaagttcttcaattacagcaagctggaagcgcgcatgccatcttccgcgcgcttgatctcagcctcgcccggaccgacgttcggcagacgcatcgtcgtggagtcgagaatgccacgcaccttcagcgaagccttggccataacagcctggaaaccgttgccgttcattgcttcgaccagtggagcaagctgcacggcaatgcgctgagccccatgaatgtcaccgcggtcgaatgcggcagccaaatcgcgcatcggaccggaagcagcatgtgcgatcacggaaataatgccgactgcaccaaccgaaaggaacggcaggaacagaccgtcatcgcccgaataccaagtcaaaccggtttccatacgcttacgcacggcacccgcgatatctccggtggcgtccttcaccgccttgacgtgaccaagctcagccaaacgacggtaggtttccaactgaatgtgcagaccggtgcggccaggcacatcgtaaacgataatcggcttgtccgcggaatcattgaccgccttgtagtgacggaacacgccttcctgcgacgggcgcgaatagtacggagcgaccacaagcaccgcatcggcgcccgcctcctgagtctgctccaccatgcgcacggtgtgggcggtatcgttggaacccgcaccggagataacgggcacgctcaccacatccttgacggcctgaaccagctcgaccttctcctccatgtgggtggtgggagactcgcccgtggtgccattgaccacaaggccatcggcgccatcggcgacaagctgcttcgcaagcttctgcgcggcctcgaaatcaacggaaccgtcggccttcatgggggtgaccatggccggaagaatacgtccgaaaggagcaggatcaagaagatgcatagtaccgtcagtcatagtgccaacggtacttcccgccacggacgccgaagcgcccgagttcgcgaccatatcgcaatatgaactgccttccagagaccaaaatcccccacccgctggaacaatcctcccgttgccgagcctcccagagtcccaaaacctccacccgctggaacaatcctcccgtcaaccagcctcccagagacccaaaacctccagttaatggaacaatcctcccgctgccaagcctcccacagtccaaaatcccccagcaagtggaagaatcggtacgcttagccgcatactcagggggattcaagccaaatgacttcacgattttgatctggtgaccgcacgatttcggaatatcgcacgattttgctttcctgaccgcacaacactccaaaacagtgcgatcaccaagagggaaaagtgcgcccaccaaaacaaactcaggcaaggtattgggtggggttctgctcgaacttggcggcgcagcccgggttgcagaagtagtaggtggtgccattgtattctcgggtggctgcagcggtggccggatccacgctcatgccgcagaccggatctttggcgggcgcgctctgattgccgttggcagtgtggccgccacagcaagagcgcatgccttccatactttcgtgggcgttttccttcttggctttgtgatcactgaacagtcccatgatgaatcctttctgactatggttgttgtgattattatcgttcgggttcggctggcgaacctgatacgtcttatttgcggcacgcaccgccttgtctggatcgaacaggcgcagtcggctcgcgttcgtcaccacgcatagcgacgagaatgccatggccgcgcccgcgatcatcggattgagcatcatgccggtgaacgggtacagtacgcccgccgcaatggaaatgccgacgctgttatagccgagcgcaaatccaagattctgtgcgatattgcgcatggtggcgcgggtcaagtcgagcgcatgcaccaaacccatcagcgagccattcatcaatgtcacgtctgcggattggatcgccacatctgtaccggtaccgatggcgaatcccacattcgcgcgggcaagcgccggagcatcgttgacgccatcgccgaccattgccaccgtatagccttgcgcctgcagtttcgcgatttcgtccgccttgttttccgggcgcactcccgcgatcacgttgccgacgccaacttgatcggccacggcatgcgccgtcgtttcgttgtctccagtgagcatcaccacgttgacgccacgcgatttcaaagctgcgatggcctgttgcgaatcggctttcaccgtatccgcaacggccacgattcccgcaagctcgccgtcgattgctgcgagcatcggcgttttcccttccgccgatagccgttccatagcctcgataatggcatcgagatcctcgttgccgacgctcggcatggccacgtcaagatcgtcgatcagatcggtattgccgaccgcaacgttgtacattgcggtttcgggagaagatatggatgattcgaaggtcacggaagatgcagaggattcgtcagctgcaacagtcggattatttgcagatattaacggcaacgcgacgtgcgcagtgacgccccgaccggaaatcgcacggaattgcgtggtctcgcctaacgtaagatgcttctcttgcgctccggcaacaatcgcggcggcaagaggatgttcggaatcccgttcggcactggctgtgatcgccagcagatcatccggcattttgcgccattttccaagcggaaacacgtcggtcaacgatggctttccagcggtgatcgtgcctgttttgtcaagtacgacagcattgattttgccgcaggtttccaacgcttcggcggaacggatcagcacgcccatctgcgcggcacgaccggtcgaaaccgttacggaaagcggcgtggcaagacccaaagcgcacgggcatgcgatcagcagcaccgaaaccgccgccaccagcgcatgcaccacgcgcggttccggtccgaacgcaaaccacaatgcgcacgaccatacggcgatcagcaccacaatcggcacgaaaatgcctgaaatcttatccgccatgcgctgtaccggagctttggaactttgcgcggattgcaccaatccgataatctgcgcgagcaccgtgtctttgccgactttcgtggcacgataccgcagcgatccagtgccattgatggtggcgccggtcacggaactgccggcctgcttcaccacaggcatggattcgccggtaatcatggattcgtcaacagccgacgaaccagcaataaccacaccgtcaacaggaagttgttcgccgggacgaatcgcaataatatctccgaccgccacctgctcgaccggaatttcctcttcaatttcacctcgtaccacgcgagcgtttttcggctgcaatcccgccaacgcgcgcatggcctctccagtaccgacacgagcgcgcgcttcaagcaattggccgaccagcatcagcgtaataaccacaccaaccgcttcaaaatacggttcgcgagcattctcaggcagaatctgcggaataaacgtgaccacgcacgagtaggcaaacgcacatacggtacccagactgaccagcgcattcatttccggcgaacggtgaataatcgccgcgaaaccactgcggaaaatcggtaatgcggcatagcacatcaccggcagcatcagcacaaattgcacccaattcggcatcggatacagcatcaacatcgtcgaaccgaatactggaatcgtaacgatggctgacacaataagacgcgcaatcagcgttcgcatctcacgagattcggaagaatcgtttgacgaatcagaagaatctgaagaaatattggaagattcagcggattcatacgatttttcatcaacaacagtttgttgcgattgcatatgaacgtgagattcagcagtattcgtgctctcttccgattccgaatgttctttcggcattgcggcatgatgttttcccggcaccacccgtaatgtgccatgcagcatgttcatgccgcatgcgaaaccgtactcccccggttcgttagggtgaagcgtcaatgtcgttgtgcggaaagcgggcaatgccaggtcgacaccgaaatcggagaacaccatgtgcgacgagcattcaccgtcttctttgcgatcgaatatcaatcgcaatggcaaaccggcctcagcttcgatgattgccggactatacccacctttgacttcgacaaccgcctcttgcacgccgttatcgacacgagcgcgaaatgctttgcgcggcgcgaagaagaaccataacacggctgccgtcacaatgaacgcgacaatgacggcaatcaaagcctgcatattctcaccaaccttattcacgttcacgtctcaatgactatcatcacaatatacccctatagggtatatttgcaagagaaaagcgatatcttcagcggtaagatcaagatttcagcgttacgaggagcagcatcatgaacgcaacccatcacggatacgcggacgaccagaagaaaatcatcgcgcgcctcaaccgcattgaagggcaagtgcgaggcatacgccaaatgacggaaaacggcgaatactgcatcgacatcctgacgcagatatcagccgtgaacagtgcgttgaaatcggtagcgctgctgctcgtcgacgatcatctcaaccactgtgtcaaagaagccatcgaagagggcggggaagtttccgaagcgaaaatcgccgaggcaagcgcggccatagcacgcctcgtgaaatcgtagaccgcaaaacatgtcaatccccgatccagcaagcgaaaactcaccatcgccgccaaatcggggattgtatgatcagaccggaaaagttccagaccccatagatttacgaggtagatttacaggtcgaggaagttgtcgaggccgacggtcacgcctgggtatgcgccggtggagaccttgcgtacggccagcagcacgcccggcatgaaggagatgcggtcgaagctgtcggcacgaatggtcagctgctcgccgtcattaccgaacagggcctcctcatgggcgttaagaccgcgcagacgtacggcgtgcacgtgaatgccgtcaaccacctggccacgggagccgccatcggtttcggtggcatccggcacagggccaagacctgcggccttgcgggctgcggcgatgccctgcgcggtgtggaatgcggtgccggacggagcatccaccttgttcgggtgatgcagctcgatcacttcagcggattcgaagtacggagccgcaaccttggcgaaatagtcggcgagcacggcggaaatggcgaaattcggcgcaatgaacacactctggccctcgcgaggcgcggcagcgagcgcggcacgcacctgatcgagcttctcgtcggtccagccggtggtacccaccaccacgtcgacaccttgcgccacgagtgcgagcacattgtcaagagacacgctcggcacggtgaactccaccaccacgtcagtgttgccgggggtgatttgggtgaggtcgtcgccggcgtcaagcgcgagcgccaattcggtgtcggccgcgttgttcacggcatcgaccacatgggaacccatacgtcctttggcgccaactacagaaaccttgatcattgcagctccttcaagcatgtcgcacgtacgagcgtacgaacagcatttcaaatcagtctcactcattctactgaggaatgttccatttacgaatgtaaagagacgcttcgacgcgtcaccgcccagccgatcaaggcgaacggaatcgaagcgagcacgaaaatccatggcagcatcagacttatgtctgggctgaaatggtcgagcatgattcccgtggtcatcgaaccgaatgacgcgccgatggttcccgcggtgctcacccacgcgaggccttcggtcagcgattcctccggcacggtctccttcataacgagattgcccgaagcgaacaccgacgaaacggtaagacccgtaaggatttcaaacactcccatcataatcagattgccttggcacatgtgaatgatgaagaagcctaccgttatgatcgcgaggaacgtgatcatatggcgccagcgggagcccttcagctcgcgcgtgccgaaaaccagcgcgcctatgcacgagccgaccgccaacatcgcaagctgcacaccaagcagggaatcaagatgcaacgctttcataacggccgtcatcgacgtatcgaatgcggtgaaactcatgttgaacacgatgaataccatcaaaagcggaatcacgcccgcataggtgagcacattgcgtttcttgcgattgtcattcgacttcaactgcgcgacggtcagtttgtcttgttgtttgtcttgttgcacggaatttgcgccgccattatttccagtattgccgtcaaccgccaatcgcacgtccgcatcgtcggaagatgccgaaacaacagtgatttcacgtactaccggcggttgcgtgtcacgcaatgcgaagaacaccgtgccgccgatcgcgcacgcaatcgtcggcacaaacaactgcgaaacgggatgcacggaagccgccaggaacgcggccagaatcggtccgaaaatgaatacgatctcatcgatggcggattccaatgcatacgcagtgttcagcaatgagccgttgccggtacggtcaagcacatacgtccaacgggtacgcacaagcgcgccgaacgagaattgcgtgagccccatcaccacagccaaggcgaacagcagtggaatcggcacgcgcaccaatgccgcgaacgcaaagccaagcatggcgatgatttgcacgacaagcactaccgatccgaccttgcgctggccgaatcggtcgaacagtcgtgcgtacagtggcgtgaccgccgccgtggaaagcacatatgccgcgctcatcacgcctgcgatcgtccaattgtcatacaaatggttgagtgcgaggataatgccaaggctcatcatcgacatcggcagtcgcgccaaggctccggaagcacagaacgctttggttcccggaatggagaacagtacggaatatggcgacttcgggatttcggttgcgctggtggcagccatgattatcgctccttaactttcgttgcgtccggcacgtgtgcccgcccacacatgctgcacgagggtagcggcgctcctccacaacgctgcccatagtgcgttaccctacgggcaggctggaaagcgccgcacgttcggcgcaccagcactagtcgttgtcggattgttccggaattccgtagctcaactcggcaaggatctcttcttctgttttgtcggcagcattgagctgtcgatcgccctcaatgggttcactcagatagtagaggcaggcgtcgatagcggtaagcggtacaccctccattgccgacagcaagatacgatacatatccaactgtgctaattttttctgaatttcctcttttttgcgaggtttttttccagttttccaatcgacaatagtatattgtttcgaccgatccaccccatcgagacccccgaagaacaccgcgtcgagcttgccgttgacgatggtgcccaattgcggcacgttgacgacgatttgccgttccgcccacgcgggcttgcgccgtgcccatgtcgacgttgcgagacgctgttgccaatcgaatatcccgttattgtctgccccattatcgtcttgattgtcttgcgattgcgccgcattgttgcgtcgcagctcggcaagcatcgccaatcgcgattcagctacgcgagtaccgccattgccgctcgcgccaacgccaatgccggcatcattcgcatcggccatgatgaaccgttccgcccaagcatggaactgcgtgcccagttgcgcggccggagacgctacgttcggtatcggacgcaccagcccacgccagtaagtgcgggcgccacgctcgtccatcatgcctgcgcgcgcctgcagcgaggtgacgttctgacgacctgacgcaagaatcctctcgcccttcgcacgcaccgcgctgtcgaacgcatcctgcgacgcctctccaagcatgtcaggcatgagattgctgtcggccaccagcaattgcgcgcatcgcagcagcgaagcacccgtattttcgcaacgcccagcaccttcgccaccgacaggctcgccaacttgcccgctggcccgttcgccagcccgcccatcagtctgcccgccagcattgttcatcgccgaatccacctgcaacgcagacaaacgcaacgtctgcagggtctcatcgctcaactcgcacggccatggcaggaactggttgccttccgacggctcgagcggcgcattccaagcgtcgccgaccaccgcatcttcaaaatcgcgggcatgctcgcccacaaaaaatccatccggcaacggcgcatcgatcgaatgcagactggtcatgccgttttcggaggaatcgacatcctcaacttccgcaatatcggctaggttgctcggctcagccgctctggaaacgatattgagcatggaatcgcgcacttccactaggaaattcgacggtttggacacacgtttgcgatcgcccacggcacgcggatcacggctttccgcattcgttgcgctgcaggtgagcagcgcctcatgacgggcgcgagtcaacgccacatacgcgaggcgacgctcgtcggcatgcaaccgacggccatactcctcgatttgcgtcaaatacagtccgtccggatcaataccttccatgtcatcgacgctcatattccgcaaggtgccgaacacttcgtcgtcaatgatttccgcatcctccagcatttccaacgcttccaacggatttccacccacaagcgcgtcatgggggaatcgcggcagaatatcggcgtccacacgcaccggaaccggcaccgcagcaggatcggtcagccacgttttggcggtctcatgatattcgggcggcgtccacacgccatcctggaaaccgttgagatgctcttcatcaacgaccacacgcagatcgctgcccttgttggtggggaatccgccatcggtcatgccgaccacggccacggcatcccattcaaggcccttcgactggtgtacggtcatcagcaccacgtcgacaggcacatcgggagccaccgcgttctcctcgcgtgcgtcgcgcagcgaatccgcccatgagatgaacgcgcgcaggctcggcgttccctgcgacgcgatctcctgcatatacgtgtcgacgagcttcagcaacgcatcgatcggcgatttggcgagcgccacccgggatgcggcgagcgtggcatcggcctgaccgccgcgcatatgctcggccagctgcatgtcgatatcgagattcaatgcgacgatggcctcacgaaccacttccggcaacgggtggccaagcatgcgctgcacctgacggatcgcatccgcggcgcgaagcacttccttcgtcccttcacgactcaccctgccgtcaatgagttccgcgagatcgtcacgcaacatgaggtccacaaggaaaaccgcattcggcacttgatctcgatattcacgtacgatggcacggatttcagcatcggaaggacccgacttgggagttactccataaattcccagattttccggtttttcttccttgttggattgctcctgcacgattccagctgaaacaagcgcacgataccggcacatcgtgttcacctgttccgcggtatcggcgagcgcctgcagatcgttggcgctgatggagaatcgcggcgtggccagcaatcgcataagcgccgcactgtcggtatgatcgctgacgacgcgtagcaaagcgaacacgtcctgcaccgccggacgttccagcaacgccgaccgccccactaccagcgtggtcaggcctgcgcgttcgagcgcttccgcgaattgcgacatgattcctttggaacggaacagcaccgccacgtgcggacgattgtctttcatgccattgtcgaggtcgcgcgaggaaggcgtgtgcagggcgatcgcatgtttggcgaagcgcacgaccgcgtcgacctcctgcccgaacgtgtcgaacgcaagcacgcccaccgttccttcgggggcttcgtcggtattgacgagcgccggaacgtcgacttcgcgcatcagcgagctgctgaggcgtctggcaggcaagcggagcggtttggtgagattgttcgccgcttcgagcaccatgcgtgagttgcgccgcgtcacggtcaatgcgaatggcctgctggtggcgtccatgccgaaatcgtgttgcagcatgcggaatgcgccaggactcgcccctcgccatgcgtagatcgattggaaggggtcgccgaccgcgctgaccgcgctgcgatgcgtgtcgtcagcgtggaacagcgcgctcagcagtgccgcctgcgtggtggacgtgtcttggtattcgtcgaggagcacatgcgaatagcgtttgcggtaggccgctccgatggacgggaatcgggagacaagctggaatgccgcgatggtgaaatcgctgaattccgccatattgcaggcgcgtttttcggcatgatagtcaagcacaagatcgagcagcaggtcgcgttgcttggcgacgaatgcgagttgcgcgctgttgaacacgcacatgtcgtgcccgagttcgcggtatttctccagtttcttttcgtagtccgcgtcggaatcctttttcagtcgtttcggcagctttggcgatttcggctcttccgttggcacggtttcgccgtcaagcgccttggcgatctgttcgacgaacgcctcatcccagtcgcgcacgcgttgcacggcttcgtcgaagctggtgcagtcgccgccgatcatggcgccggaaatggcgttggacagggcgaacacgttgcccgctatggtgttgaacgatttcagatcgccgtcgaacgccataagatcatccatatgcctgtcaagcacggtgtggatgagctgcatggcacctgcttcgctcaatggctgcgtgttctggtcaaagccgacaagcagtccatattggcgcacgatggattggaagaaagcgtcgtacgtggagacttccggtttgaggaacgtcatgttcgctgatttcaggccgcgttcgcgctggtcgcgagtcacggccgcagacactcgagacaatagttccgaggccgctttgcgcgtgaaggtcagtccgaggatcttttcggggctcaccccctgttcgatcagcgtgatgatgcgtctggtcatcgtgtaggttttgccggatccagcgccggccaccaccaccacatccgcatacgagggcgcttggacgacggcagcctgctcaggactgtcggtgaacttcatggttccgctcatgccgttctcctttcgaatacggtgttctgttcgcccgcacaggccgggcagatcgtagtgtttctgcagtatctcacatgttccgtcgtcggtcttgcggtgatttcgttcgccctgctggccgcggccgcatagaagaccctcgcgatcatggtgagggaccataccgccatcgtgccgcgtaagccaaggaactcattccaatgctcgtcgctcacttccaacggaggaagcatgtcatcgagtccgtcgtggaaatccttgtcgagttttttgacgtaatagcgcggtatgaattcgccggtattgagacttccattggcgaacagcgcctgctgcatatgcgattcggcggcggtgtcgccatacggcgcagggtatgcgtgcttggctacatggaatagcgcgctttgcgtgatgttcggcgcgttcgccaccgcctgcgccccgcgcatgccgctttcctcggggaatacgagtcccagctgatagcagacgagctgcagatcgttgaacaggccttcgccggtcggactgacaccggttttgtagtcgatcagacgcacctgctgcgtgccatccgccatttcacgccgttccaaacggtcgatcctgccggtcaaacgcacggtgagatactcgctcatgccggtttccggccatcctccgaccaacgctcccataatggcgatcaattcgttccgtgaaatcgcgtgaacgccgtccatcgcattgtaggcgtcgagaatatcgtcgaaatcgaattttgcggtaaatttcagctcaggttcggctttcgtaagttttccaacgctgaatgcatcattatttttaatcggataatcaccatgattcgattgcacgaaatacgtggcgatgttacgcaacgcctcctgcgcctgctcatctttcttcaacgcctgataccgttgcgcgggatcggcaatggcgttgaaatcgccgcatagacgcttgtattcggcatacatccattcggtgatcgcattgatattgtccacgtcgctgatggcggtatggtgttccggcatatcaagtccggcttcggtggcctgttgcgccaccttgtggatcagcgagccgaaactcgtggcgacgctgcccatgcgcgggccggagaagcggttttccaacatccaacacaccgggcacgcccacagattgtctaccgcagaaggagacaaagtcaccacgtcggatcgccgcgatttaccgtttcggcccgacgtcgagctttccgacgtgtcgctcatgcccgtccgcatgacggccgcgatcttccgcatggtggcctcgaccgtctcccccataaacggccaacggtcagggtcggccgccgtaacaccatgcgaagccagcaatgccaacgcttccgcggcatcacgcgccttcgggctgtcctcaggttccgacgcaagcacgcttcgggcggccgcgaccagaccacggggatcggtttccagccccgcgtaatcgccttggccgccgaccgacgcatattctcgccgttccatatcggcgtcgcgatcgcggtcgaagcactccggcatatatccgtatagaaaatccgaaggcacattgtcgtcattcagcacggcgctcaccaccacacgctcgctggcacgggtcaacgccaccaacaggctcttctgctcggaggcgagcaccgacgccagttgcgcgtcctgcctgcccgccggagtgacgatcgtgtcggacaatacgccgtgcagcatcacatcggccagttcctcaccgccgaacaacgtgttgcgtggtgtgagattcggccactgcccctgctgcaaagccggcagaaaaaccagattccagcgctttcccgccgctcctgcgggagtcgtcagggtcaccgcctgatcaatgggcgcggtatgcgccagcgaatccgcctcaatggtcagcaaacgcacctgttcgatgaacgcctcgatggtgtgtaccgcgaattccccgcttgactcgccgcctgaagcatagttgaacaaacgcatcgccgcgtcaagccgatcattcgcggcacggccggcagccgaatgctccagcgccacacgctgccagacttccgccttgccgcaggccctccatgcgcaatccaacacatattgcggttcacgcgaaaccagtttggcttccgactcgcatgttttgtcaagaaccttccacaatgatgcgaacgccttgatctgcggatccgcgcccagcacggaggcgatcgcatcgaccacgcgatcggtattgccctccataagaagcacgtacagcgcttccatactcagcgcgaaatcgccttcatgctcgtcttcatgctcactatcatgctcgccatcggcgcgaatcgcatgatagtccgtcatataatcgcgccagtcttccatcaaacgagggagcaacgcctgttgttcgacggcagcgtccgccgcatcctcatcatcttcgaaatcatcttcaaagtaatcttcgaaatcatcttcgtcgtattcttcggcagcatcctcatcatggttcgcagccttgctttccacaatcgaagcgagcgaaaccaacgcgttcatcgcggattcgatggatgcgagacgggccggacgcccctcatgccgttgatcaccaccgaccgtaatcagcggagatcccataatcagcgccacgcgcgaacgaatataggatccggcggtctgcaggtccatggtcgaagccgcgatcgtctggtttttcaattcggccaactcgatcaacgcgaacagaccctgcacgaacggctcatccttcaacggccgggtcacgctggaatagcgcacgggaacgccgtcagcgcgcaaccgctcgccgaatgcgcgcacggtggcattgtcgtgcgcgatcacggccatgtcgttccatacacgggaacgttgcaaatgctcagttttgatcttccacaccacgtcgtcgagctcttcggaagaggaacggtacaaggccgtttccacactgccgtcggccggcgtgacacgagcgcccgtatcgtcggccggcaacgtttcgatgggcatcgcgcctggcatatcgctcattttgccgggacgatcgggcagaggcacgtccgtcgactccgtgcttgcgatcgacaggctcactcgcgtcgcgacaagcgtgcgatagtcgccatgcacgccttgctggttcgacacggtttgcgcggtatcgccttcgtgcgccgtttgcagaccttcgatgcgttcaagcctcgctcccatgcgcgtctgcgcctggttgaacagatattccggatatgatcctcggaacgtctgcacggcttcgtcgggattgccaaccaacagcaggcgcaccccgcgttcatgcagggcttcaagcagtgcgaaaccagccaacgtcgtatcttgaaaatcgtcgacgatcagcatgttcgcaatatcggcttcctgtatgccagacacggcttcggtggcgtcgatcatcagctgcgacgcgtcgagacgatattcgccaggataagacgaacggatcgcctcattgtattcctcacgcaaggcgaaggcgagacgccattgagtgcgcaggcgttcgcgacgttcgtcaagcatgccgtccctgctggccgcacgggcgatcagcatgtcttcgaactgcggtttcgcgccaatctcgttcatgcgtgcgagcatgtcgcgcaattggttggcgaatgcgtcggtggaatcgtcggccaccagtcctgaccattcggaaaccgcgaaataggtgcgcagcagatcgcaggtggcgcaatcgtcgccatgttgcctatgctccacatgcgaagctagtaccttgcggatgatcacatcctgttccgcaccgttcaacagtttcggcaacggttcgccttgacttgatctcacggccgtcagcagacggaatgcgacggcaggcaacgtagtgaccggtcgcgcctgcgacacggccgacaattcgcggatcgcccgatcgcccaacgcatcggcgatctgcctgccagacaccgtcatcacggcattcccgtcaccataccgcctcattgcggcaaccagcatgcccagcgcaaactcggtttttccactgctcggcgcgcccgcaaccaacgtgacgcggtcaaggtcttccaaattcatcatgcctcccaacactactagtctcgccctcctttacctgacaaatccggaacctgcaaagttgtctcgaagccaacctttatccaacacgatctgcggtgcaaccactccttcgtggcatctgcagcaacgccgacaacacatcaatggtcatttccatttgagccagatgcccgtcatccagcaactgaatgtatgtaccctcatcgtcgccacgaaggccgtctcttaaggttcgcacgttctttctatcactacgacttctattattcagccacaacatgtctcagatgcccgtctttgtatatggacattttgaccccttgctgataggtttctgggttggtcttcagttaggataggatccagagagagcggccgaaaagcatacgcaccacgaggaaagagagcatatggaagccatgaacggcattccccctcaaatccctgggtatacattcgcccaaaagttgggttcaggttccgaagcgaacgtgtatttgtaccagcagctttcccccagccgacaagtggccatcaaggtcagcaagggaacgctcgatccgcgcgcggcgtcgcggttccgttccgaagcgaacttcatgggcaggatctcctcgcatccctacattctttcggtgtacgaaagcggcatcaccgccacaggcaacggctacaccgtattcgaatacgctccgggaggcaattacaagaccttcctggaatccaacaggctcaacgcagaccagatgctcaccgtcggcatcaatctggcgagcgccctttccacagcgcaccgcgaaggcatcatccaccgcgacatcaagcccagcaatattctcatcaacacgcatggcatgcccatgcttgccgatttcggcatcgcgggaacgatttacgggcgtcccggcatcggctacaccatcgcgtgggctccgccggaagtgcttgcgaagaacggcggaggcaacgaatcctccgatatttattcgctgggggcgacgctgttcgccatgctgacgggccagtcgccatatgaatacggctattccgcggccctcggctcgaccaggggcaaagaacgcggtgctctgctgagaaacatcattctcaccgatccgctccctaagctcaataggccggatattcccccgcaagtggagcggattttacgcaaggcgttgaataaagcgccggaagaccggtattattccgcatatgatttcgcgcgtgacatgcagcgtgcgcagcaggaattgtatggccatgccacgccgaccacggtcgaaggcgaaccgccgttcccgcaaaatctgtacgcacagtcccaggcgaacattcaggtttcaccgaccgtcccaaagcagcgcagcacttgggccaagcctcttgcgatcgttgtttcggcggtcgccgcgattgcagccgtcgaactggcgttcgcgtatgtgatcttgccgaatatggattcggcttccgacaatagcagcgtgcagatcaagactccgggaacgcacgatcaggacaacgattcgcctgattcggccatcaccacaagtagcgtgcccagtgtcgagaatctggccggctcatattccgccgatggcagcagcgtgcagttcacatgggtgaaccccgaccctcaggacggcgattcgtacgcatggtcgctggtaggcgatgcaggagtagacccgaacgcccaaggaaccaccaccaccgacacgcgcatcagcatcaaacccgccgacggctcgcagacctgcatccaggtgagcctcatccgagcggaccggcagatgtcgcagaatcctgcgatcgcgtgcgcggccaaaccataagcatcacagcacttcccaacagggtcggccgacggcattattccatcgcaggcgatgtccggaacgaacacaacgaccatcggaacactcaaggaagaaccgaaaatggacaaacgcaagaacgcagccgatcagccggcacaatcgcacgaacgtcaattgcgcttcggatcgatgatgcgcaaactgctgttgccgtcgggaagcagacggtggatcacgccgatcgtcatgctgcttctgctgctgggtatcatcgcaggcgcgttcatcgtcagttcggtgacgcaacggcatgtgcaacttgacgacggcaccgtgtggatcacgtcgctgaaggaccgcaaagccgcacgattcaatgcgaagaacaaggatgtggacgccggagtctcatccgcagcctcccgtttcgacgtggcacagcatgatggcgacacagtgatctccgaaggcaccaaagccagcaatatcgcggcttccaccattagcgaaaccggcaacaccgccatcaaaacggatatcgaaaccattatcggaggcaataccgcagcgttcatcaacaccaaaaccggcaatgtgtgggtgggatccgctgccgatgtgaaatccgtcaaccccaccaccgacaagccgaacatgaaactgggatccggcggaaaaatcgcggtgacgcatgacggaaccgtatacggataccgaacttccgatggcgcggtgctgagcatcaaagggccgcaagacacgcgcgagcaagttggcacgataggaggcgcaccgcatgccgaatcgttcaccgtcatcggcgaaaccccggtcgtggcggcaaaaggcaccgtgtattggccgcagggaagcgcagccatcaatctgcagggcagcatgaccttgcaggccccttccacggacggcaaacagaacggatgggtggccgtggcgacaccacgcgggctcgcaacggtgaacctcagcaccaagaaaacctctgaaacaccgaattccggcaagggcgaggccgcccaaccggtgtccacaggcggatgcgtgttcgccgcatgggcgcagaaagccaacaattacgccaaagtgtgctccgtagacggttcggatacggcattcgacaccctgaccaacatcaacgccacttcggaactgatattccgcaccaaccatcgtctggtcatactcaacgacgtggtcaacggcaacgtttggaatccgcaggaatccaccaaggtcatcaaaatccaatggaacaaggtggaaaccaaacagtcgaagcaacaggaacagaacaacgacagcgccaacaaccagcataatttcagcaagacctgctcgtcgcaatccggccagatcaaagccgaagatgattcgttcggcgcgagaacaggatcgcagcagatcctcgacgtgctccgcaacgacgaacagaccgactgctccgtactgcgcatcacctcggtaagcgcccccgacggcgccaacatcagcgtttcccccgtatacgacggacgatatctgcagctcgacgcttccgcggcatccgaaggatccgtatcgttcagctatgaaatctccgacggacgcgggcaaacctccaacgccaacgtaagcctcacactggtaggcggggacgacaacgcgccccagcaaaccgatacgccaccggaaatcgacgtggaacaaggagcggcctacaccaccaacgcgctgggcagcttctccgatcccgacggcgacccgctcaccctcgtatccgcaaccccgcaaaacaccgaccaggtgaccgtttccacacgcgccgacgggcagctcgtgttcaacgcgggatccatgtcttccggacgcgccggcatcgaagtgaccgtttccgacggccagcagaccggcaccggcatggtgtatttctcagtgaaaccggccaacacgctggccgcggtgatcgatccggccgtcaagcagaccacgccagacacccgcaccaccatcgcgctcaaacaatacgtgcatggcacctcggccgaacccgcgcagctgaccgccgtggaaaccccatccggcgcatccaccaccatgaacgccaccgatatgtcgttcaccttcagcgcatccaaccccggcacctactacgtgccctacaccatcacacaaggatccatcccctcgaccggcctggcccgcatcgaagtgcaggcggtgaccggagactccgccaagcccatcgcagccaacgacgtggcactgctcggcgccgacaacaccgcaatcgtggaaccactgtctaacgacgtcgacccgatgggtggtgtgctatccgtgaccagcgtgaccgccgatgcggcgagcggcatcaaaaccggcgtcgtaagcaacaagcgcgtctacatcaccgcacgacaggtaccgaccgagcccgtgcagatcaaatacagcgtcgccaacgcggcaggcacgtcaaccggcgtgatcgtactgcagccaccggcactgaccacctccaactccgtgccgaaagccgacaacatcaccacgcaggtacgcactgacggcatcgtctccatcgacgtgctcgaccacgtgacctactccgacggcaccacggtaagcctgcaaaacgacctgcaatacgacaaaaacacgttcaaaggactcgtattcgtatcaggcaacaccgtacgataccaagcatccgaccaaaccggatccttccccgtaacgtacaccgtcaaagacaatctcggcaacgcggcatccgccacaatcaccatcaacgtgcatcaaaaagacgcttccaacaaggctgcgccaacaccatccgacgtcgaggcgcaagtcgcggccggccaaaaagtccagatcccgatcaccttgaccggcatcgacgccgacggcgacgacgtgcagctgctcggtctcggcaacaaggcgccgacactcggacgcatcagcgaagtcggcgccacctacctggtatacgaagcctatgccgactccacaggaacggacaccttctcatacgccgtcgaagactggaccggccaacgatcccaagcgcaaatccgcgtaggcgtattcacatccggcaccgactcgggcgtatacgcgcgcgacgacgaaatcacattgcgccccaacaccgcagcaaccgtgcccgtggcgcaaaacgacatctccggagacaacaccgacctggccgtcagcgaaaacgtcgaatcgcaagacatcagcaatgtgaccgtggcggacaatgcgctcgccttcaccactcctcagcaggcgggcacctattacgtggtgtatacggtcaaagacaaggcaggattgtccgacaccgcgacattgacggtgaacgtggacgacaacgccaccatcgaaccgccgacagcatacgactaccgtgtgccatcttccgcgacgatcgataagaaatccatcgacgtggacgtttcgcaatggatcgcgaatccttccggcagcgccgacgaactgcaggtggccgtggatgattccgccaccgaccatgcgcatgtcaagggcggtgacaagtccacgaccattagcgtggaattgacggacgaggcacgagccgtgccgtacaccgtgaccaacacgacatacaacatcacgtccactgcgttcatccaagtgcccgcgtacggcgtgttcccgccgacccttcgaccgaaggcgccggcattgaaggtgaacgcacgcgagacgatcaccatcaatatcgccgattatgtgcgcgtgggcgcaggcaagatcgcgtatgtggacggcgccgattcggtgagcgccacgaaggccgcggacggcgacctgtatgtgaacgaccagacgttgaagttcaccgcatcaaaggattattccggtccagcgtccatcaccttcaccgcggtggatggcaaacgcgacaagaacgataatgtgaaaatcatcaattcggcggtgttgacgttgccgatcaccgtgatcggacgtgacatgcccgcgccgacgttctcctcgtccaccattgacgtggtcgcaggagaaagcgccaccaccatcgatctgaccgcgttgacccattcggcgtccgacctgtatgacgatgagaagcagtacacgtattcgggtggcaccgattccgaccaggtgagcgccaaggtgagttcgaacggcaagctgaccgtgtccgccgacaagaccgcttcgccgggaacaacggtgagcgtgccgatttcgattcaatattcgaagggcacggtgagtgcgggcgtcacggttcgtgtgacggcctccaacaggcctttggcacgcatcaacgcgaaaaccgtgaaggtcaaggcaggatccagtgaggaagtgaacctgctgtccgatgcgtataatccgttccccgattccgcattgaccgtgaccggatgcacgtccgatggcgcgtcgaagctgaccgtggactgcccgtccaacggtgtggtgtcgatcagcgcctcgtccgatatcggcgcgagcaccaacaaggtgatcgtcaacgtgcgcgatgccaccaatacgaaggaacgtgaggtgacgggcaccatcaacgttttggtgatggacaagccggatgcgccgctgctctcccccatcgccggagacccgcaggatggcgcggtgaatctgagttggacggccggctcttcgaacggcagtccgatcagcgaatacaaggtgtcgtggggcggcgacggttccggcgagaaatcgtgcggatccgtgacctcctgccaaatcaccggcttgaagaacggcaagacgtactcgttcaaggtgcaggccaagaatgaggtcggctggtcgaaggagtcgaatggcgtggaaggcatgcctgacaagcttccggacgcgccgaccgatgtgaaggccgaagctagcaagaacaccatcactgtcacatggaaggctttggagggtaatttctccgccgtcgacaagtatcaggtgacgttgagcggtccgaatgtggcgaatccggcccaggaagtcactggcaccagcatcacgttcaaattcgacgacaatgcgatcaccgacggcgcatcctataccgccacggtcaaggcgcataacaaagtgaactggagccagccctccacggcatccaatgccgtttcgccttggggtacgcctgacaatccgactatttccgccgatcaatcaggcgacaagatcgtggtgagaggacggatcaatgacgcacgtaactcgaaataccagtcgattacggtaagcatcgagggcgaagacaaatccgtggagacaagcgccaaggattattccgtcgaattcgacattaagaacgagtggtactacagaaaacttaagccgacgattaccgtggttacggaacgcagtggctcattgcgcaacgaagcgtccgtttcgactttcacagcagtcgatcctccaaccaatgtgaagctggaactcaacaacaacacatgtgtggcgacctggtccagaaaaggtggacgcgtcacaggtttcgttgtaaaggccaagggttattacgatgatgatgttcatgagagcagagccgaatggccgctttccggtgattggagcacctgcgatacggtaagcgtgcaacagtacttcatcgacacctcacatctcagcgacccagcaatcgctaccgataataccgtcggcaacaaaaagccagcggaaatcacactgccatcctcattgacgtgggatacacagaacgccaacatcattcatgtcaatggcggtagttgggaggcccacgggcgaagtgtcaaaggccagatcgtcatcactccggcaggggaaagctcgcatacctacgattggccagctaacggcacactggatgtttccgacatcaccagtccttccggtaccagatgcgattgggaggttcgcgtgatcaccactgccggggaaccagaaatcaatgcgaccaagaaaagctctgatcccgtgaccggagtccgatacgaggagaaaacccccgatccggaaccgggaccaacccctgataatggagagacgcaatcctcgatagacaccaatgcttcagccatctcattacgaacagggttggcaggaaaacaggcgcgaggcatctcattcaccgtcaaataagcaaattcaacatcacaaccaatcatcaatacgatcaatagaagcaaccaaggagtacctatgagcaacgaaaacgacgacgccacccagctgggttccattgggcgccatatgagcaagccgcaacagcccggcaatccgcaggcacgccccgcattccaagctccaagcctgccgacgcatccgcaggaacaggacggagacgaagagggcacggtactcagcacgcataacgcaactccttccaggccgacgaggcctacggttccaatggcgcagcccatgcaggcgcaaccgacgcaatccgctccaacacaacagccgctaccacaatcgcaatcggctcccgtaatggcaacgcgccaattcccgcagactacggcaccaagcgtcaagcccgcgcagccggccatggcttcttccatgatgtccgcgccgcaggccgacatcaccgaattccatgaactgttcgcccaactggtcggcaacgtctcccaagtcgtggtcggcaaggaacagccgatccgccaatgcgccaccgccatgatcgtcggtggccacattctgctcgaagacaatccggggaccggcaaaacgcagctggcccgcggcctcgccaactccatcgacatgtcgttcaaacgtatccagttcactccggatctgctgccgtccgacgtggtcggcgtaacctactacgaccagaagaacggcgaattcgaataccgcgaaggtccgattttcgcatccatcgtgctcgccgacgaaatcaaccgagcctcgccaaaaacgcagtccgcactgctcgaggtcatggaagagcagaaagtcaccgtcgacggcgaaacccatgcggtaccgcagccgttcatggtcatcgccactcagaaccccatcgaacaactcggcacctacaaactgcctgaggcgcagatggaccgtttcctcatcaaaacaaccatcggctatccgagccatgacgtaagcgtgaacatcctcaagcaggtcaacgtcaccgaccgtgcctccaccgtacatgcggtgctcaccggcaacgacgtgctgcgcatgcgcgccatcagcgaaaccgtgcgtctcgacgacgcgatcatcgaatacatcgtgcgcttggtggaagcgacgcgccacaacgaacgcatccaagtcggatcgtccatgcgaggcgcgctcgcactgacccgatgcgcccgcgtgtgggccgcgtccagcaatcgcggatacgtggtgcccgacgatgtgaagcaactggccgtcgccgtgctcgcacaccgcatcacgctcaccgcggaggccacattcgcgggatccacccccgaacagatgatcgaacagatcctcaatgaagtgccttcaccgaccgtgggcgccaccgcctgaaacgcacggcgcagccagccgcgtacgacacggcacacgcgaagcgcacaccccacacgaaacgttcgtaaacccccgaaaggtcaagcatgcgacaatccaaaaccatgcagcgcaggagaaccatgcaacgatccctgcgacgcatcaagcatcgcatcaaacgactggtcacctcatacgtgtcgccgctcggatgggccgtgaccggactcgccatcgcctcactcatagcgttcacaatcctcagctggcatgaactgctgaccatggcgatcgtgttcgcatgcatgatggtcgccgccatcatgctgtcgctcggcaacacgtcgttcaccgccaccatagacgtgtccagcaggcgcgtcaccgtgtcagacacggtgaaagtcgatgtgtgcgtcgacaatccagggcgcacgccaaccacatcagcacgcggcgacctgcccatcggagacagccacgaacgattcgccatccccatgctcgccgccggccaatcacgccaaaccaccgtggaattcaccgccgtctcccgcgcggtactgccggtcggtcccctgtccatacgcaaaggcgacccattcggactcgtacgacacgaaaagaaacttgtcgaccaaatcaacgtgttcatccacccgaaaaccgttatgctgaacacactcaacgccggaattccgcgagatctcgaaggccagccaagcggcgaaatcgtcgacgacgacctcgatttctacggactgcgtgaatacgagccaggcgacgacgtacgcaacgtgcactggctcagctccgcaaaaacaggcgcactgatgatccgtcaatacgaggcgacccgacgcaccgacaccgcattgaccatcagcgtgaaccccgacgactatgtgagctccgacgaattcgaactggcggtatccgtccatgcctccatcggcgtgcaatgcctgctccaaaaccgaccggtgacctcacacgcgggaaccgaacacatcatgccacgcaactccacggaattccttgacggctgcagcgccatctcccccgatatcagcgacaatccgaatctggcgcaaaccaccctcgcccatgcccccgactcatcgttctactacatcaccgtcggcaggctcaaaaacatcgacgaaatcaaacacatggcgctcgcactcccccgatccgcaacctgcgtggtactgcaaaccgccatcggacagccacgcgccatcaaacgatacgccgatttcaccctggcgaccgtaggaaacctagacgatctcccaatgatcatgggggtactggaatgagcaccacaggactttccacccacaacaccaacaccggcgacaccggccgcaccaccggattcggcaacaccttcaccggaaccggcaccggctcatgggccgactccacacactccgtcatctggatgtcacgagacggcaaatcacaggcactcccctacctacgccggacacgcgcctcgcaatacgcaagcctgctcgtcgcagccctactcaccctcgccgccgccagcaacctcatcgacgtctacggatcggccacatcctgggcgctcgccgccattccggccaccatcatcggatctctcgtggcgctcgcaggcacggttccggcacttcgtctctggtggcagatgctgttcatggccgtcgcccagctggttgtcggccctgtactgttcctcaacgacaccaccatcgcccatattgttccgaccttgcgcacgcttacacaaggctggatgaacatgctcggatcgttcaaattcattctgtcggtcgaacctcctaccggtaccgccgatggctgtttgctggccgtatggaccatctgcctgtggttcgcgctactgaccggcattttcgcagtgactgaagatgggcgattcaccatgatcgccattattcccgttaccgccaatcttgcgatttgcgcgctgctcggctcatcttccggctattaccgcatgttcgtaggcaccataatggcgctcatattggtgatttggatcagcgcacgttggaaattactggaattgggacgttggctcagttccgtcgtgatcgtggtgctttccgtcgcattggctattggaggatgcctcgtcgtcgatcaggaccgcaccattctgcgcgaccattatgatccgccgcttagcccgtacaattacaccagtccgttaagcggcatgcgctcgtacattacaaacagtaaggacgatgtgctcctcaccgtcgaaaacctgcccgctggatcaagcgtgcgactagcggtcatggaccgtttcgacggcaacgtatggaatctgtccgactccaccatgtcatcggactcctccaattaccgacgtgtcggcacctccatcaccaacaatgccgaaggcaagaaattcaccgccacattcaccgtggacaaaggactcagcgactactggctgcccatggccggagccgcatccagcgtgacattcgacaacagcgaaaactccgactcgttctactacaacagcgacaccatgtcggccatctacccctcacgcacctccgaaggtctcacctacacggaaaccggcatcatgccaacggttcccaccgacaaacagatcgccaaaacagacgcggccgccatcagccagccaaaagccgaagatgtgcccgactgcgtggacaaactcgccacagccatcgccggaggccaatccaaaggcggcgaagcggcccaggccttagccgaaaagctcaaagaatccggttggttctcacacggattaagcggcgactacccgtcaaccgcaggccacggcaactaccgcatcgaccaactgctcgccggaacggccatggtcggagacagtgaacaatacgcctccgccatggcattgatggcacgcagcctaggtcttcccagccgtgtggtactcggattcctgccaaaagacgacgaaggtgaaatcagcgaaagccgcaccgaagaacaaggaacaaccaccatcacgaaattcaccggcaacgacgtgaccgcatgggtggaaatcaaactggacggctacggttgggtggcattctatccaacgccaaaggaaaccaaagtccccgacgaaaaccagaacctcaccccaccgaatccgcaaaccctggtacgccagcccccggtaccactcaccgacccgctacgtgacgacacccaggccaaaggcaagtcctcaatcggcggaagcatggccgacgaaacctcagccaacctgttctggcagcatttcggcagaatcgcaagaaaagtagccatctacggaagccctctatggacgctgctcatcatatgcggtctcctgctcgccatcaaagcgatcgcactggcacgatcaagaaaacacggcagcacgcagcagcgtgtggcagccggctggcaatcggtcgccgcgctcgcacggcaaagcggactcgacattcgaggcacacgcagcgaacaggcggtttcgatcgcgaatcagatggatatttcccgcgagaccttgctcgctttgggcgcgcaagccgattacgcggccttctccggtaatttcgtcaacgaagagcatgtgcagcagtattggcgcgatattgcacaggaacgcaagtacatgctcaagtcattgccgacgttacgccgatggcgtgccaaactttcgcttgccgacgttttccacttccgcagcaaccgcagcgggcggaacaacggcagcgatcggaagcacaatcgtaagaaaggacgggactcatgatcttccgtagcatcgaggccggcctgaatagcaatgtcgggtgcaaaagaaaaaacaaccaagacaacgctctcgccagccgtggcgtatatgtcgtatgcgatggcatgggcggcggcaaaggcggcgagcgggccagcgcacaggtggcggcatgtttctcgcagcttgccgaacagccgtcgcgcaaccgtacgtccatcgaacatgcgttgagccaatcgcagcaacaggtgctcgaacttggccaggagcttggcggcatcgccggaaccaccatcaccggcgtggtgctgccgactcgcgttgaagatagcgtgcatgaacaagccatcgatgagtactgctacgtcatcaatgtcggagattcacgcacctaccatatgcgcgccgatgcggaaggccattggatggcggagtcgctgacccggatcacacgtgaccattccgaacggcagaacgccatcgacaccggcgaaatgctaccggacgaggcgaaccgatgcataccgcgcaatatcatcacccaatgcgtcggcgctcctgacggcattcagccggactggtatgcggcgcgctccacgggacgtttcatcatctgctcggatggcctgcacgcgcagatcgatcgggaactgctcgccgatgtggcagcctcatatggcgatccgcaagtcgccgcggatatgctggtgcagtccgcgctcgacgcgggcggcaacgacaacgtcaccgtgattgtgcttgatatatgcggcaaatcatcggattattcggcaaatgacgattggaacgtcagcaaaatcgacgatcacgaggatatcggcgatttacaggaaagcacattgcaaacgttacgtgccgtccaataatgcgcatgttctcgcaatgacaatcgtcaataatcggatttgtcacgttatatcagcgtattcaatacaatatttacagaacacgagataaggagatcatgatggtcgatttcgatgccgcggtggcggccgtgcaggatccgaacgcagatcccgtgtttctggcgaaaatcgcttacgaaaatccggaattcggcgcgaatgtggttgccaatccgcgtgcgtacccaggcctgaagcgttgggtcgcccaattcggcgatgagcgcgcacgacagcagctggtcgcgatggggtggccggttccgcaggacggaatcatgcagcaggaggccgagacggcttctgaacaggcgcaataccagatgccaagcgagcaggcgcaataccagatgccaagcgagcaggtgcaataccagcagccgcagcaatcatcggaagtgcaatatcaggcgcagcaccagccgccggcaacccagcaatgccagcctgaaccgtttgcggcaacacctgcatcgaatatggcgaacgatgcttcgacggaatacgtcgacccatataccaaccccgcagacctgtctgaagtggctgatttttcgccgattcagccgcaagagccagtcgcgtcgaatgctggtttcaccgcggaattggccatgaccacggaagatcagatgctgatggctgaaatcgcaagcaaagctccggagctgcaccccttccttgcgcgcaatccgcatatctacccggatctgctcaactggcttgccagtctcaatgattccgccatcaacgcagccatccgtctgcgacggtaacccttggtagaacttggcaaaagcccgacgaaagccgccaaacaaggcctaataaggcctaataaaagccgcttgcattggtaagctttcgtaccataatatgttcgttgcgccgtcatcctcatttatggattgacgacgcaacatgtatcgcggcgcgaaggaaatcagcgctgttcgaaagtgaagaactggtctccgatacgcaccgtgcaaggcgcgtcaagcttcatcggcttgcgttcgaccttgatctcctcattgccttgaatgatgtacgtgccgttgagcgaaccgtaatcctcgatccacaatacgccatcctgatcgaagctgatcgccgcatgattgcgtgagatggtgcgcgtcggatcctccaacttcacgaatttcgcaccttccggcacttcagcggaaggcttgcgccccagcagcacacccatatcgacgatcacttcctggccggtctgctcgttgtaaagcacatactccagcttcggctgcttcatggtgaacgccgaagacagcaccgtgccatcccagtcgatgtcatcatcgtcattgaccggttcgacgtcggacggttccagcgctgcggcagcctgttccaccggctgtatgttcgccgcatacgattccgcggattcctgcacattttccaatgcttggaatgcttgggattccggtgattcgtatgttggctgcgatgttggctgcgactgcgcagcctccgccatggcgggctcaacgagagaagacattactgtggcatcatcgtcataccaacctggttcaggtggaggcggatatggaagaaagctcataccttcattgtaatttgccatgcgattttgcgatgaagatatccgctctgcaatacgtacggttccgcaataggctgactgttgtcgtagggatcgcagcaactgcagttccgcattaaaaatagttccgcattaaaaaatggggatcagctgtttccagccaatccccattcatgtattgagatgatttcagacgttatgccattccatcatcgcttttcggatcacagggtgtcgcccaaatccatctgaccgccattgtcgtccaggaagtcatccggattgaagtcgtcgccgagcttcagatctccgaagtcgatgttcgagaagtcgacttcggacagatcggcgtcgccgaaggcggcatcggactcgtcgccacccaaaccgaagttcgggtagatggtgtcgcgaatggccttgtcaggctcgaccacggcgttacggtaacgggcaaggccggtacctgccgggatgagcttaccgatgatgacgttctccttgaggcccttgaggtcatcgaccttctggctcagagcggcttcggtaagcacgcgggtggtctcctggaaggaagccgcggacagccaggaatcggttgccagcgaggccttggtgatgcccatcagctccggacgaccggcagcaggcttgccaccttccttcacggccttcatattggcggccttgaagcgggcctgatccaccagttcacccggaagaaggtcggtatcgccggaatcgatcaccgtgatacgacgcagcatctggtgcacgatgacctcgatgtgcttatcgtggatatccacgccctgggagcggtacacggtgtgcacttcctccacaatgttcacctgggcagcacgcgggccgaggatgcgcaggatcttcttaggatcgacggagccttcgatcagctgggtgccggcttcgacatgatcgccgtccttgaccatcatcggggcgcgacgggtcaccgggtaggcgatcggctcgacggaatcgtcgtccggcttcaggatgacctgacggccgcgctcggtgtcttccaccttgaccacgccagcgaactctgcgatcggggcctcacccttcggagtacgggcttcgaaaagctcggtaacacgagggagaccctgggtgatatcggatgcggaagcaacgccaccggagtggaaggaacgcaacgtcagctgggtaccaggctcgccgatggactgtgcggccacgatgccaacggcctcgccgacatccaccagcttgttggtggccagcgaccagccatagcacttggcgcacacgccgcgcttggattcgcaggtaagcacggaacgggccttgacctcttccacgtcgtgggcaacaagatcgttgagcacgtccatggacagcgcgtcaccggccttgtacagcacggtctcgccgtcggcgggatcgatcacgtcggttgcgagcagacgggagtacggaccgccatcggcggccttgaccagatgcaggttgccttcagcatcacgctcgccgaccttcatcgtcaggccacgcttggtgccgcaatcctcttcgcgcacgattacgtcctgggaaacgtccaccagacgacgggtcaggtagccagactctgcggtacgcagtgcggtatcggccagacccttacgtgcaccgtgctgggagatgaagtattccagcacggacaggccgtcacggtagttggacttcaccggtcgaggaatgatctcgcccttcgggttagccacgaggcctcgcatgcctgcgatctggttgatctgcatcatgtttcctcgtgcaccggactgcacgatgatagccaggttgttcttggagtcgaagtgttcctcgaccgcctcagaaacctcgctggtgcacttggtccacaggtcgatgagttcctgacggcgctcctcttcggtgagcataccgatttcgtagttctcgttgaccttgtcggcttcggcttcgtacttctcgatgtactcgtcgcgctcggacggctggataacgtcggagaacgcgaaggacacaccggaccacggtgcgcgggtgaagcccatatccttcagcgcgtccagcgttgccgccacctgtgcggtggagtaacgggttgcgatgtcgtcgacgatcttgctcagacgcttcttcggagcctgatcgttcacgaacgggtaatccaccggcagcgtgctgttgaacagaatacggccataggaggttgcgaaaagcacggaaccatcatggaagcgctcttccttcaccacggccgggctgcccggttccggatcgacgacttcgatttcgctcggctcccagcccttcggcagcacaaagtcttccggaaggcggataagcaccttggcctgcatgtcgatctcatgcttgtcgagggccatttcggcctcttccagcgaggagaacacgcggccctggcccttggcaccgtcgatgacggtggtcaggtagtacagaccgaggatcatatcttggctcggcatggtcacggtgtggccgtcagccggcttcagaatattgtcggaagccatcatcagggagcgtgcttcagcctgggcttcagcggacagcggcaggtggactgccatctgatcgccatcgaagtcggcgttgaatgcggcacaggcaagcggcggcaggtggatggccttgccttccaccagaatcggctcgaatgcctgaatacccagacggtgcaacgtaggtgcacggttcaggagcaccggatgctcggcgatgacctcttcgagcacgccccacacttcggagtcgccgcggtccacgagacgcttggcgctcttcatgttctgggcatagttgaggtcgacaaggcgcttgatgacgaacggcttgaacagctcgagggccatcggcttcggcagaccgcactggtgcatgcgcagggacggaccgaccacgatcacggaacggccggaataatccacacgcttaccgagcaggttctgacggaaacgaccctgcttacccttgagcatgtcgctcagggacttcagcggacggttggaggcgccggtgaccgggcggccacgacgaccgttgtcgaacagggaatcgacggcttcctgcagcatgcgcttctcgttgttgagcatgatttcaggagcgccgagctcgatcagtcgcttcagacggttgttacggttgatcacacgacggtagaggtcgttgagatcggaagtggcgaaacggccaccgtcgagctgcaccatcgggcgcagatccggcggaatgaccggaatcacgtcgagcaccatggcctccggcttgttgccggtggtcaggaaggcgttgacgaccttcagacgcttcagggcgcgggccttgcgttggccggtaccggtgtcgatctcttcgcgcagctgcttggaagcggcttcaagatcgaagtcctgcaggcgcttcttaatggcttcggcgcccatgcagccttcgaagtaatcgccgtagcggtcttccatctcacgccacaggtcgacgtcgccttccatgtcgcccggcttcaggttcttgaagcggtcgaacacggcgctcagacgctggatctgctcgtcgaaacgaacgcggatggcggccatttcacgctcggcgctgttgcgcagcttggcgcgtgcggagcccttggcttcgccttcggcctcaagttcagccagatcggcttcgaccttcttggcacgctcttcgatttccgcgttgcggcgcttctccaagttggcgatatcgttgtcgaactcgtcctgcagacccggaagatcctcatgacgctgttcctcatcgacgctggtgaccatgtaggcggcgaagtagatgaccttttccagatccttcggagcgatgtccagcaggtagcccaaacgggacggaacacccttgaagaaccagatgtgggtcaccggagcggcaagctcgatatggcccatgcgctcacgacgaacacggctcttggtgacttccacaccgcagcgttcgcagacgatgcccttgaagcgcacgcgcttgtacttgccgcaggcgcattcccagtcgcgggtaggtccgaagatctgctcgccgaacaggccgtctttctccggtttcagggtacggtagttgatggtttcaggcttcttgacctcaccgtggctccagttacggatgtcgtcggcggtggccaggccaatcctcagtttgtcaaatgcgttgacgtccagcactctattgtcctgtctatcgattcttaatgcttaatcacgtttcatcaggctggtcgcgccgcgctgtcaggcaacgcgaccagccttgggatcactggaattcaggttcttccacaacctggtcttccttggcggccgcgtcaggacgtgcgccaatgttgaagcccaaatcgtcggaggaagtagacggatcgtcgtcctcgtccttcatgtcgatggccacgccttcggcgttgagcacttcgacgttcagcgacagggactgcatttccttaagcagcaccttgaaggattccggaatgcctgccggcggcaggttgtcgcccttcacgatggcaccgtagacacgcacgcggccgtcgacgtcatcggacttggtggtcatcatttcatgcagcgtgtaggcggcgccataggcctcgagggcccacacttccatctcgccgaaacgctggccaccgaactgagccttaccgcccaacggctgctgggtgatcatggagtacgggccagtggaacgcgcgtggatcttgtcgtcgaccaggtggtgcagcttcagcatgtacatgtagccaacggagatcggcttcggatacggttcgccggtacggccgtcgaacagcacagccttgccgtcgtcgccgaccagcttgttgccgtcgcgatccggaagggtgcaggacagcaggcccttgatggtttccggacgaacgccgtcgaacaccggagttgccaccggagtgcccggctcgcccttttcggcgccctgcggaatgtacttcttccaagcggcttcggtatccggatcaagggagatgtcccagccggcgtgcgcgatccagcccaagtgcagttccagcacctggccaaggttcattcgagaaggcacgcccagcgggttcaacatgatgtcgaccggagtaccgtcggcaaggaacggcatatcctcttccggcagaatgcgggagataacacccttgttgccgtggcggccagacagcttgtcgccctgggtgatcttacgatgctgcgcgatgtagacgcggatcatctggttcacgccgttcggcagctcgtcgccgtcttcctcggcatcctcgcgagtgatctccttgacggcgatcaccgtaccggtttcgccgtgaggcacgcgcagcgaggtgtcacgcacctcgcggctcttctcgccgaagatggcgcggagcagacgctcttccggagtcagctcggtctcgcccttcggggtgaccttgcccaccagaatgtcgccggcttcgacctcggcaccgatgcgaatgatgccacgctcgtcgaggttggccaccgcgtcctcgccgacgttcggcagatcgcgggtgatctcttcggcacccagcttggtttcgcgggcgtcgatctcatattcctcgatgtggatggagctcagggtgtcgtcctgcacgagacgctgggagatgatcacagcatcctcgtagttgtagccgttccacggcatgaaggcgatgagcaggttcttgcccagtgccatttcgcccttctgggtggccggaccatcggcaagcacggtaccggcttccacacgttcgccgtcgtggatcagcggaacctggttgtagcaggtggtctggttggaacgcaggaacttggccagcttgtaggagctggtggtgccgtcgtcgttcatcacacggatgatgtcggcggaaacatacgtcaccacacccggcttctcagccagaatgacatcgccggaatcgacggccgcacgccattcggcaccggtgcccaccagcgggcgctcggattcgatcagcggcactgcctgacgctgcatgttggtacccatcagcgctcggtggccctcatcgtgctccaggaacggaatcagggaggcgccgacggaaaccatctgacgcggggaaacgtccatgtagtcaacggagctgacgggcacatcgactgcttcttcttcgccgactcgggcaagagcctgcttcttgacgaagttgccgttctcgtcgagttcctggttggcctgtgcgatcacgtgctcggcatcgcggtctgcggtcatgtattcgacctcgtcggtcacatggccgttgatgaccttacggtacggggtctcgatgaagccgaacggattgatgcggccgaaggttgccagagaaccgataagaccgatgttcggaccttcaggagattcgatcgggcacatacggccgaagtgggacgggtgcacgtctcgcacttccatggatgcgcggtcacgagacagaccgccagggcccagagcggacagacgacgcttgttggtgacgcctgccaacgggttgttctgatccatgaactgcgacagctgggaagttccgaagaactccttgatggtggcgttcaccggacgaatgttgatcagggactgcggggtgatggcctccggatcctgggtggtcatacgttcgcggaccacacgctccatacggctcagaccggtacgcagctggttctggatcagttcgccgacctggcggatacgacggttgccgaaatgatcgatatcgtcgacgtccacgcgcagatccacatcctggccgtcacgcttgcccgggaacttggtgtcgccggcatgcagggtgaccaggtacttgatggtggagatgatgtcttcgcgagacaggctgcgatcgttgacatccttttccagaccaagcttgcggttgatcttgtaacggccaacgcgggccagatcgtaacgcttggtgttgaagtagaaggaatccagcaggttgcggccagcttccggcgtcggggtgtcggccgggcggatcttgcggtacagatcggtcagagcctcgtcctgggtctgcacggtctccttggcaagcgcgtccataaccagcgggtaatccctgaacgcatcggcgatctcatccttggtcatgccgatggccatgaggaacacgatggcggactgcttgcgcttgcgatccacgcgcacgccaagcacgtcacgcttgtcgatctcgaactcaagccatgcgccacggctcgggatgatcttcgcgccgaagacttccttgtcggaagtgcgatcctggctgcggtcgaagtacacgcccggagaacgcaccagctgagacacgatcactcgctcggtaccaccgatgatgaaggtgccgtgcggggtctgcagcgggaaatcgcccatgaacacggtctgggacttgatttcgccggtgtcgccgttttcgaattcagcgttcacatacagcggcgcggagtaggtgtaatccttctccttgcactcctgcacggtgtggcgcggttcttcgaaatacggatcggagaaggtcaggctcatggtctgagcgaagttctcgatcggggagatctcctggaagacctcatcaagaccggaggtgtggggcacggtgttggtgccgttcgccagatcctcctcgacacgcttctgccagcgctcgttgccgatgagccagtcgaagctgtcagtctgtacacccaacaggtagggtacatcaatgggctcgcggatggagccgaagttcacacggtccgacgccttgtgcagatcaatatcgtgctggtcggcgcgtgcgatgatggtggtggtgttcgtcgtagcctcagccaatggacgttccttatcgctcgctaaatcgtttcgatatgtttccccggaagcgctcccattggccaccatatgcctagtacgcgggcgcttcttccttgtcagcgtgcccgctatatgacacgcatgtacgcaaagtcatgagaataacatatcctatagatttttattcaatagtgacgccgaccggatcggacttcgctttgggatgcccttcaatcgaaagctgcgccgaatacacgccacgatccaccttcggcagggtggattgatcctccacgcattcgctgccagtacgcgttcccggccaggtgatcgtctgtctgacctcgtcgcccttcgccaacagacgatagtcggtgtcaacggggcacacattcgacttccaaaccacatcatcgcccgatttgatcgtcaacaccacgctggaagccgacacatcaaccaagcaaccaaccttgctggaaccgtcatatttgacgtccgtagtgaaatccatcgaatcgcccacaccgaaacttgacgccgcaggagtcaacgaaagcgcgacattggacgcatcgcaatccggcaccccgcttttcttctccttagtcggggacggcacttccttacgggaaatcgcatacacgtccgcatgatgaatctcacgattcaccgcgacaatccccctcgacagggagtacaggcaaaacaccagaaaagaaatcagcactatcgcagcgatgccgacgacgatgcgacggcgacgaaatatcgcctgctgttttttcgaacgtttcttgccggatttcgaggacgtcttctgtgccatgatttcacagtctagcgtgcgcacatccaaagaacgtcggcattcttcctttcataccggaagacgcacatccgcattcggcaggatttcgataagaccatcctcatccaacgatgcgatgcaccgatcaagctggatatggtcatcccacagtcgttcaagcgacttgcgattaagggcggtcgcaccttccggcagattgcgcagcgcattcagcaccagcccacgcacctgacgatccgtaccttggaaacgttgacgcggccgcgtgcgacgttcccccaatcccggacgaccattatgcaaaaacacgcaatgtcccgaaacagggcacgcctcgcacaacggagcctttgccgtgcagacggtcgcgcccaattccataacggactgattccacaccactgaaggacggtcgaaccgtctgcattttgaggcatcatcctgcggcaacatctgcttcgccaacgcacgttccgcaggtcttgcggcgccgccaagcgactcctcgccaagaaaaaccctcgaaagcaccctgcgaatattcgtatccaccaccgcgatgcgctcaccaaacgcgaaactcatcaccgcgctggccgtataatcgccgatacccggcaatgccagcaactcatcgtacgtacgcggcagcttgttatcgtaatcggaagcgaccacgcgggcgcattcctgcaatcgcaaggcgcgtctcggatagccgagcctgccccaagccgtgatcacatccgctttcgcggcatcggcaagcgcgaccgcatcaggccagcgttccatccaatcgttccaatacggtaccacacggctcatctgcgtctgctggctcatcacttcggagacaagcacgccccacgtagtagtgcggccgaaacgccatggcaggtcacgcgccgaagcatgccaccattcggcaagcgcgtccgccacagcttcagcattttcaatttcggtattaggctcgttcgtgtcgttcatcgtacctattcttgcattcatgacgaacgaagagcataccaatgacgcgcaaggcgcaaccgcagaggaagccaaagtcgagaaaatgttcgaatacggctaccgcaagtcgaattatgggccggacgaactcgtgaccgacgcgcacggcaatccgatttccgtggtcgacgcgatgctgtcagccgaagacgcggccaaagccgaaacctccacgccccacttgtgctactactccccccgcattccgggcaataccggttcggcaatccgcctgtgcgcggtgaccggcacgatcctgcatttggtggagccgctcggattcaatctgcgcgatacgaaactgcgccgtgccggactggactaccacgacatggcccacgtggtattgcacccgaattttgagaatctggtggaatccatgccgaattcgcgcatcatcgcgttcaccgcgcacgccaccaaactgtataccgacatcgaatacaagccgactgacattctgctgttcggcccggagccgggcaatattcccgatccgatggatattatggccggtccgcacgtggccgaacaggtgcgattgccaatgcgcccgagcctgcgttccctgaacctcaccaattgcgcatccatcgccatctacgaagcctggcgccaactaggcttcgccggcggccagtgatccctcccccgcctgccaactttcgtttcaattcattaccttatggatattggggacgcagtagggcgggatattccattcgtgacacactcaaggccgttcggccaagcctacggtcccgaacggaatatcccgccctactgcttgctatggcacacaaaccaacgtgttgcaaacaaaaagcaagcgtcaacctaatctgatgtgaagcgcaacataagcggggagccggcatgttctgtttcagaccgtaaagacttggcctgagcggcccggagcgtgtcgggaatagaatatgccggctccccgcgaccttccgcaaccaacgcaaccactgcgaaagatgcgtagggaagagaggggctagtttttgaagctgtggattggggcggggatgcgaccgcctcgggtcacgaaagcttcgcagctggtctggttgactggaatgatcggcgcatagcccatcaggccgccgaagttggccatctcccctacgcctttgccttcaaccggaatcacgcgcacagccgtggtcttctggttgaccatgccgatcgcggcctcatcggcaatgatgccggaaatggtggatgcggtggtgtctcccggaatggcgatcatgtcaagtccgacggagcacacgcaggtcatggcttcaagcttttcgatcttcaggcaaccattggttgccgcatcgatcatgttcttgtcttcggagacagggatgaacgcgccggacagtccgccgacgtaggaggacgccatgatgccgcccttcttcacctgatcgttgagcatggcgagcgccgcggtggtgcccggtgcaccaacctgttcgaggccgatcttctcaagcacttcgccgacggagtcgcctacggccggggtcggtgcgagggaaaggtcgatgatgccgaatggaatgccgaggcgacgggatgcctcctgtgccaccagctggccgacgcgcgtaatcttgaacgcagtgcgcttgatggtttcgcacaggaattcgaagtccttgcccttggcctcgtccaatgcacgggagaccacacccgggccggaaacgccgacgttgatgaccgcgtcgccttcggttacgccatggaagccacctgccatgaacgggttgtcgtcgggggcattgcagaatgccacgaatttcacgcatccgtaagaatcgttatctgcggtggcatgtgcgatgtctttgatgatgtggccgagcagttcgacggagttcatgtcgatgccggtcttagtggatcccacgttgacggacgagcagacaatgtcggtttcgctcagcgccttcggcagggagcggatgagcagctcttcggcgggggtcatggacttggatacgagagcggagtagccgccgatcagatcgacgccgaccttcttcgccgccttgtcaagcgcatgcgcgattttcacgaaatcatccgacgttttgcacgagcttgcgccgaccaaggaaattggggtgacagtgatgcgcttgttgacgatcggaatgccgtagtcgcgttcgatggctttgccggtggatacgagatccttggcgtacgtggtgattttgttgtagatgttgtcgcagacttcgtcgacgctgtcggccgcgcagtccagcaggctgatgcccatggtgatggtgcgtacgtcgagcttctcctgctcgatcatcttgttggtctcgtggacctccatgatattcagcatgatgtgttccttcgctccttaccgatgaaccctgatggatcagacgcggtgcatcttggtgaagatctcttcacgctggcagcggatgcgcacgccgatctcttcgccgagcttgtcgagatcgtccacgacctcgccgaattccttgtcggtgttggaatagtccacaatcatcatcatgttgaagaaaccgtcgatgatggtctgggaaatgtcaagcacgttgacctgatgctcggaaaggtatgtgcagacgcgtgcgatgatgccgacagtatcctgaccgacgacggtgatgattgccttgttcatggaactccctaaacgttaggtgcgaatatccagttaccgtctcggcaaaatgccggacgtgccttaagtatagaaaaggcagatgtcaaaaaagtcgttttttcggcaatcgcattacattgtgagacgatttcttccgtcaaaccggtttcaaaagttgcggaaagtcgttttttggaatatctgttttcgacgtgaaatcggatttcataaaagaaaagcgcctgccgatcgtttggaaatacgatttcggcaagcgctttttacaatatgtcatgcgattcacttttcgctgatcttgtcttctttcaggaagaaggagaagaccagcacgatgacgatcagcaccaagccgaacacatagccgtagcgggatcccgcaacgaagccttccgcatcggtggcgccggagcccatcgacagcaggcaggtggcgatggacgtgccaatcgcgccgaacacctgctgcatggtgttaagaatggtggagccgcagcttcggcatctcatcaagctagccgtatctggtctacggcatcgtgcctgctggccatcgtcgtgagatagctgtgcacccatctggcccacaagtgaatcatgaaaaacgcgcgttggcgcacgtccttttcatggacgtgcgccaacgcgcgtttttgcatcagcgtctgcgatcaggcctcgcggctcgcggaagccgcagcgaacgccggcaaggcgcgaggtgcgttgaaaccttccttttcgaagcggtcagcaatcttctgtgcgatctcgtgcccctggcccttatccaccagggcgatgatggagccaccaaagccgccgccggtcatacgcgcaccatacgcaccgttggcacgggccacgtccacggcaatatccaactcgggcacagtcacttcataatccgcagcgagcgaatcatgagacgcgttgaacagtcggccggcctcgtcgatcttgccgttggcgaaggcacgcacgaaggagttgacacgggcgatttcggtgatgacgtggcgcacgcgcttcttcatcgtgtcgtcttccagcttgtcgagcgtttccttgagcgcctggaacggatcgtcggacttggcgatgctgtcggcgaccacacgcaggttggccacgccgaggatttcggcggccttctcgcaagtggcgcgacgctgggcatactgtccgtcgttgagctggtgcggagcctgagtgtcaagcaccagcagttccagaccgtacttgtcgagatcgaattcctgctgggagacgttctccagcgggctcagctctggacggcaatcaagacgcaacgcatggccgaaagtgcagcgcatggatgcgttctgatcgagcccaccggtggacgcgcccgccatgtcgttttccgacttgatggcggcgttgatcagcgtcacacgaccggcatcggatgcgccataacccaaaccgtacacgtcatccaacgccaaggcggtggagcaggtcatggctgcggaggagctcagaccggatccgagcggcacgcaggaggagaatgccgcatcgaagccctgcaccgcatcgaagccggcttcgcgcaatgcccaggcaacgcctaccgggtaggcggcccagccttccacgccaccggcctgcaggccgtcgaggtcggcttcggtgacgttttcggagtcaacgtcggaaaccacgcgcaccttggtgtcttcacgcggcttgagcgcgatgaacgtgcggtgcggcagtgcgatcggcaggcacaggcccgcgttgtagtcggtgtgttcgccgatcaggttcacacggcccggtgcggcccatacgccagccggctcctcaccgtaggtggcacggaacagatcggtcgcgttcttcacaccctcgtcgtgcgagagcggctcaatgaattcaacagcagtcattggtgttttgtcctttgggttttattggctttcagccttcgatatcgattggtccgagctcgtggaagcgcttggcgatgagttccggcgtggtgtcggaaacccatgcggccatgccggattcggatccggccagatacttgatcttgttggctgcgcggcggaacgagaagaactgcaggttcaggcggtagttttcacggcgtgcgtcgtggatcggagcctgatgccatgctgcgatgtacggcaggtccatgcccttgccgtcacccttgtcgaagaacgcgttgccgcgcttgagcagggtggagtacatgacggccaaatcccaacgttcctggtcgttgagctcgtcgagggtgagcacgtcgcgcaccggggccacatgcacctcgaggggccagcgggctgcggctggcacgtaggccacccagctgtggttgcgcatgacgacacgctccccggcctcgatttcggagttcatgagatccttgagcaggttgccgccggtcttctcatggtaggcttcggtctgcttgagttcggcttccatcttcggcgcgatgaacgggtagcagtagacctgtccgtgagggtgcgccagggagacgccgatttcctgtccgtggttttcgaacgggaagatctgttcgaggccttccatcttggagatttcggcggtacggaacgcccacgcttccacgacggtgcgcagacgggagaccggcaggtctgccggcagaccgtcttcatccgggtcgaagcagatcacttcgcagcggcctgcagcaagcttcttctcccacagcgggttgccgttgacgtattccacggcttcggaacggcccggcacgcgaaccatcgacgggaagcggttttcgaacacgaccacgttgtagtcggtgtccggcacttcgccgtcttggtacgggtcgcccggcttgcgtgcggccagcgggttgcctttggcggtggcgccagggcccgcggtgatcggacggttcatgcgtgcggtcgccataggaatccagtcgccggtcagtggatcgcgacgcatttccggagcagcgtacggcacttcctcaccggccgcgttgagctgattggagaaacggtatgccagctgacgaggatcgttcagttcgcgcgtcttcgcgccggaaacgtattccggatcatcgtcgaggtagaagaaagcgcggccatcggcgagcgtggtcggcgtgatgcgaatgtgctccttcgcgtactctccgggagtgtagtttgcgaattcactcattatggttattcaccttcctgaataggctcgctctggtgtgccagcacgagctctttaaccaaatcccttgttttcccaaccgaatcggggtctagtccatcatcggtaatgaccgtgtccacctggtcgaagcgtgcgaaaagcgacaatgatgtgcagctccacttggtgtgatcggtcaaaattatggtgcgatcggcaatgtccatcattgccatatcggttgcggcctcaagcgagttcggcatgaggaagccgcgcggaatggacacggaatgcgtgcccaggaagactgtgttgacgcgcagggaggccaccactttgtctgcgatcgggcctacgagcgagttggatcgggtggtcacgccgccggtcacgatgacttccacgtctttcgattccagcgcctgcaccagttccgccaccggaatggagttggtgaggatggtgatccccgacgactgctgtgattccaacagatgttgcgcgaatacgtatgcggtggtgccgccgccgatggcgatcacgtcgccgggtgccacatatttgatggcttcctgtgcgatggcgtccttcaatccgatgtccatctgcgactttacggagaacagcggctcactcagcagcgtgctggtggtgacggcgccgccgtgcacacgcttcagcagacccttgtcggccagatcggcgatatcgcgtcggatggtcatggcggaaacgcccaattccttggacaatgcggtgatacgcaccgcaccgcgggtacgcaacctgctcaaaatcaaatgctgacgttgtgacgatatcattcgaacattatcgcacatgttcactcaaaataaaaactgagatgagcgtttcgcgcgttttcctcacgaaaaaatatacttggcactcctgtaatcgttcaaatcgaacaaaaacgaacgtcgacatcccgtcagcgaaatcaatcgacgtgttgctttcctgcgacaaacggtgcgagaatagtgaaccatgacgtatgtttctgagaatttctggcacgatgcggtgaacaaagccaccacagatctcttcaccttcggctacaagcacatcatcaagccgcatttcgtgttcaatcagacgcccgatgtggcgcacgaccagatgattcagttctgcaagatcaccaagaacattccgccgctgatgtgggcgtgccgtgaaatgctcaactattccgaccccgtgctggaaaccagcgtgatgggcgtcgacttcgtcaatccgttcggcctttccgccggcctcgacaagaactgcgagatgccggtgctgctcgacaacgccggcttcggcttcgaaacggtcggatccaccacgtctcgtccgtgccccggcaatccgaagccgtggttccaccgtctgcccgaatatgattcgatgatggtgcatgtcggtcttgccaatgagggttcggaaatcgttgttccgcgcgcggaacaggcttggacgaaggcgcgcgacatgcagatttccgtgtcgatcgcgcgtacgaatgatgataagaccggcgatttggacgaaggcatcgaggattactgcatttcgatgcgccgcacggccggtcgcaccgccatggtcgaagtgaacatctcctgcccgaacacgatggccggcgaaccgttcaatcagagccctgaagcgctcgacaagctgttcaccgaactcgacaagatcgaacgtccacagcccacgctggtgaagatgccgttgaataagtcctgggaagagttcaaggatctgcttgacgtgcttgccgaacacaatgtgcagggcttgtcgattgcgaatctgcagaaggaccgcgccggcatggagattcctcgcgattgggagggcggactgtcaggttcgccatgctatgaggccagcaacgaacgcatcaagcaggtgtaccgcgagtatggcgaccgttttgcgattgccggcatcggcggcgtgttcactccgcagcaggcgtatgcgaagattcgttccggctcgtcgttggtcatgttcatcagctcgctgatgtatcgcggaccgcagcagatcaccgtgttgaagcgcggccttgccgaactgctcaagcgcgacggattcgaccatgtgagccaggctgtcggcatcgacgcctgataccgattatttcaatcggcagcgagcaccaaataataatgcgccctgcgaccgccaacgcggtgcagggcgcattattgttgttcgattgttgttcgatattaccttggtttattggttgcgtttagtatgcgccacgcacatactgcggctggtagggcgcatcttcggtcggaataccgagcttgtgggcggcgcgaagaggccaattcggatcacgaagcgccgcacgtccgatttcgatggcgtcggcggcaccggatttcaaaatcttcttggcctgcttcggcttggtgatcaatccgacggccgtggttggaatttcggcacgcgagcgcacctgttcggcgaatggaacctgataatcgggtttgacgggaatggtcacgcccggaatcatgcctccggtggagacgtccatcagatcgacaccgtgcttcttcaggactttggcaaggttgacggtctgatcgagatcccagcctccggcggcccaatcggtcgcggaaacgcgcaccagcaccggcatggtgtcggggatgacggaacgcacggcgtccacgacttcgaccagtatgcggatacggttgtcgaacgatccgccgtattcatcctcgcgctcgttgatcagcggatcgaggaattgcgacagcagatagccgtgggccgcatgaatttccaccgcgtcgaagccgatatcataagcacgccaagcggcgtcgcggaactggtcgacgatggcatggatttcgtcaacggtgagttcgcgaggcttgtccaacggcccgaacgcgttggcgcttggccccacggtctgccatccgccctgctcttccggcacgctctcatgctcgtatccgatggagaagcagccggtggaagccttgcgtccggcatggttgagctgcaccgccatcgtcgcgccggcggccttcgcatcggcaacgatccaacgccatgcgtccatctgctcgtcggcccacaatcccaagtcgcacggcgaaatacgaccctccggcgtcactgcggtggcttccacgataaccatgccgaaaccgcccatggcacgtgacacataatgctggtagtggaatggcgtgggcaggccatcctgggccaacgcggaatacgtatccattggcggcagccagatgcggttgcgcacggtcatgccacgcaaagtcataggatcgaacaggccaaccgtgccattggttgtagccttcttcgaccgcttcgccttcttttcgtcttcgctcatcgtagtagctcccctccggtcgcacctactggctccttgccgatcggctgaaccttcttcttgtattccccttgagcttctctggagatttcgtgccataaaaccggcactatttgcattctacgcagaacgcccgccgagcgtggcgggcgttcattgattgttcacttccattcgctgaattgcggaagcgtcactcatcttcggtctgctgctgatcctgatcatcctgctggtcgttctgctggctttgctgctgaagcgactggttctgctgctgaatgattgtgctttgctgctgggtggcattctgctttccaccgccgatcttggtgaccgtgctggatgttgcggaatacttggccgcaggctgcccataatcgttgtcaatcggcagctgtttgcgttccgcataagcattcataaagtcacgccatgccggggccgcgatggtggaaccatcccagtagctgtggtactggccgttgatagcgatattcgcaatcgggtggccaaccgggttctgcacgtcaccgacgagcacgaatgtggcgatctggttcggaatgaaaccacctgtcgtaactagctgatcctcgtgggtaccggtcttggcgaaggtcttacgtccattggctagctgtgccacaccgcctgcgccgtcaggacggacaacgccttgattcatggcccaagcaagcgtttggatgatttccggatcgaccgcctgatggcagttcgcggaaggcaccttaatatcattgccgtccacatcagtcacctgcttcagcgcgatcggatcgcactgcacgccattggacgcatatacagcgaagatgcttgccatcgtcagcggggacacgttgacgttgccgaccatcatggcaggcacgaatgatgaggtcttgtcgagcgtctcaccggtattcgcatcatgatagccaagttcagttgcggtatcggcaatcttgcacaagccgatgatggatcccatggaagcctgcgtggtgttatgagaccttgccaaagccaatgccggcgtttccgggttcaccgttccattggttattgcgttggtgacgttccacgtatcagtgccgccggtataacgatcgcatgcgaacaacgaggtcgaatacctcgtggacgtctgcaggttctcgttgacggaatgtcccgcttccatccatgccaccagattgacaggcttccacgacgagccgatggagaagcccatgccgccgccgtcttctcgatccacggcatagttcatggaatccctggtctggtcgttctgcgccgcttcggtggcatcatacgttcgattcagaccgaagcccagcacttctccggtacccggtttgacggacgccatcacgatttccatgccggaggaatcttccggtgggatggtgttgcgcgcggtttcgttcaacaaggtgttggcatcgatatccaacgtggtgacgatcttcagaccaccctctttcagcagtctttccctgtcctcgctggtcttgccgaattccttggaattcaaaatcttatgcaccacgtaatcgcagaaatagcccgcatcatagtccgcggccatgcaaccggtggaaataggctggacatcaagcgtatctgcgagcggagtattgaccgcctcttgatattccgcatccgaaatatagccctgctcgttcatcagctgcagcacgatattgcgttgcttctcggattccggctggttcgattcgacggaaggatcgtaagcgttcggattcttggtgattgccgcgatggtggcggactgcacgatgttcagctgatctgcggtggtgttgaaataccgcttcgcagccgcctgcacgccatagaggctattgccgccaaactgtgcgatattgagatatccctgcaaaatttcaggcttggaatactgcttttccatttgcacggaaatcagcatttccctcatttttcgtgcgatggtatcttccgacgcatggtattgtgcgatcggatcgtcatcctgctgcgcctgcaggatcagcacgtttttgacatactgctgggtaagggaggaaccgccctgatggtcgcccttcatatatgtttggacgaacgcgcggaacacaccctgcacatcaacgccgccgtgagtgaagaatcgtctgtcttcacgcgctaccacggcctgctgcatgtatttggaaatcttcttcaacggcacgacttcacgattctgatcccagaattcggtgattttcgtggtgccatcggaagcgtacatggtcgacttctgcggcaggctggtcacatcaaaatcaataccttcgaccgacagcgacggaataaccgccttggcgacgctgttcgcgccgaaaaccgccggtaggaggaacaaactggcggccacgccgccacccacactcagcgtgatgtaggcaatcacgagtgcgagcacacgttgaacggtcaaagtcttcttttcgggcatggtgcccattctaaagtggtgggtctactaatcaaccggccgatcgcagccatcacgggtttctcacaaacaaccgtaaaacttgaaaaacactggaaaacagtcgaaaattatcgtctcgatcgtcgaataagcatgccaggctggtagatgatgatggaacggccctcacgcgcaatccatccacggttggcgaaatccatcagcgccttgttcaccgtctcgcgcgacgaaccgaccagctgcgccatttcctcctgcgtcagatcgtgcggcaccttcaaccccgcctcgaccggctcgccgaagcgtgacgccagattcagcagcgttttcgccaaacgtcccggcacgtccatgaacacaagctccgaaatgcgctcgttgttgtcacgcatgcgatgcgcgagcacctgaagcatgtcgacggccacgcgcggatgctcgtcaagccatgcgaacagggcgtcatgctcaagccatacgactttcgtgtcactggtcatggccacggcggacgcggtgcgcggtccaccatgcggatcgaacaccggaatctcacccagcacttcgccgtacgcatgaatgctcaacaactgcacacgtctgtcggacgattgccggatcagtttgacgcgcccgcgttccagcagatacatgcggtgatcggtgtcgccttcgcggaaaatatagtcgcccttgctgtattcggcatgctgcagatgcggcagcagttcctccgcctcttcggaagaaacctgcttgaacaacgcggtgtgcagcaacgtcgcgctttcgccactgggtccactattggtctcgtttggcgtagccatttgtcacacctccgttcataggcacatcctctgggcacgccgccaggcgtgttgccgggcgcgctgccgcggcttcgaaagcttgttgcgattccacatgccctcacggaacaccaagctttcgtaacgttctcattgcccttgatatcaggggcggcttcgaccatcgggctacattgtaactcgcctggcggcgtcgagcagccgttcaaccacgtcttcacgactcatgcccgtctgcgagcgcattggatcgactcgttttaccgctgatttcaccgctttgtccgacattttctcacgtgaggtgttcaatacccgccccattttttccgcgtcgatatcgtaggcgagggtcacgtggtgcagtatggcgccaggccctccctctactggtgtgaatcggcgttgtgcggctccgccgagtttgccgtattgcgtggcgatgtcgttgagtccggcgaatcgtacgtcgagcccgagttccttaagcgcgcgcaccagccagaaatcgcagagccggtatgattcctcgatgcttatgccttgggtgaaatcgaacggcgcgtacaacgagtaggtgatggtattgcccggttcgatgaacatcgccccgccgccggtgcaacgtcggaccacggtgaatccttccttctgcgcgaccgccgtattgacttcgtcttcgagcgactggaatttgccgatgaccacggccggagcggcccattcccagatacgcagcgtgggttcgcgtttgcctgccgccacttcgcgcgcccatgcgatgtcggtttccatttgttcgttcgggtcgcgcggcttgtcgtggatgacggtcggtttcaggtcccgccagcgttccagatattcctcttgtgtcagcgcattatgcattcccggttgttccccggaatattgtttcgtggacctcgcgatatttccgttgcccgttgcatcttccgcattacgcgattcactgcctgtgattgcgcggagaaaagcgatggcaatgccttctgccgtcatacccaccaatcgcacgttcggatagttcgaggtaatcgcttgcaatcgtcgcgtaatgtcgcgtgtgggcgcgcctcgctggctttgcagcaagttttcccaatcctgcaatagtcggcgggaatccttgtcatcgccgtcaagaaagaaatcgccgtcgatccgacattgttccacggattggatggaacttgcacattcgcggaaatatgctggaatgtcatcagaaagccggacggaaacccctacgagtttgccgcccggctgcttatacagccctctgcccatcaatcttgaagttcttggccgcgcccatcgcggtgccagttggacccgtagctggagcacaggatgaggactgcttcgatcagagcccagattccggaaatgatcggtccgatgaggatgatccatccgatcagggtcagcaacagctgggccacggccttgccggtgtatcccagatagaagttgtgcacgccgagggtgccgaggaacaggccgagcaggccggcgacgatcttcgacttctgcgcgtagccatagccgggctgctgttgggtcgcctgatagtaggtctgctgcgcgtaggttggtggctgattgtatgcggactgcgtgtattggggctgagtcggctcctgataatagggggtctgcgccgattgtgcgtaattcgtaggtccgtacgtcggctggccgtagatgggctgtgcaggttgcgcaggctgagtcggctgcccgtaagcgggagcggccgagccatatgcggggacggacgaaccgtaggcagccgactgaccatatggctgaccattgccgtacgtaccgccggggatgttgttgccctgcgtacccggggcatatccctgcacgggctgctgcgatgcgtacgggtcgggattgtgcggctgtgatgcaggctgattgtagccatcctgcgactgcctgtaatcggcttgagttgaatcgttcgtcgcgaaatactcgtcttggccggaaccgttgtaatcggcattgttgtcactcatggtttcaacaatatcccataatttgccttgttgctttcatccaccctgaaagcaatccctgaaatccccctgaatatgcgagacgcctgtcgaattcaagcatgaactcgatttcgacaggcgtctcaacaggcgaacatatccggcgcaatcatgcgttccggatcatatgtcacatgcgtgccagaatgtcgcgtccgacctcgtcggtggagcgggtagcggatcccagctcttcgatgtccgcttcgacggccgcatcgatcttggccgcggcgtcgtcgaaaccgaggtggcgcagcagcatggccgcggaaaggatcgcggcggtcggattggccttgttctggcctgcgatatccggtgcggaaccgtgaatcggctcgaacatggacgggtattcgttggaagcgttgatgcatccggaagcggagtatccgacaccgccgaccacggcacctgcctcgtcggtgatgatgtcgccgaacaggttgtcagtgaggatcacgtcgaagcgggacggattcgacaccatgaaaatggtggtcgcgtcgatatgcagatagtcgtgggaaacttccggatattcctcggcgaccttatcgacgatgcgctgccacatgtctccggcgttgacgagcacgttcttcttgtgcacgagggtcacatgcttcctgcgcttcatggccagctggaaggcgtaacgcaccacacgttccacgccgtaggcggtgttgatggaaacttcggtggccacctcgttcggggtgccgcggcgaaccgctccgccggcgccgcagtacaggccttcggtgccttcacgcaccacgacgaagtcgatatcacccgggttggcgagcggggaggtcacgcccttgtacagcttggacggacgcaggttgacgtactggtcgagatcgaaacggagcttgagcagcaggccacgttcgagaatgccggccttgatacgcggatcgccgactgcgcccaacaggatcgcgtcggtcttcttgatgcgttcctcttcctcttccggaagaatcgcaccgtcacgcaggtaacgttcggcgccaagatcgaaattctcgtaatcgaattcggcaacgccctcggccgccttctccagagccttctgagcccacggagtcacttccttgccaatgccatcgcccggaatgacggcgatggtgtacttctttgcagaatcactcatagcacgcgactctagtcaacgaatcagcacgtggacttaaaacgctcaactaatggacactccatgccgctttcctgtacgaaacacacgaaaagcatgaatcatacgaatctcacaaatcgcacagcctaatcagctggtaatacccatcacgccaagacaccaagcattctcataggagatctcctcccactgcttgtaccttccagacgtacccccatgaccagcctcaacctcaatcttcgccacggcatccacgcctgcacgctgcagtcgggccaaccatttcatcggctccacatacagcacacgagtgtcattcatcgacgtggtaatgaaaatcttgggaaaaaccgcaacccgcgcatcatttgcatcagacggcgcattctcatacggcgtatattccttcatataccgatacacgtccgcattatgcagcggatcgccccactcatcccactccgtaaccgtcaacggcaacgacggatcaagaatcgacgtcaacgcatccacaaaaggcacatccgcctcaacgcccgcgaaacattcgggagccatattcgccacggcacccatcaacaggccaccggcggaaccgccatcggccaccgtgcgagcaggcgacgccaaaccggcacactgcaacgcacgcacggcatcaacgaaatcctcaaacgaatgcttcttattgagcaaatgcccctgctcataccaagcacgacccatctcaccgccgccgcgaatgtgcggcaccgcataaagcacaccacgatcaagcatgctgatgcgagacaccgagaatcccggatccgaactgatctcatacgcgccatacccggtaacgaacatcgccgaatcacacgcaggcacatccctgcgccacaccaaggaaacaggaatgcgctcgccatcgcgggcggtgacccacaccctgcgctccatgtattcgcgcggttcaaatccaccaagcaccgtggcacgcctcaacaggcgatcctcgccggtcgccggatcgatatcatgcagttcgccgggacgcgtgtaactggagaacgagtagcgcatgcggggcgcatcatacgaaggattgcctcccacaccaatcgaatacaagcgccgggtctcccccggcatcgcatcggcggtcgcaccatccgatgaggtcatcgccttgcgggaaaccccatgcacggccgacccctcgccttgcgcggcggccaattggtcgagcgcgccccacacttcggcacgttcctcgttgatctcgtccaccgactcgtcgacatcccaatcgtcttccaacgcgtggggaaccagctcggtgaacttccatggacgccccgcaagaaaatcctccgcagcggcatccttcgtcatcaccgcaatatgcgtcaggctttccgcccggtactgcagcgccacataatgccggtgaatcgagatcccctcaatgccaagaccatgcgcgccctgcaaaatggctggattgcagggattggaatacggtgtgccgatcggcatctcagaagcgcccggttcgacctcgtcgccgtgctcgcatccgtacggcgaaccgacggccacacgcacgccctcacccaaacggtacgggggctcatgggagcgcatgtcgatcacatcgatttcgaaattcgggttcaacgcattgtgatagaccacggcgagcggaatatcctcaccgcgttcgccggcaccttcgaaacggctgaaactcacgtcgtattccacgtcctgctcgcgcggaatgaacgcgcggaattcgccttccggatcgtcggtggaaagcagcagcacttcggtggtagtcttcgacccggtgccgatcaccagattgcgttcgtcgaacgacaggccgatgccaacccagaatcgttcgtcctgttcgcggtacacctccacatcgtcgacgatgggagtgccgacgcggtgcctcatcaccgcgtatggacgccacgcgtcgtcgagcttcacatagaacacccattgcgcgtccggtgtgaagcaggcgccaccgatgcccttgaacacttccggcagttccttgccggtttccaagctgcggatgcggaaatcgtaacgttcgtcgccgctggtgtcggtgccgtacagcatccaacgtccgtctttggaaatatccatgccgccgatacggaagaaatcatggccttgcgcttcggcattggtgtcgaacaccacttgttcgccgtcgatgggcacgccgatttcaatggttggcggatcccaatcgtctgcgcctcgaataggcacacggcattgcaccgcatactgctggccctcctgggtgcgtacgaaataccagtagccatccatgcgtgtcggcacggacatgtcgttttcctgaacgtgcgacttgagctcgtcgaacagtgtggagcgtagggttttcaacggttccatgcgctgctcgcaataccggttctgcgcggcgacgtaatcctgcacgtcatgcgattccttgtcgcgcagccattcgtactcgtcgatgaaggtgtcgccgtggaatacgcgctccttcggcacacgcttcgcgatcggcatcccgcatttgtcttgcacgctttcgtcgctttctcgcgcgcccgttgcgccctgttcaccccgaaaatcagtcatgcacgcgattataccggcattgcattcccaatcccacgcggcacgcaccccctgctccgggcgtacgaaaaagtcagacgcccatctgttgtttcaggaacggcagcatggttttcatcagattcgaaccggtcgttcccgtgaataccgggacatcggtgaccgggatcggctgcgtgaccgcacgccccgcaacggtgccgagattgccggcgacttcgcgtggagacaactgccggatgccgatcgccagcacacgccctgggtatcggcgtgcgatcgtggcgtacgtggtcggatccctctgcccgtcatcgccgatcagaatgaacttcatatcaggaaaatcagccatcaattgttcggcatactcgagtttgtgctgcactccggaaggaatgaacgttttcgggcgaggatcgaggtcgcgcaatagcagcggaccttccggaaaaccatggttggcgatgaaatgccggatcgagctttccacattccatggcgatgtcgacaggtagaagaacggcgcgtccgggaacatgtccgcaatgcggttgaacagcaggttcatgcccgcaaccggcattttcttctttggatcgagcagcagcagattgtaggcggctttcatcaggcttggcgcctgcgtgaccatgatggtgtcgtccacgtcggagatcacgccgactttcgtaccgctggggatggtgaacaggttggctgtgaccggtttgcggctgcgtaccttgtatgacacgtcgtgcacgcccggttcgagcgaatgttcggccacgagatcgagatatcctgcggaatcggaggctgcgaattcactggagacattgcgctgcgcgtccacttcgtcgtgcacttcggacgcgcccacctgcacggtttcgaggggcacgccgtcgatggcgatgcgcaccttcgtatgcggcgaggggatggtgagcatggcacggatgccacgggtcagacggcccgcctgacgtttgaagggcccgtacacggttcggcagatcagtcgagagtaatgttcggtgccgtagccgacatatggttccacgcgcggataccagttgagattgagcaccatgcttgttgagaacgtcacccacttgttgaacgctctggtaatggtgcggcggaacagtcgtgtcagcggaggcttgacttcgatgcgttcgtgtttcgaagccgcgtcgaaggtggtgaccaccttgcgtgcgggaatgggcacggtcggcatgtcatcttcggatatggaatccggttcacgctggggcaacggctgcggttcggtcataaccccactataaaggcgattattgaattacctggtaccccagcgtgaaaatcagggatttttcagggaataccgatgatttcccatccaatttcccgaatcgtgccgttcactgagccacgatgttggcgtattcctcggaggaaagcagtcccggctcgtcatcctcaagttcgattttgaaaatccagccttcgccatacgggtcacccgttacgatgcttggatcgtcggcggcctcgttgttcacatagcgaatcacgccggccaccggagtgaccagcggcgtgaccgccttggaggattccagttccgccacctcgtcgcccgcctgcacttcggtgccgacttccggcagatcgatgtacacgagttcgccaagctggtcggccgcatattcggtgatacccaccatggccggctcggtggaagcatccacccacacatgctcgtcggaatattcaagatgctcaggcacatccagattcggcttgttatcgttttcttcgctcatgaaagctcattctacgtcaatcgtatgtatttccctagagcagtgccgaaacttgttacgggaggtcgtggccgagccattcttcgatcatgtagcgggcgatggtggcctttccgggagcttccatacgccctgccaccaactcgttcatgtattcgtcgcgggtcacccaacgcgcctgcagggtctcgtcgccgtccacgcgcacgtcggtggtgttggccacgcctttgaacgccatcatgagcgatgcggggaacggccatggctgcgatcccaagtatttgagttcgccgatgtctatgccgacttcctctttggcttcgcgccggcaggcatgctccaggttttctccggcttccacgaagccggccgatacggagtacagtccggtgttgcgccatgcgctgttgtgttgcagcagcagacggtcctcatggtccacgatcgccgtgatgacggccggttccactctggggaacagcagtcgcttgccgtccgcttcgctggtgcagcgttgcgcccatcctcccaacgccggttcggtcggagcgccgcatgtggggcaatgacgttggcgcgcatgccatacgcccagcgagatcgccgtcgtggcctggcctgcctcgcgcgcgctggcatgcggtgcgaatccgcgcagatcgacccagtcgaatcgttccgcagcgctttccagcaacgatttcgacgttttcgcttccggttcgtgctgttcgccgaacgcatcgtccgcgcccatatgctcgctgcttgcggccaccgtctccgcggctttcacgcgagacacgtcaacggcgaccacgtgttcgtcgcgtttgccgccatacgatccaaggaatatggcgagcgccgtcggatgcgtgtgcagttccgccgccacgtaggcgccgggcaattgcgcgagacgcatatgcacgttggcgtagtccgcgatggctccctgtccgcgcggcaccgccaccatgccgtctttgacgagaacgaccttcgtggccggctccagcagcgccgtgtcgaacaggtcgggttcgccgcgtctcgaaacctcatagtcgatgtcaccttgcgcaagtggcaggaacggcagtgcctgagtcagcgccaatggtgagaacacgctcatcgcttgcttctttccttgaatacgattgatagagcggatattttttctctattccgtattttcttttctatttttttatatcttttttgtatttctgattgcgatattgacggcagcggcggaaaataccggctactgcaccctgcgcaccagcgcgagcagcgcgtcggcaaccgcctgcggatgctcgtatgcgctgaaatgcccgcaatcgaatatcaccgtcatatccgcgctcgtgcctgtcatcgcatcggcgatcggcgtcatcacgctcggagggctcgacggatccttgtcgccgcagatcaccgcaaccggtgctgtaatcgcaggcaacacatcgttcagatccgggcgcccagccgccatgcgctcacgccatgcgatgccttcggcaggctgttcgttgatccacgtcgtgaactgttcacggtaggcggccgactgtttgatggtggaatcctcaggtgtggatgccgcaaatcccatcaccggctcatgcgtgcccgtcgattcacatgcttcggcgatcgcgatgcgcttcgcgcgcatctgcgcggaatccgccgcggccttcgtgtcgcacaatgccaacgcggcaacagcttcggggtgcagacgctgaatgtcgagaaccagatagccgcccatcgaaaggcccgcccaaatcgccttgtcgtaaccggccgcatgcaacatcgcgacataggcgtcggccatatggtccaaaccgttcgggaaagcgccgtccgcgtctttgccgccactgatctcatcggaaggaatcggcccttctcccgcaccgggcatgtcgggaccccagatcgggaaccgtttcacaccatgttccacagcggccgcctccaacgcctccgcacattcgtcccacatgcggtggtccacggggaacccgtgcaccagcaccacgggaagcccctcgccctcgcaatacacgttattatgtaattcgatcgtcatcgtctcactccgttcctctcccctatattgcctatgtatctatcgcttgcgctgcctgcattcgcaagctgccacgcgctttcctggcgcccacggccgaccggtttcgacgtcaaccataagcctgtcggctacctgccggcccaagcgatcgcctgacgcacaatcgtgccatatccgttgctcatctggtttatgaaagtgtcgaggatctcgctgttcgtgttgacccattccacgtcaagcgtctcatcctgcggcttgcagtcgcccgcgatcggcaccacgtagcacaatgcgatcgcatgctggcgggaatcgaaataatcggatagtcccggcgtcgggaaaaactcggccacggtgaacggctgcagactcaccggcagctgcggcaacgcgatatcgcccaaatccttggcgacattacgcgccacggcctcacgcaacgattcgtgatagagcacgcgcccggcaatcagcgttcgctcgatactgccgtcgtcagacacgcgaagcaacgatccgacctgtgaaacacgccccagatcatcggtgcgcaccggcaccacaagcacgtatggaatcggcatttcgccgcgcatacggttgatttcgccggaagcaagccatcctggaggattacctattccgcgaatgaaatcctccggcgtaatgtcgtcgaattctccgcgacgacggcctgcatcgaaatcgccctcgtcgggcacttcatcattcatcactggcatagtcccattatcacgcatcttgtgtgaattggctggaaaagaatgcgccgaaagacgattcttctgacagcggatattgcatatgccgggaatgcggcgggttgggacgcggttatatactccaaagcaatcgcatacgaggggcgtagcccgtcacgcgcgtcgatggaacgaacagcaaggagcaatcatggcaacgcatgcggtcacttcgcaggatttcaatcaggtcgtcgaatccaacgatctggtattcgtggatttctgggcaacctggtgcggtccgtgccgtgcgttcggcccgacgttcgaaaaggcaagcgaagcgaatcctgacatttatttcgcgaaggtcgatatcgaccagaatccggatctcgcctccgccgccaaagtgcaggccgtgccgaccttgatggtgatcaagaaccagcagatcgtattccagcaggctggcgcgttgcgcgcgtcggatctggacgatctgatcgcccaggccaaggagctggacgtcaatgcggccgctgccgaagaggctacggaacaggcgcaataaggcgaatatcaaaggatcgcaaaggtgccgttcgatggcgaaacatcaacggcacctttttgctttgcacgcttgttttgcatgcccgctttgcctgcctgttacatatgcgctcgcccggattccatggcatggagtagaatgtcgcgttggatatgcgctttccggcgaagcctgaagtggcggcgcaccgcatgccgtgcatgtgtgaattcgtcgaggatctgaacgcgcgtttaggagcagaatggctaaccacagcaagcacgcccgatcgtctaccttcgccatgccgagcaagtcctcgctggtgaagatcgccgcaacggtcgcggcggtgggcctgttggctaccggcggcattgtgtcgcgcaatctttacacctccgcggagcagaacacggccaatcaggtcacggccttctccgtcaccgattccgccgaagcatcccgtggcaacgcccgtgagctgctcaatggagacacctcgtacgtcaccgtgaagatcaacggcaagtcgcgcgtggtgcccggtaccaatttcaccgacgtgaagtccgtgctcgacgcgggagacatcacgctcgaaccggaagacacggtctccccttcgctcaccaccaaggtggatgagaagaccgtaatcaccattcagcgtgccggcgcaagcgttgaggtttccgacaccgccatcggtttcaatgtcgtcaagaaggaaacctcaagcctgccggaaggccaggagaaggttgagacggaaggcgaagagggcgtgatggaaaccacgaacctcgtaaccaagtccggcgacaccgtggtctcctccaatatgatcagctcgtatgtgaagaaggctccggtcgacaaggtcattctcgtcggcaccggctccacttcgtcgtcgtcctccagcgcttccgcgtcgatcggcaccactgtgccggcgggcgaaatgcagcagtgggctcacgattatctgctgtcgaacggctacaccgaagccgatttcaccgccaccgtatacatcatcacccacgagtccggctggagcgtcaccgcaacgaatccgagttcgggcgcctatggtctgccccaggcgttgcctggcagcaagatggtgagcgcgggcgccgattgggccaccaattatcagactcagctcaagtggttctggggttattgcgcgcagcgttatggttccattcagggagcctacacgtactggctggccaatcactgctattaaatcgcgattgatcatcattgattgattcgatgatgatatagtttgagctccgtaatattcgaagatattacggagctcaaactatattacgatcttaaatatcactgggatatcgccgatttcacagggcattgttggaaccgatcaccgtggcttccttgacgtcatcgatcttcctgcgcctgcggccgccgtgaccggccttcggaccacgcttgccgacggtgccgctgcggaccccgttcttggcatcgaagatgatcacgcgctcatcgctgtgatattcgccgtccagagcgaagaaggcgatcttgtctgcaggcacttccgggaaggtgaagaacttctgcgtcgcaacgagcaggtcaaggttgcgggtggtgacggaagacggcgtatcggcgttcggagcattgaactgaagagcgaaatcgtcattctcatcgcatacctggattgcgaacttgccgcgctcgtaattcaccagcagcttgacgtattcaggacgtccgagaacttcggaaacacccttggaaaaacgaacggattcaagcatgaccgtcatggtcaacttgccaccagttctttcgccaacttctttgaaaccatcaagaacggacatgtaaatccttcctttattgtaaataactacgtgaaatactgtacctcattgttaagaataaaacgaatcgaatttcggggaatatattcatattttcaagaacacaacgtaatacgaaaaacataatgccgatttcgcttatgtaaaaccagaaaattcgatacgattcgcatggttcgtctcaaaaccatctcaaagcaacaacaaccccttgtctccccggcaatcgactgtcgcaagcatacaaatatatacgacatgcctcgaaacagccacatgcaaacgtttctgaaaatcgtttcaccgcatgcacccgtcaacagcctttcccccgcttcttcacccctcttcagggcaacgggtacaatacgaaatcgtcggaaaacacgaagaaacacggtaggaaaggacagacccgtgaccttcaaccgctacatcctcttccgcatggtcgttgaatttgtgggagccatcgcctgcgccatccaaatgttccagcatcacacgtggccgggcatcatcaccatgggcgtgttcgcgctggtgtgggccataggcgagatctggctgagcacggtgtacaaccgcgcgcatccccgccgcgacgagctgtccgacgagcatcaggcaacggccatccgtttcacgttcttcgtgcttgtggtggcgctggtggtgttgggcttcgcgggcatgatcgtcacactgttcaggcatgcgccgttcaccgttcccgccatggcgttgccgacgttgggcatgctggcgctggccatcgccgacgcccgctacctgtggcttgagcatgagggcggggacaccgatgaagactagtttgaagttcaaacgtatggaacgcggcttgaaacaggccgatcttgccgacttggtgaacgtgcgccgcgagacgataggacgcctcgaacaggggcagtattgcccgtcgctacgccttgccatggatcttgcaaaagcgcttgataccacggttgaagacctgttcagttttgacgacgaagagtgacgcttcggcgtgttgcgtttgtaaattcttatcaaaatggcgattttccaacgaaaaatcgccatttttcatattcgggggcatgtgcgaacgtcgtcacatggtgtgacaacgccgtcacatatgtgcgattcacctcacatcccccgagagcgcggttctcaacgggggcgtatagtcaaggtcgtagcgggaaaccactacggcaaaccgctgaaatgtacgttttatttagagaggaatcacgattatgaagaagaagatcgtcgcaattctcgccaccatcgccgccgtgttcggctttggctttgccgctaacaccgctatggcttatggcgcgaccggcaccgtttccggcaacgtcgccaccttcacgtttacgggactgactccgggccagcgctacgtggtgtcctacgatgacaccaccgtcgagaacgtcaccctggctgccaccaagtactccaacgttaaagaggcacacgaggacggcaccctgaccgccacctacaccttcaagtctggctttgctggcaccatcgcatcttccatctacgcagtcgatggggcaggcaatccgaccggtgccgctctcgcttccgcctccgtgaccgtcgccgctaccggcgaaggcaccgccaagaagaacgagaccgcttccaccggtgctgctatcgctccgtacgttgtggccgtcgtgctgctggctgccgctggcatctccctggttgccgttcgcaagagctctgctcgctgaacaataaccaagtagatacacaccatatctatgtttcatgaaggggcttgggttttcccaagtcccttcatttattcgaaaacaagcatcgtaaaaccgattgttttcttttttcaggaagagatcatgaaagtcctgtttatctgcaccggtaatatctgccgctctcctatgggagaactgctcctcccccaattcatgcccgatcttgaatccgacagtgcgggcacacgcgggctcgtttcgcacgaaatcgcaccgaacagcaaaaggctgctcgaccagcatggcatcgattccagcagcttccgcgcgaaacgagtcaccccgcaaatcgcgcagggcagcgatctcatcctctgcttcgaacacgagcagcgcaaggaaatcgcggtgattgcaccaaccgcggcccgcaaaaccttcctcatcaacgatttcgccaacatgtgcgtctactgcaaggaacaggggtacatggggggtaatacccggcaggaaaaactcgaatcggtaatcgacaacgcaagcatgatccgaccgatgatccccgataccaacaatgtggaggatccgatcggcaaggacttcgccgtatatcaggcagcgtacaacgaaatctgcaaggctttgcagaccatagcaagcgccactgcctgaaaacgttgaaatatcaacgaaccaagctagaaagggtgcccacctccctccatgggggtgctctttgctagtatggaacctgatcaatatgatgtgacaaatgtcgaggggaaacatggctgcagcagaaagcaacgtgccagcaaccaatcaggtggtcgtcgaatccaatgatacggaagacgacggcatcaccttgatggatttgttccgtatagtccataagcatcttctggtgggcatcatcacgttcgtggtggttttcgcagcggtgtgcgcatacacattcctggcacccccgaagtattccgcgaccgcgcaggtgttcgccacctacagtgattcgtcggtgcaagacaacaatatttccaacatcaacagcgccagcacgtatatcaccaaccagattcagtcgtatccgacgctggccaccacggaatccgtgctgaagccggttatcgacgatcttggcctcgacaccaccgtcgcgaatctggccgggcagctgaccgtcacgaacccgacgaacaccgcgttcgtgaacatcaccgccgaaacgggagacgcgaagcaggcttccgacattgccaacagcgtggcggaatccctgagcaatgtggtggagaagtcgctgtatgcctccggcaaggagtcgccggtgaagctttccgtggtgcagcgcgctgcggagccgatctcccccagctccccgaaggtggcattgtacttggccgtcggcttggtggcaggcctgattctcggcgtgttcgccaccctgatccgcgatcttatggcaacccgcgtggaggaagccagcgatctgcaagacattatcaacgcgccgatcatgggccgcatccccaccgacgaaagcctgcagagcaacaagccgatcatcgtgtcgaacccggccggccgtatcgctgaggaattccgccgtattcgcaccaacctttccttcacatcgaaggttgaaggcagcgatgcgcgcatgatcgtcatctcctccgtcggaccttccgaaggtaagaccactgtttccgtgaacgtggcggccgcccttgccgaaaacggcgccaaagtgctgctgatcgacgccgatttgcgtcacccgtccgtagccgaacgacttagcctggaaggcggcgccggcctaacgcacgtgctttccggccaggccaccgtgaaggatgtggtgcagcgctattggaagccgaacctgcatattctgccggctggtccgaagccgccgaacgcttccatgctgctgaactcgaagaccatgaccgaattgctcgacgcggctttgcagacctacgattacgtgatcatcgacacttccccgatggtggtggccaatgatgccactgtcttcggctcgaagagcgacggtatcgtgctcgtttccggtcgcgacgtgaccatgaagcgcgatctgaaagacatcgccgtgcagcttgacaacctcaatgtgccggtggtgggcttcgtattcaacctcgaaaaggaacgcaagtcttccacgaacggcaattactactattactactattacgacgaggatggcaagaagagcaagcacgctcataagaacagccgcaagaagtccaagcacaactaagctgctgggcttcagggtttccgccctctatcgcgagtcggaaaccagtctaagtaaccgaaaaggggttgcagcaaatcgttaagattcgctgcaaccccttttccatgcccaaattttttgccttcagccggctggcccgcaacttcgcatcagctgcggaggaggatctcctccaaggcgccgatcaccgcatcgggcatgccggaggtgacaaacagctcgttgctgaaacggggcgcggtatcgaaggtgcgcagagccccgagcgcacgcactccttgctcacgaatcgcctgcatcgcatgctctttggaaatgtacggcatttgcgcatgcaagagcacgtcaagcacgtcctgttcgactgaattctcagcaatctgcagtccgtctgcaatcgtaacgttcaagcatgcagtagacggcacgtcgcgcacaacgaccgacagactcaacgtctgctgatcgtatgtaatttctgcagtattgcaagctttaccgccaatttcgatacgaacgttctgcgtgtctggctgtgcaactccacggaacacaatctcccagttacgctgtgccggaatggcttcagcacagccttccaccggactgatggtgaactgcgtggcattgtccgtattcttccagtcaaggctcatgcgcgtatcggcaacatgagtttggccatcgcaagactcggcagatgcagaaccggaagcagcagaggccacagaaccatcgtcttccttgagtgtgaacgaaccgttcgcaccggggaacaccagcacctgcagggactccggattgcccagatcattcaccttattgccctcgccaagctgctgcaacggcacgataccgccagccttggcaaacaccggcatacggtcgatcgcacgccacacttccaaacgacgcccggactctcctgccgaaacgtaacggcgaccatcgaagaagtcataccattcaccttgcggcagccatgcttccgtgctacccagctgcgcggaatcgtcattgtcagaaacaattggtgcaaccagcagctcagtgccgaaacggaattcatccggcacctcgtacgcctgcggattattcggctccgcccaatacatcggttccaccaatggcataccctcgaacgcggcacgatagttcatggtgtacaggtacggcagcatcatatggcgcagtcgcagcgaacccaccatggaatcgcgcacttccgcggagaagttccacggctccttgcccatgaactgcgaattgctggaatgtaggcgattgatcgggctgaacgtgccaagctggtaccaacgggcttccagatgttcgttacgatagccacacatatgaccgccaatatcgtgactccaccatccgtagccgatattcgacgcggtagcagtgaaatacggctggaactgcaaggattcccacgtaacaatggtgtctcccgagaagccaaccgggtagcggtgcgaacccgggccagcataccgcgagaaggtgagcggccaacggttgttgcgttccgtgcaactcacgttacgtttggattgctcgacatgcatttcatgctcatcgcgagcgcccggctcggcgcacttttcgcattcgcagttctcatttacattgcgttcggaagaagtctcgtagcgcccggaatccaggtagtgcaagtggttgagcacccacagcgggtcaagtccgggctggcgggtcacgccgccctgctgccagtcgagccaccagaagtcaacgccttcggcttccatacgatgatgcatgtcgaagtaggcgcttacgaaatccggattcgtgaggtcgaattccactgcctcttcggttgcgggatcaatgccgacgcgcttggccaccgcctcatagtcgtcttcgaacgcgcgcacgccgtctcgcggatgcacgttcaacgtggctttcaggccgcgctcgtgcaagtcgcgcaagaacgcctcatgatcgggaaacagctgcttatcccacgaatagccggtccaaccggaaccgtatttcggatcgacatcgtccacgcggtgccagtccatgtcgatcacggatgtggtgaatggaatgccttcgcgcttgaaccggtccatgagctgcaggtattcgtcttgcgtgtagcggtagtagcggctccaccagttgccgagtgcgaagcgcggcagcagaggcgttggtccggccagcttgtagaagtcttgcaccgcttcggtgtagcggcggccatagccgaagaagtagaagtcggtttccgcgtgatcgcgtggcataacccaagcccccagcggattcggtttgccgttcacttcgtatgcttccacgatcacgttcgcggcggaatcgtcgagcaccgcccatccgtctcgcgaaatcacaccatcgtccagaggaatttcgccgttcgcctcgtcgagcgtgcgcgcggtgcctttaagattatgcttcggttcgtcgccgtaatgccacgtattgaactgggtgtcggccacgcccttgacgactacgctcaagccttctttgctgaatggcttgccatcgtacgtcacatacagcgcgggggtgtcaacaatgagcagtccgtcgcgatgcgtcaccgtgaactgcgtatcggcaccgaaatcgcggttgaccaccatttgcgtgagattgtcctcaaattcgccggaatcagaccattcgaaacggatcagcgattccgttagaatgccaatcctccaatgatccccttgtaaaaccgacgattctcgcattttcggacgtgccttgcgcacatagtcgacgaataccgtgccggttgcgttatctaatgcgttgtttgccatactactcctgccttacttgccactgcccgtcgcaatacctgcaatgaactgcttctggaaaatcatatacacaatgatcactggaacaattgccaacgaagtcgctgcgaacaatccgccgtaatcggtgccgtattgtccgttgaaggccttcagaccgacagcgagcagctgcttgtgttcgtcggtgatcatcaagaatggccacaggtagtcttcccaattccacaggaaggtgaagatggcgagcgccgcgatggtgttatggctcattggcagaatgatgctatggaagattctggtttcggatgcgccatcgagtttcgccgcttcaatgagttcgtcagaaattcccgagatggattggcggaacaggaagataccgaatgcgctgatcatgccaggaagcacgagcgacgtgtaggtgtcttgcagaccccagttggtgaacatttcgtattgcggaatgatggtcactgcccaaggaatcatcatggtgctcataacgatgccgaaaagcaggttgcgaccacggaatcgcattttagagaacacgtaaccaagcaccgcacttgtgtagattgcaataccggttttcagtactgctacgatcagcgagtttgcgaacaatcgcaagaaattgaacttttcttggatgctcacataattgtcaatcgtggatggcttagggaataatcctccggtcactttgacgatttcgctatttggcgcgaatgatgaaatgaacatccaaacaaatggaacaatggtgatgatggcggcgatgaagagcagaatcgtaagaatgatgccgccaattttacgtgatttcatgccagttcctccgaatctccagaaaccttgaacatgatgagggtgagcacaccagtgaacaggaagagcacaactgcctgagctgacgcgacgccgaagttgtatttctggaatgcctgatcaaagatgagatagctgatggtgtaggttgacgtgcccggaccgccttcggtcatgacgagaatctgcacgtatgcctgcaggtagctgatcagtgacgtgatgacaatgaacaaggtggttgatttaagcaacggcagggtgattttgaagaaaatctgcactgagttggcaccgtcgatggcggccgcctcgtacacgtctcgaggaagattcatgagaccggccaaatatagaacggtcgcgtagccgaaatccttccaaatggtcatgatgatgactgccggcatggcccatttggtgtcgtgcagccagttgatgtcgagtcctgtgattttgtttaccatgccgaactgcgggtcgaacatccacatccacacgaaagaaactgccacgagcggagtgatggtcggcatgtagaacagacctcggagggtgtctttgcatttgacgagtttggcgctgagcagcagggccaagccgagaccaagcacaatgcggaagagtgtggaaacacctgcgaataccgccgtgttccccatggaagtccagaaaagtttgtctgtgaggatctgtttgaagttgtcgagtccgacccaatcataagtgccaatcagaggattccagttatgcaaactgcccgcgaaggctttaaaaattgggtaggccaggaaaatggcgaaatagaccaccaagaagacaacagccatgttgcgtagggtgaaaattctcgataccagagattcaccatttttgtttttcattgaatctcgcctctctgtgagccgattcgaccgttttgttacgcaatacggaatgtcagatcgaatcgaataagaagattgaacgtatctcgtagataaaaaggcagtcgcggcgcggaagaagaatcgtaccgcgactgcccggattggaaaagggattggaaaggatatatcggtattacttatgttcgtcgaagtaagcgtacttgctttccattgacgtgaagtcagagctcttcatgtcggtatccatctgattctgggcctccttgagagccttatcgatggacatgccgttctggaagacgttctggaaagcagtggtgccgctggattcaacggtggatggtgccggtcccggccagatcagtcggtctacgcgtggctggatggcggccatgaccggcttggagagaatgtccttgtcgttctgcagcgaggtcttggctgggaaggagttcagttcggataccgcttcacgaatgtaatcatcgttggcgagcaggtacttgatgaagtcctgggcaacggcctgctgttctttgctctggttcttgttgacgcccggagtggattcgccgttgtaacggtcgtatgcaaacggagtgtcttcggagaaggttggggtggcgaacacgccgtagtcaatatctggatacttttctttcagcgtgccttccatgtggccccaagcgtagatcatcgcagactggccgttaccgaagctttgggtgtaatcgttgccgaagtcaacggatccgaccttgtacttgtcatacaaatccttgaggaactgcatgttttctttggtcacatcgttgttgtagttggctttcttgccatcttcgctgaagagcagttcacccttctgataattcagaccttgatagatggcgctgtaggcgtcgccgttgaagttgaagccggcctgcgtcatcttgctgccgtcggttttggtgagcttttgggcgacctggatgaattcgtcccatgtggtcggaatgtcggcgtcggtgaggcccgcttcgctccacaatgtcttgttgtagtagatgttgccggtgttgatcacggagtcgatgtacttgactttgccgttctcatcttcatgtacggatgcggtggagtagtcggattccaaagacttggtgtcgatatcgtaatccgctgcgtatggacgaatcaacgcatcgtaagagttgtggatgttgaaaacggccggaccgtttttgcctttcagagccaacggcagcttggtccaataatcatcccatgaaacattcaccgttttgatggtgacgttcggatacgtcttcgtgtaggactcaatcatcttgtagacaggatccgtgcccttgctgccccagctccagtactcgagctggattggcttgccgtcgttcacgagatgattggggtcgtaggtgatggtgttgccgataacgtcaagccctttgtcggctttcgtatcggttgtgccggacgcggcattgctgttcccgcacgcagccaagccgacgatgctcaaggccgccactgccactgcgatacctttgttgattttcatatctctccttacgtcctcgtaagccttcatccgccccttgcggacaagcaatagcatacgacaagggtttcatattggcaattcaaggttttttaaaatgtaaacggtttcatttgaaacccgtttcatctcaccgctgtgagcgtgcacacattgtttttcatacggcgtgtcgtatcgcaacccttttcattcatctttcaactctgtagccatgaggacggtaatgatggtaggctgaaacaaacagtgaaaaactttcggaggcaccatgaaagcgagcatcggcgatgtggcactgaaggcaggcgtatcgaacgctacagtctcacgcactttcgcacaccctgaacaggtgtcagaggcaacacggttgaaagtgcaggccgcagctgatgcgttgaatttcagcgtttccagatcggcaggaattcttaaatccggtagaacctatcgcatagcattattggtcggcagcggcgtcatcgaatggttcaccgccgaaatcattgccggacttaacgatgttttgcgtgacgccgggtacgatctggtcatctaccccatcgaggggtcggaggcgcgtgacgcattcttcgaggaacttcccgtacgcagcaacgccgatgccgtattcgtttcctcatttggcatcagccccgacgaggtcaaacgtctcggaaccgcaaaaattccgattatcggtatcaataccaccagcgaaggattcgatgcaactgtcggtatcaacgacaaagaaggcatcaaactcatcgttcgacatctcgccaagctgggacatcgtaacctgctgtatttatatgaaagcttttcctccacattgggattcagctcatttaaccgtatttccggattccaggaagcctgcgatgcagttgacggactgaccgcccgcacactggcagtgcaaaaaggcgacagcattctagatgcggcaatttccgaaatcatggcgcaagacaacccacccaccgcattgtgtttccatcaggactcacaggcaattccattgttcttccgccttcaacgcagcggcctttccgtgcctggagatatttccgtaaccggatttgacgacagcaccttcgccaaagaagctgagctaaccaccgttcgacagcgcccatacgacatggccgtcgatgcggcacaaaaggctctggcgctcatcgaaggacaacccatcgaggaaccattcgagacattccccgtgcagttgcaagtacgaaactcaaccgcaaaaccacgcaccgctcccctgctgtaggccgcagcgtgtactcgcgtgaaatcacttcgcgtaataccccacaccaaccggtctatctgcgttatgtatggcagattttgcttttcgtacggaaacatctcgcttatatatggcacgtcgcctgcgaaaacagccacttcgggggtacgtttttgaggttttcgccgcatgtgtctgccatatgtaagtgagatgtctccggtcaggcctccgaatctgccatacataagcgaaatatgagcaaaatgcaggcgaggcacgctccataacaaaacaacgcatgcaaagacgaacgaggctcaattattaattgctgattggttttgcagtaaatcaatcttttcattaagtttttctacagaagaaaaggccacggtatatttggtaaatccatctttttcctgaggatttctccatatgtcttctggggtaataccacttcgtttagcgtattgattcagttttgcaatcaacgagacaaagttttcatcgtcagtattcaaggtacgatttttatcattgaataactgtctatagggcacatcgagatgctggatgatctctcgagccacgccaatattggcatcgtcaataccttgttcgtcaaacgctcgattaatcattcttacgcatagattcgattcgagtccgagttcccacaattcctttactccatgtagtcgttcatccttggtggccagctcgtcgaacaattcggttctatccttgtctacagttttgccggaatgactcatccacgcctttgccgcttccaaaagataatcgaaatctgcatcttgaatataaacagacatatcctcgactatcttctgcagcacaggttcaagacgagtatcttcatcggcgatgatcctacatgcctcattcggtccaagaagattcggcgataagtaagtaataaattttgcagatcgcagcagccacgttcgacgtgcttcccaacaaatattaggaatcattccaaaggcggtttcagtgtcgccaataatcgatttatcatccaacaatcgcgcatagacatcgggctcacgtttaagatcgaatactctggaatcacccactttaatattggaaacctgctcatccgaaagtggtgattcgagctgcaacgagcgaaccagcgattcctttttcttcgcattgcaaacatcaagaggcaggttcaacagtttgaccgcaagatttcccctgtcaaattctgggtcttccttggttgattcaaaggaagaatgcagctttagccactcaccacacgcatccgcctcctcgacatccccaacagactccaacacggtctgcagattcatcggagtaaaccaaatcgcatcattccgcagtaactcattgacataagaaacgctgattcgtttccgtgtttcatcgtcaattcccgaagaaagtctgttctttaattcgtccgactcaaaatgaagcattcgagcagtatgtgaatgcttcttgattattccgctaacaacttgctcaagctccacccatttatcttctgatttgcgagtgtcaaatatcgagtggacggagtcgcccaacactgcaacaatatctgaatcgacatccgaggcaacagtcccatcaacgaagtcgagcgcatattcagattccttcaggaagtcaagatacttgtcgacattcttaatgacgtattggtagacgggggtggaaatgcttctgatctggttcagagcgagcatttcatgctttgcaaacgtgccttgcaaatcgttaatcgcacaaagaagattgcttctggtgaaatcatacccatcatgttcaacgaggagtctgcgcaatggttcactcaaacaagacagatctggagcggagtaatgagagtcaagcagcaccttgtcgagttgctttgccacttcttcatctaaagaatcatcgctgaatacgggaatgaattcccaatgttgttgaatgaaattattgaaggcatcggaaacttcgtattgaacatttttattcaaatgacgcagtacaacgtctaggaaatcacacaaagttgtagtgtcagctaacgtagcaacatcgtccgccaagaactccagtatctccgagcatgtgtccgccgcaagcagttcaagaacttcagctgttttgttttcctcatcgctgagaaacgcaagcaagaaatcctttgccacacccttcaagttggatagatacgagataaccatgcgtagcgtctttttatcttcatctgcttttgacttcaccaggtagttgagaatactgatatttagcatccacgcttgtccgaagagagaattatctcgatgtcgcacgcgtttcagcacattctgtacatccgcatcgttgagatggaaagagaaatcagatttgttctcgttaatattgtgtattacaaaatttagggcattcctcgacatgccttcatctgaataaatcgtggaatacagcttgtaatcttgagcgatccaaccaccggcaatcaaacttgatagcaacgtaccctgttcatgcagatcgtcttggataaactgagacaatgtctggcggtctgaatcatcgaacatgtcgggaccctcgaaatctatctcgcaggctttatcattcagaagatatttccaatcacctgtcctcagattttcaatgcggttttcaattttacagatcctctgattgacagcattcaatgtcagctgactaatatcaattgtcgtgccaaggtatttttcaaaagtttgttttgaaggtgtgatttcaatcggacgccaaccagattcgccatagaaagaagcggtaatcttaattgtagaatcctttcgctttgctgaaagctcttcccaggtgtgtgcttcgctcaatttagagccgctatatccagagatattaatgtcatcatcatcgacttttccgccgctgagttccgcaatccacgctttcgtccgctgcgccaactgggaggcaattctatccgcctccatagagtctaaagccatttccaaatcttcttgcgcgcttttgcgccgttgggatagcctataaatgctatctgtggaaatgctccgtgcagtcgaatatattttgtcgatcttgctgttgccttctctcatcttttccgcatccgcaaggtaacagtttttataaatcaaaaatgcgagaagatgcgcggcggatagtccaagagtattctcctcatctttcttatcatctaggttaacatgcagtcttctgctgtacatgatgaaatcgttgcggatcgttatccaagtacgctggtctggaataaaaccggcgacgtcttcaagtagatctccgactttgtctattcgagtgatttcatcgcctagagcgtttcgtgccgtttgatgggaattatttgaactgacaaacggaactactgaaataataagatcgaagaatttcgcacgagagaaagctcctattcgcctttcttcacttaatgtttcttccgaggccttgatacattgatcatcaaacacggcgtcacttattgcataaataaaacggatagttcttccatctcgacgagatctttccccagtaataactggatcgtcattcagaatctgatttaattcacgtaatgaatcgaagatttcagggctttcaaatcggtcgagatcttcgaaaatcacggtttcgatctttgatttttcgaataggtatacaatttcgtcaagatactggtcaaagtatgagtcaactccctgatccaatttcaacgaggcaccactcacattaacttgcccgattttcagattgctttttagaagataagaacagatcatccatgacgccgcgaaaagaagcactagcaagactacatagcctagcaaaaacttccctgatggacttatcgcccatttatcgacaaacggcaaagaagacaacaatgattgcccgaatttacctaaatcatcaccgaaaaatgcccccaacaacatcgtcaggaatacactcgtcatcaaggaaaaccctatcttctcccatttgcccttctcatgaatccgatgaaatctagagagcgggacatctttcggatcgacaccgtacaacagttgcttcacaatctcccgctgaatccgattcgtcggagtgtctgtcgaaaaatcatctgtagggcccttagagccatgcctattttcattattatcagatcgccgttcagcattaccgcaacaggatgccagcggagcaagcgaaatgttctttgtgctacacggttttaccccttcaaagtcttcgaccactttctcgaggatgctgctctttcccgaaccatacgttccagatatcgctatatttcttagcttgcccttcttatcacttcctatggcacttttgagagcatcgacatattcactatgatgttccgcctgatattccggatacagcggattcagttcaagggcgtcctgctgttctgagacattcttcacttcttgagaatccgtcatatcagtgacacctctaacttcgcactcctccatgaccgacccctctttctccaaaccagcctcattgctccgctcgacattccgcgacaaatcatacaccctggattggcaacggtgtgttggacgggtccttagaggacgagtccctgttcggtgaattccttcggactccggtatccgagggcggagtggagccgctggtcgtcggaccaccacacgcagtcgtcggggtcatgcctcggctgctcgatcgtggtgtagtggttccggtacacgagctccttcttcagcagcctgtccgccgacgcggacataggtaagatcgctcgccagatgcgcgtgcggggcgtagccgtcgaactcgcggtccagcaggttcgcgagcttcgcctcgttgacccgcgtcccgtgcggtttgaatcgtctgcgcgtgtacgcgctcgtcatgccctgttcgtgcatgatgccgccgatgcgcctcctggacgcggtgacgcccttcctttccaaggcggccttgatcttcctggcgccgtagcgtccgcggctgtcgcgccggaccgcgcgcacgtcgccggcgatcggatccacacgctccgtcccgagatgcccggtcatccagtaacaggtggatcggggacgcccagcatcccgcatcgcgacgatatcgggcggcattggcccgtatcacgcctgccttcgtgtgaataccggcgccgcttgttctgaaacgtccgcctccatctccaaccgccggtcgcggatgtcttggacccagcgccgcagggtcgatcgcgcgatgtcgtactcggccccgatctcccgggatggcttgccgctctcgcacgactgcacgatctgccgtttgaacgccccgtcgtagtggcggggatgtttcgggccggccatcatcggcctccaatcccacgtcattcgtccctcattggactgtctaacacattgtagccaatccacgcacgacgtgatgcacctcgacggcatccacctgcaccgcgacacggttgtgctcatcgcggtctccggcggccacgtagtcggatggcacgtggcgaggagtgagacgtgctcggcctggtcgtcgctgctgtctaggatcgcgccaccacatcgtcgcgcgtctcggacgtcagaacagccgccgagtggatggcgtcgtacaaccagtgagagcggaacttcgccggattcctcgaccagaagagccgttgggaggacggcatcatcgcggaccagcacatgcacctggccaagacccgccggatggtgcacggacggatcagggatgggcagccattcacgttcctcgacccgccggacgggttcgcggagccgatcccgtcctcgagcaaactcatcgagtcgtggagcgcgcgcatccgagacatgctgcgccaccaccgcggcctgtccctagcgcggcggatcaaggcgatctgctagtggtgccaccagcgcattgaggatccggagacggacatgcaagcaagattccttcactacgtccgatcagaactaaatatcgagatcgccagcgtctcaccgcttcatttgttcttgagctatgttatcatttttctgatttagtcgacagtattgtcccagcagctcgaaaggacgtcgcattctccaatgtctcatatgtcgccacatccagttatccttaactaagtaaggaggaaccatggaaaccaagcctgaagctcccatcgccaaatctgagatgtcttcgacggaagccgctgaatttttgcatgtgactcgccgcagtgtcgcacgttttgccacggaagggaaactcgcatcacaaaaaaaaggtaataagcttttcttcaaaaggagtgatgtggaagattttgctctcaagcgcggaataattcaaccgcttgagactgagccacagtctcgcatacttacagttgctcagttaatctcgacagtcaaagaagaagtcgacactttaaaagaggaaatcaacgccaagcaacagcttctggcggagagagaaaaattcctgtcagaccttcagtacgcagaacgacgctaacggactgacaaaataaaacaagatgccaacgtcaacgttctaaatcatcgctggcatcttctttatcgaaaggaggagcaataatgaaggatctgatcgttatcatgattctcacaattgtgattatctctaccctttaaaaggtagtataacacctattttttctttatttgtaaaagataggtaacagcatgtgattcgcatatcctgattttaagcttagtgtcggatatgcgaatcgcatgctatgcataacacaaccaaggaaaagtatgcccattacagagttaagcaagttcggaacaagtcagtcttaaccaccagcacattttttctcgtcatactactggtagtcgctattgatgcgcaaggaatatcgcagcgaccattcgacggaaaaacatagtcccactagaacacaggcagacgggcacactgatttcagctgggtagtgcccaaaagcgtgcaagtccgtggtgatcggacatatgcaaactcagacgtgaaccataaaattaacaaaacaatcggtagtgtttgtggttataggtcagagtcctccagaaaaatttgtcctttccgcttccgtttaatgcatcaaatcgggaggatgatacaatctttcttcttacgcagctatttcgaccacagcaccgcccacctgaattcgtctgggacattcatgacgcattcgcgtgaccttcatgtagttttcgcgtctacacaacctaccgcaacgccgcttttccggacttgtgcagacagcaaaactgaatgtacttttttatgcggttacatgtacttttattcacgataaagttgggcagtgtccagtttgcggaggtcgttcttctttacagaaagacgaccttcgtgctttattgaaaccctcacgagtaaacagacacaacacgatggacttctatcacattcgaaaaacaaatcacgcttctcaattcacgcttttacgagcatcctcaagaaatggaaggtaaacctcagtaaattgggaaacagtcattattttaacccaactataacgagactcggaggcgctgattcctttatgcaatttaaattcacgaactgaatcttgtatatgcataagcaaaggatttggtccaacagaaaccatacaatccttctggcgttgcaccctttcatcccggacaacgacgatcacgccaaaatgtcgaccaagaacttcggcacttatcaccccatcgcactccagcatataagcagaatcattcagttttctttctatttcctgagccggcttctgtttaattgtataaacgccagttttttgatcataagcaacgatattaccgtttttatattcaacaaaacagaaaaaattatcactgatatttgatttgcttagaccgtcacatgatgagggccgtagtatttcatgctgttcaccgtcaactgattcgttctgtccatcacacgatggagaagacgacacagtatggttttcacggaatgtctccgcatataagtcgaagttgatttgccgtacatctttctctacaagcgattctcccctgctcacgtcgaaggacaaccgagcaatcgtttcaacgggatcgccaaattcatcttgcttatctggatcagtctccaagaacctatccatctgcatcttcaggaaagaaagacattcatctggcgtcagcattttgcttcaccctttcatatccttctcagcgaccgctttctgaagcgtcaagaatggacgagccattctatcgaaagtatcagcaatacctgcatcgtcaagttgaacaaatgtcgaagagccatcatcctgcgactcagcagtgtaaaccgacgtctgatccaaatagtcgagaatgtacgcatagtccaccaaggcttgcaagaagtacgggctgtgcgtagtaatgagcattttcacattcagtgttttggccgtaagcaccaatgcgtgcgcgtacgtgacctgccattcaggatgcaagtggatttccggttcatccagaacgagtatgtcatcatctgaaacgattccattctcgataaggaaacggataatagcaaatgctttcacccccatagaagcattgccggcctgaatcggattttttactttctcgtcagtattgattaccaagccagacggagatggcgcgagaacagcgtgaaacgcattatcgaacaccgacaatacttcctgcattttttcttgcgcaactaccgacccagccaaatcgtcatatatatccgaccgaagatcttccattcgattaagcatcgcctcgataagttcatctctgtatttaggcccccatgacgaggatagtcttcttctgtgcgcaactgagatgttatcgatcagagaaggatcatcaaggatgtagatatttcgtctttcgttcgttgcagggagacttgaaacgcatctattgtcaatgaacttgacttctgttctgatcatctgaaaatacgatctcggactcatcacctgaagaaggaaacagtcccttaatctgttccccaaattgggtttcaaatgttctttgcgtaattatttgagcattctgttcatccgaaacgctgagcaattctgcaatacgctgacgaatgacaatatatttctcatcctcgccaaaatgcttagcggcagagctaattgtctctaaatcatcccatctaagccatctctcttgcgaaagtgattcttttttgcactcgccatcatcttgtgtagcaatgtttaagaaacccgcagaaacgtcctcttcgctcctttccgaaccatattgaacctcttgaactattttttcggcaagcaccctcatagttcggctactcaccgtttcctccaaaaacacaccggtagaggaacgtgaatcttttatcgcaataggagccatctgagacatcgcccgaaaaacggaccgcactagcctatcgcgcacattggaatcataattatggaacggtgacagcagggaatataacgctttccccaaagtgctcttgccggtattattggcagctgcaatcactgttattccatcaatggcaatgtcggcatgccgaaccttacctatgttccggatttcaagtcgcatattgcctccacttataattacacttttctactcatgatagtgcacacttctgctacacaaagacttcatttttacgccactcacgacgaatctaaatctaatttctccagttctaactcgtctacctcagaactacgattgctagaatgtgataatgtccagattttacgcactttgaggataacgtccgaattcttgcgcactttgggttttcaggcctgacgtgaaaggcatggccccgcgtcctgtgcacgatttcttcattcgccaaaacgaaaaaccgcgattggaaaccaggagacggaaccatgcccgagaacatcatacggatcgaccggcacatgtcggggccagactcgaccggctcgtcacgcagaaggcgtccgaggtactcaacgcgatgctcgacgccaaagccaacgaaatccgccaggaccgtccatgtacgagcgttccggcggacggaaggcataccgcgcgggccgttactggctcgggctcaccgccaaagccaagcgggtcgcccgcggagatggaggggcggaggctcggggcggccgccaggtgcctgcgcgagggcataggcgaggccacgacctacctcctgcccgagttccccgccgagcaccgcagaaggatccgcacgaacaacatgattgaacggctgaacagggagatccgccgccgcacgcgcgtcgtcggttgcttcccggacggcgacagcgcgctgatgctcgtatgcgcgcgcatacggtacgtgaccgcgaacgagtggagctcgcgccgctacctcgacatgtcccggcttggcgtcacgctggaggaagcggactgatcatcgtgccacgggcggccatgacccaaagtacgcaatctttcgggcactaccacgcggtcctcaggggtccgggaagcgtcatctagaatgtgaaaacccgcgcaaggggcttcagggacatgggctattccagcacgatgatctatctgacctgcggcaaacacgacctacgaaccatcatacctgacagaattcacccacaccaaacagcgaaaggctagattattttgtacaaaaagttgtgcctccgactgctgtgacagccggaggcacaacccaaggaattgcatatctagccgactagactctacataggatgcccgtcacccatcagttttcttcggcaaatggctcgtaggtttgtcgggagataaaactgaaatagtgtattttgtcccactcacgcggatttccgaattccagcatgcgtacgttgcggttatcgtaggtatgcgcataaaggacacggttcctgatgtcgtatgctgcagtgtattgggtccatgggactagcacctgtccgtttcccacagggcgcagaactccctttggattattgacagcagtcagcagctggaacacctcgttgatggcggaatcatcatcgacaggaagggacatgagcttggtatatgccgcccgcagaaagcgtgtgtccggcttatagtcagaaggtattccatcaatccgctcgtccattcgtcgagctcgatagactcgattggctcattaatgtcgtatgaatagtgacgatgagttgaacgctccagatgcatcttaagattggtgacatgccaatcaaaggtgggagcattggcgaagacgccgaccttgttctcgtaaattgcgaaaccgttggtggaggacggttcgactacgatggagcgtcccgattcgtcttggaatacgctgtgctgtggaacggatcgccccatcatcgggcctggcgcatccacgattccaacttcgctattcagacgctgcttgacctcgtccagtgaacaataatgcgtaagaatccaagtaacaagctcttctcctcgcaatggcaccttgccctgggcttgtatctcctcatcggaagcgtagcggtaccaatggtcgaagtagaatgatcccccacatatgccttgttcgttaatgccgtcaagaatcaccggatgggcatggacgtctgttgcccgggcgattcccatagtggcgatttctgccataaagggggtgtacgtggattcaatctttgttcctgccgggattttcattccagcatattcaaaatgctgctcgaagtcctgggtgcgaccccaataaggttttccttgattgcttattatctctattcccgtgcacatgataaacctttcgattgaggtgaaatgcatcctgcagccgcgatggagatacattccagtgtcgcggaccattgggcgttcctacgcaatggactgtgacgccgccgcatcggattcgtttttagccgatgggatcgcagcaatgaccgcacccgccaatgcgacgaatgcgccaagcaccgttaccagatagacttgcgtgccaagagccggaaccagccaatcgataagcatagaaccaattagctgacctgctgttgaggccagtcctagaagcaataggccaagtccacgcaccagtaggcccatcagggcgatggacagcaaaccaagcgggccgccgaacggctcggcgcaggcgtcggagcggtccacaactgggtcatggcgtaccgggaaggcggcatggccgcgctgcgacccaggaacaggaacgccagccagaccaacaaacccgcgccgcggcgaagccggaatgccggggacggcaacgatgacgcggaggcgttgcgccggcgcatcgaggaactggagccgaggaacgcgttgatgcgggaggtggtggaggcacgcagaaaaagacccgggtgccaacccgcggcgcctgtcgaacagagagaagacactgccggccgaccgtttgcgtccgacgtattcactcaactcgatgcgaatcggcatcctcaggaagacaacgcgggcaagcattcccgcaacccaaacctccttccgtgtttttgacaaaacgcctgcattggcgagtgcgcgttggaatcacaagagggtcaatatcaatggctgctccaccgtggtccgaattcatcaagaatatttttgacaggcaacagcacatttcactaagaaaaataccaatcagagggtggcctttccgcgcaggatatcatccgacgcatgcgctccaacaatttcaatcaaacagatgttgagcagttttacatggcacttatcaaagattctgttttctgccgctccgcactcaaagaattcagccagaaaataccgatcgcttttgcagccgcatcaattaagtgactgcaaaaatccattcaatacgctgctgccagcaacacctcggaaagcaaaataaaagtttgaccaatatattcgtaggcatcgccaagcaatgcaaccgtattaaaacttggttcgattaaggttcgataaatctgcctcgccatttttgcttatggcgaagcaaaatacatccttcccacatggctttgctgctttttgtatcttttgttgttatccgttgccacttatcggcatcggcacggcatgtcagtatcatgtgcgtatgcgacttattggcaatattctgtggctaattctgggtggactgttgctcgccgccagctgggccattatcggtttggtgttgtgcatcaccattgtgggcattccactgggcattcaggcgttcaagatggcggggctcacgttgaccccgttcggtaagaccgtggagtatggcggcggcgtgggatccgtgctgatcaacatcatctggttcgtactggccggtttgtggatggcgattggctacatacttgccggcctgctgaactgcgtcaccatcatcggtattccgttcggtatccagtcgttcaagatggccaaattagcgctatggccgttcggctcgcaaatccgcagcttgtaaatcacttcagatcacttcacccagcatagacggccatcgactgccgtcttgcatataagtatcgaggagctgcggtccgaacaggccgtgaccactgcaccctaagcaacgaaacacgtctcatttcgcttatggcagctccagagcggcaaggctcaaaaaactgaacagtcgaacatacctacccaaatgattgctaatgtcagccgccttgtgaacaggttaaagaatacttgcgatagcggcttctccaactgtacgttatcgagaagaagacatactccccccgtcaaatacggttactcacgcagcttgcttgccgcgaagataaacaatggcagcgcggcgaacgcgtagttctcgcactggatatacaggtacacgatcaggacaagccagcagataacagtcttgctccaaacaccatgctcggcagctgcagtatcgaagacacgcgtcatggaaactatggaagcgatgaccagcagaaccaggccgatcaatccgtattcggcgacgacgctggtatacccacacatcgtccatacggtgtccgcattcatgccggccgcaaatcctgtggctgcgccgccgttcatgccaagaccatttagtagctgctcggccttggatgcgccagcccacaccgcattgatgatgttgcccgcaccataaccggtgaacatggtccatgggtgggtgagcaggccgcagagcggatcgagactttggtagattcttgcaaagaacgaaccatccccctgcgcgccgttttcggcaatggaagtcagcctggagtcggcaagcacgcccatcagtccaagcaggcatgctccggcaaactgcgccatgccacgcagccgttgcttccgatcatgccacgtgttgtgcacgatgatggcaaccagcagcgccacaacggagtcgatgacgattctggtgccggcctgcatcagcatcgcgccgatcgcgtagacgacgatgaggtcacgcagccgtttggcatagatgctgtcgcgacctcgcatcagccacatgaggggcagcagtatgccgaacaggtgcatgccgatatagctgggttccgcgaacaggaattgcgaccgaccgccgccccacaccgaactatcggtgatgtactggcggtacatgagatgcgagaaatagttgacgagcggctcgaaccgcagatggatggagaaccattgcacgacgcccacggcgaaggagcaccagtaggccgcgataagcagccggatcggcatgttccaggggatgcatttgatatggaaggcgatgacaagcgcacccaacgtggcaagcatgccgaacagcccggtgaggctcatgaatgcggcgttgaaatgaatgccgaaacgcagccacccgggaatggacaggatgatgcagacgaccggcagcaggaacaagggcagatacttcacggctacgatatgcagctgccgccagttgcacaggcagtagacggcgaatagcacgggactgatcggtgaccagaacggcgcgtacaggccgagcgtggtgccgtccaccgggagaagcgcgatgcccggcaacagccagatgacgtttcgatcctgcgtcgccaggaatcgcagcattgggcgataggaaacggcgcgccccgccgattgtctgccactcgcttgcgcctgtgcagcggcatcatcaattgcgacgccagccttggccttggcggccacttcgcattcactattgttcggtcgaatcacacgcgcccctttccgcaaccaccttactcgacattgcactatatgcacccattgatttcaccgcgcaacggatgatattgccacaacgattcacggcttcaaatgttcattcgaacatgacagaacacggaataccataaaaagacaacacgcttaatgttatcttttttaaaaccgcatgacacttgccgtaaacccagctatgacaacgattcacaaaaccacaatacacaaaaagttcatttttcaaccatttcaccttctatatgcgtgatagcatcaatagcgaacacagcaagcgttcaccccacacaacacaaaccagtcatacataatgttcatttgcgattacaaacgaacatgcataatgcacattatgcgtggcttatagaaaggcattacccatggcaaacgagaaaaccgtcatcaccgtgaatctcgacatgttcgacaaggacgccgacgccaaaacagccgaagccaacaaggtggcgaaaaacctgggcatcagcgatgaagcactcgccaaggtagaggatttcaagcaggagctcaccgatcatgacgcttgggatctaccgttcatgggctatgtgaacgaggactgctacggatacgcctacgtgccggacgcggccatcaccatgcatccgtatcgggacgcccacaagaagttcatgaatctgccggatgacgcgcagaccgcattcgccatccgcatgctgttcacccaccgccccgtcgaccgctacggtaccgacatgttcctgcattaccactgcggattcaccgtcaacttcattggagaaggcgccaacaaatactgatcgcctcaagcaccggttgcttcagctcaagccgacaacgacacccttgtcccgctgccggctttccgaactccctgaaagcccaagcaaccccgtagcgcatttgattggcgacacctcggatccgcaccattttgaatactcagctgtgctgaccacacgcgtccccttgttgccggagagacatggttatatggctcaattctcgtttgcgccggtcgccgattctggcgacggtgctgggctattggcaatgagcaagtgcaaattcgatcccctgtgcagggaggcagttccgctgcctatgcgttgccaggtttcccggtagtccccgtcgattgccacgtttgcgcttgcaatgaatttcttgaattcgtcgatgtgcgtcgcatatcggcgacggaattgttgagccagttgcaccttcttattatccgagagttcttcagatacgttgtgtagcgcatgttccatgtttcgagagaagaaatacatggagtacggtatgccggttccttgatatgtgattgtggagataccagcgagttccctcatcgcacgtttttttcgagcgttacgttcacgcagcacatcgacattcccagcgcagatcccgtcttcgccataatggatttcaccgtcgtctgattccctcacgcattcatctggaatgaaggcaccgtcggtgtcgctgatctgaacaatccgagcgatatccttccaacggtatccgttgagtttcagggattggagtacgaggccacgaacacgttctctagggtttaatctgcgttcggtcgtgatatcgccatgcacgatctcgaatttgatctggccggttgagaagatacggctgagaatctgagcgagggctgtttcctcggtggggccttccacgatgaatatcatcacctgtttggcaatcgccatagctcagtcctcctcggggaacccgacatcgtagaaggcgccgtcgatgtcgaaggaattcgtcggctcatatacggtttccggttgcccaccaagattgattgcgcgtagatactgattacggagattatttttttctctgcttccgcggaatttgatgtatcgattatctggattcgtcgtcgtgaaataaagcgaacctttgtccagaatttccaatggacgaagattatgcgcggtaaaaatcagctgaccgcgcccatgctctttcagcacctgcagaagttctcctagcaggaactcgaaaatgcctgaatcaagctcatccacggcaacgcaagcacttggcttcgcatagacgtcaatcagcagcatcaaaatagatacaagttttttgattccctcggattcgcatcgcagcggcaatgcgattccgtcgcgcacgcatgtgatttgcacacgttcgacaggcttgccgtcatcccccaggctctgaccgaacctatacaggcttaaggagagtcccgggaccagcgccgtcagaacagggttcatcttcttcagcgtgctgttcagtgcatcgagttgccttggattcagatcattgggctccagcaggttcacatcgaacgaagcatcggcaaaaaccccgtattcgccttcatgagttgacatcttcagatgattcattatcgaaatcgcgtatcgggtggtatcaacgattgcgaagtcggatattgcaaatatctttatggatgcaatcaattcgtaaagttgaccgatgttgtctgtctttccccgcgtcgcatcgccaccggacgcatcgtcttgttggcaaactttccaaagcaacgtaaagaaatcattggaaaagatcagcgaactatggttcttaagggcgagacgttgctccacgaccagttcggttcggattttctcattcgctgcgaatatgtttttccaagctgttttgggcctgatctcgtaatcccacgaatcatctcctccgttatatgccatcaaggtgcgctttgactccttgccactgaatttcttgatggtaatttcctcagctgtgattacaggcccctcatcggtttccgcaatacgcgaacctgcttcagcgatagcaacggtataggagaattcatacactgcggactgagaatcctcatcgaatttaacgcccttaacgcatatccttgcatcttcggctttctcatcgccgaacttcttggaaacacaatcggcggcagatcgcgaaatgtcgcctccatagaaaatattcttcagcacagcgagcgcctgaatcaccgaggttttgccggaaccgttctgcccgtagattccaataatgtccgaaccgggaagggaacgctttgtactccatgaggaaaggacgatattgccttcccttatgttcttaaagttcctaagctcaagtgacgtaaggcgaatcatggctctccttcctttcttacatattattacacgccaacaatggaaattgttagattattcgtaaatcagttacgtttttaagaaaaaaatagattgttctcttcgtttcagaggcaacacaccttccgccttgtcttccgatcggcaaggatctctggcggccataggctatcgcgctatcagaaagctagggaatggcacggtccaaataccttgcgaaaaatgttgggcacgttccgtaagttgagcagcattcattccactcccggttttctgccgtgatggtacggtacacgagaaactcagcagatctcaatcttcgagactctttttaggctttatggggcttgaattttcagagcaagtgcaacgtctgcgaatggtggacctcgtagggcgtcctgaagccatggcgcttgcgcggcctgtggctgatcgcatcatacacctcacgaacccgttcgtcgccggccgcgtcgaagtcggtgcccttggggaagtactcgcggaccaggccgttggtgttctcgttggtgccgcgctgccagggatggtgcggcagcgcgaagtagaagaccgcgccggtcgcctcctcgatcctcgcgaagtcggcgaactcctcgccccggcccaacgtcgccatgcggctctcggcccgccctgtatttcgtcaaattgaggtggacgtgttcggcacttaatctggacaccgtcgtcattgactataaagaagtagtacaaatacgctcttgagttctcaaaccaccaccgctcacccgcctcgaggcaccccaaccggggaaccactcgccgagcggcagcgaagagtcaatttacacgaaccccggcaatcacgcaaatcgacccttccaaagataccctaaaaccgttgcaaataaacacatccctcggcgtgtcccgattccgtccacctgaatcgtctttctccttttccacagaaaccagctcatccttccggaaaacatgttcgtcgtacgagtcgccttatcaggaattgacggaacgatacgttgaggggattctgttatcctgtggggcgcagcggagcaaaatgacctgccaagacgggatggtccctttcatgagcaggcttttgactcaaaatagaagacggatcgaatattccgcagtgataccgtgaagggagggaacggcatggaggcgcagcttatgaggctacaggacctgagactcaaagaaggaatgtctctagaacagctggccgagctctccggcgtggatcatgatcgtctcgtcatgttcgaaaacaatccggaaaccatacgcaatatgcatttggacaccgctcgccaaattgccaaagcattgcactgcaacgtgttggagctccatcccgacgaaggttggagaggcggaatccactgcgctgaatccgggctaagagacattcgtcggactcgcggctatacgcaaaacgagttgtcagagatgacagggattccccagccgaacatctcttggtttgagacaggctatcgctcgacctcaggcatgcggctggatacagccaggcgtctgtcggaagcgcttcgatgcgatccgacagatttcctaaaagaagcgtatagccgatatgaaaataaatgttgtatctgatttagataaaacacttaaatttcatcggacgccatacttcaacaaacgaatgcatcccgcgcacctcccatctcaccaaaaagattaggcaagaaagaagcccatcaatcattgacttcacaaacctttcccttccagaaagctggataacgtccgagattttgcgcactttcggacgttatctggcgcggaggacgcatttgcgcagttcggaagcgatgagcacgatcatggcaaggccgaggcattcgacccatgcgccgacgctgagcggtaccgtaccgaaagcggtgttgaggaacggaatgtaaatcaccgccagctgcaataccatgctcagcgcgatcgcgccccatagccacttgttggagaacagtccgacgaacgctgactgcaagtgcgagcgcgaggcaagcgcgttcagcatttgcgcgaacacgagaatcgtgaagcccatggtgcgtgcttccgtcatttgtgcgtcgtgaccgatcgcatcgacggaacggtcggtgaacagaccgccgtccaagtgcatgtccatgccgatcagggtgacggccgccataatcacaccgatgaaaatgatgtcgccccacatttcggcgtcaatcacgcgatcggtgagtttgcgcggcttgcgcgccatcacatcgtcggtggacgggtcgacgcccatggcgagcgcgggtgccgcgtcggtgagcaggttgatccacagcagctgcgtggcaagcagcggcacggtcacgccttggctgccgggctgggtgatgccgaggaatccggcgagcatcaccccgccgaacacggtgaacacttcgcccacattggagctcagcaggtagcgcaggaacttgcggatgttgtcgaaaatgccgcgtccttcacgcacggctgcgacgatggtgctgaagttgtcgtcggcgaggatcattttcgcgctctgcttggtcacttcagtgccggtaatgcccatggcgacgccaatatcggcggttttgactgcgggagcgtcgttcacgccgtcaccggtcatggccacgatattgccttgccgttgcaaggattcaacgatcttcaacttgtgttccggcgcgactcgcgcgtagacggacactccgctggtcaccttgtcgaatgccgcttcgtcgggcagttcgtcgagttggctgccggtcatggccgtgccgcccttgtcgataatgcccagatcggtggcgatgcgcgccgcggtcagcgggtgatcgccggtaatcattaccgtacgaatgccggcgcgatgcgcttcggcaaccgaatcacgcacttccgtgcgcggcggatcgatgatgccgatcatgccgacccaaatcaaatcgttctcaagcacatcgctttgttccgcaatatcggcaacatgacctgcggaattcagtatgattcccggcacttgcgcaagagaagcggtaccgagcggacgataagcctgtcccaacgtgcggtatgcgtcggaggaaagctgttcgacagtcgcaagaatctgctggcgatcgccttccgtaagtgggcgaacggcaccgccgacagcaatcctgctgcaatatccaagaagtacatcgggggcacccttggagaagacggtcaggcggccggcgtcagcgttgtcttgtgccacgatggacatgcgcttacgttcggaagtaaacgggatttcgccaacgcgctcgtagttggcgtacttgcgatccgccttcacttttcgtgctgcgacgatgagtgagacttcggtcgggtcgccgaccgcctcccacgttacgttttccgcatttccggcagaagcagcagattcgcgcagttcgccgtcgttcgccaacgcgcccacggcaagggtcgcaacggcttccgattcgatgatcccgcgtatttgcgcatgttccatggtctgtggatcgaccaccatgcggccttccggcgcatagccggtgccagtaagctgcacttcgccgctcggagtgaccacacgctccacggtcatctcgttgcgggtgagcgtgccggttttgtcggagcagatcaccgacgcagatccaagcgtttccaccgaatgcagcttcttgacgatcgcattgtgcatggccatgcgctgcacgccgagcgcgagcaccaccgtaagaatcgcagccaaaccttccggcacggccgcaaccgccagagaaacggccaacagcagcgaatcgatcacatcgtgaacgtcttggaagccttcggtaagcgcgagcgcgaccagcaccacgaccgcgatgatgcataccgcgctgccgaggattttggaaacgtagttcatttccttttgcagcggggtttcgtcgtcttccgtggcttgcagcagatcggcgattttaccgacctgcgtgcccatgccggtgctggttacgatggcgcggccggtgccttgcgttacggacgtgccgttgaacaccatgttggcgcggtcgccgagggccttcgcctgtgcgagggtgtcggtctttttgccgacgggcacgctttcgccggtgaggctggcttccgcgattcgtaggctggcggcggcgaagaggcgtccgtccgcggaaacggagtcgccttcgccgagcacgatgatgtcgccgggcaccacgtcaaccgtgttgatgcgttcgattttgccgtcacgcagcacgttggtttgcggcgcggtcatgctggagagcgcttcgacggcggcttccgccttcgattcctggatgtagccgagcaccgcgttgacgataaggatcagcacgatgacgatggcgtcgaacggcaatgcttcgccgccttccgcacccggtacggcgttggctcgttcaatgaaccatgcgacgagcgaaatgccggtcgcagccagcaacaggtagacaagggggtctttgaattgttcgaggaatttcttccatttcggcaccggtggtgcggacgcgagttcgttcggtccgtacttgtcgagtcgacgcttggcttccgcttgactcaggccggtattcaaatcgacaccaagcgattgcgctacggtttgcgcatcggcgagcgacggatcgacttgcgtttgcgtcgcggtttttgctgcttgttcgaaatttcccgaactggtatcgcggaattgggtggattgatcttccttgcgatcaaccatgatgatctccttgggagcgccgcggagtagtcagcactcccctgccgttgcgatagtgcgaaatagcggaaaattgcgattttcgcaaccactcgccgaactgggcaatgctgcgcggttgtgggcaccgggcgtacgccatcggtgcattcctgccattgttacacaccgtgaccattttgcaagagcgcaacgcaccgtcttttgtcaagatttcacaaaatcgtgaaacataatctgcaatcttatttcgaccgcgcattcgattacacggcaacaccgacggcaatgtcgctaccatctttggcggaagtgtgatatgttatcggatgttagtaaacaaaattacttacgctatgattcgtagcgtacattggcaacgtcgcaatggataggggtagttatcatggcagctcaagaagccgcgcaatcacagcaaacgcaaggggttccggaatcgcgcatcctgcaggcgcggcaggcgaacgcaagctggctcaccgatccgaccgtattcgcggtgaatcgcaagcccgcgcactccaatcatcggtatttcctgggcgaagccaccgaaccaaagcagaatctcgacggcgaatggaaagtaaacgtcactcaggcagccaacgtcgacgtggaaaacgcgccgttcgccgcagctgacttcaacgatgccggtttcggcgcgatcaacgtgcccgaacacctgcagatggccggctatttgaagaacaaatatgtgaatgtgcagtatccatgggatggccatgaggatccgcaggagccgaacgttcccgaaaacaatcatgtggcgatctaccgccgttccttcacgctcgaccgtccgctcgccgcaacgctggaaaatggcggcaccgtcagcgtcaccttccacggcatggccactgcgatctacgtgtggcttaacggcaccttcgtcggctatggcgaggacggtttcacgccgaacgaattcgacatcaccgaagcgctgcacgttgacggcgacaacgtgctcaccgtcgcctgctacgaatacgcgagcgcctcttggctggaagatcaggatttctggcgtttgcacggcctgttccgttccgtggagctcgccgcacagcctcgcgtgcatgtcgaaaccgtgcagatcgaagccgactacaatccctccatggccgccggaacgctgaatgcaaccctgcagttgcgcaatgcaaacgacgcggccaccgtcaaggcgaaactgcgtgacgcaaacggcactgtggtgtgggaatccacgcaatgcgccaacgaaaccatcaccctcaattccggcgcgctgaagaacattgcgccgtggagcgccgaagagccaaccctgtatgagctgacggtgcttgttgtgggccatgacggtccgctggtcgaaaaggtcgtgcagcgcgtcggcttccgtcgcttccgcatcgaagacggcatcatgaagctcaacggcaagcgcgtggtcttcaagggcgccgaccgccacgaattcgacgcgaagcgcggccgcgccatcaccaggcaagacatgatcgacgacatcacgttctgcaagaggcacaacatcaacgccatccgcacctcgcactaccccaaccaggaatactggtacgacctgtgcgacgaatacggcatctacctgatcgacgagaccaatatggagacgcacggcagctgggtcgcgaacaatatcgaaacccccgaaaccgccgtgccgggcagcaagccgcggtgggaaggcgcgtgcgtggaccgtatcaacagcatgatgcgccgcgattacaaccatccgagcgtgctcatctggtcgctcggcaacgagtcgttcgccggcgaagtgttccgcgcgatgcacgcccacgcgcacgcgatcgacccgaaccgccccgtgcattacgaaggttccgtgcatgatcgcgcgttcgacgacgtgaccgatatcgaaagccgcatgtacgcgcacgccgacgaaatcgaggaatacctcaagtccaacccgaagaaaccgtatatttcctgcgaatacatgcacgccatgggcaattccgtcggcaacatggacgaatacacggctttggaacgctatccgcaatatcagggcggatttatttgggatttcatcgaccaggcgattctcgacagcaacggtcgcatgtgctacggcggtgatttcggcgaccgtccgagcgactacgaattctccggcgacggcctgctattcgccgaccgcacgccgtcgccgaaggcgcaggacgtcaagcagctgtacgcgaacgtgcatatgaccgtcgatgcttccggcattacgatcaccaacgacaatctgtttgtttcgacggctgattccacgtttgtgttgcgtattttggctgatggcaagcccgtttggtcttcttcgcgccgcttcgacgttgccgcaggtacaagcgagcatgttgagatcgattggccgatcgacgattaccgcgcaggtgcgcaggaactggttttggaggcgtcccagcagttgacttccgcttgcgattgggctccggctgggtatgagctttcgttcggccagtgcgtggttgcgggtggcaagattgccgatactgttacggccgcttccgccgcttccgatggagcgatcaccttgggccgctggaatatcggcgcacgcagtgcgggccgtgaagccctgttctcccttgcacagggtggcatggtgtcgtacaagcttggcgagcgcgaattcgtgttgcgtaagccgctgatcaccacgttccgtgcgctgaccgacaatgatcgcggcgcgggccatgcgttcgagcgtgcgcagtgggcggttgccggaaagtatgcgcgttgcgttgatacgaaggttgagccgctcggcgaaaccgcagtttccgtcacttacacgtatgagcttgcgattgcgcagcgcacgaaggtcaccattcgttacgttgccgatgtgcttggccacgtcgatctgcatgttgcatatccgggtgaaaaggacggcgatctgccgacgattccggcgttcggcattgaatggatgctgccggtcgagtattcgaatctgcgattctatggcgtcggcccggaggaaacgtatgccgaccgcaagcatgcgaagctgggcatttgggatacgaacgccttccgcgatcgcgcgccgtatctgctgccgcaggaaaccggcaaccatgaggacgtgcgttgggctgagattacggacgattctggtcatggcttgcgcgtgagccagactgcgaatactgaaaccggcgttacgaagccgtttgcgatgagcctgctgccgtattcgagcacgatgcttgaggaggcgctgcatcaggacgagctgccggagccgaagcacatgttcctgcgcgtgctcgccgctcagatgggtgtcggcggcgacgattcctggatgagcccggtgcacgagcagtatcagctgcccgccgaccagccgctcaacctcgacgtagccctcgacctgttctagtttcaaggattcagtcgattcctacgtgcgaaatgtctcccgattcttgatttcaaggatcgggaggcattcgttgtgccgcaagttgactttcggcctcacgattcgcagttctgtctcacgatttcgcaagatcgtgcgacaattcggaaaaaacatgcgatcagtccatcaaaatggacgatgagggggattttgttgatggcttaaattagacggattgcctagaatgagggcagaacttccgaaacgttcgagcgcaggcgggcaaattcgcgcgcgtccgagcatcacgaagcacgctcttccaggaaaggggccatcatgagcgacgcaatgaacaacccgtatgcgaacaatccgaatcaaaatggcagcaacgaacagcagccgcaaggccagccggaatacggggcatacgcaccaaaccagcaatcgcaatcccagcagcagggcggcaatcccaacaattcgggcaatccgtatcaaagcgagcctcagaccccatgctacttcgacggtcccaacgccaacccgaatcccaaccagaacggcttcttctacgcgagctacaccaccggtcagccgtacggccaaccatacggacagcagaacagccaatccgacgctgacaacggcaccaacaattggcagccgatcagcccgttcaagctcatggaggaatggctcccgaagaaggcaaagaacgcgatccgcggcacgtatgcggtactcggcatcgccgccgtcattctcggcctggcactgctgatttggcccggtgccacactgaaggtcgccgcaatcgcgctcggcgcatacttcgtggtttccggtgtggtccgcattgtgaccgcaatcgtggaactcgggcttccgggaggatggcgcgtgcttgacattctgatcggcctgatgctgtctgtcggcggtgtggtcatgctgaaaaacgcggcgctttccggagccacactcgccgtgctcatcaccatggtggtcggtctcggctggatgctggaaggcgtgatggcgctcgtggaatcgtggcgcatgccaagctccgcatgggccgtaatctacgcactgctgtcgatcgtcgccggcttcatcgtgctgttctcccccgtcagctccacgacctggctgatcctgttcggcggatgcgcgcttgtggcgatcggcatcgtcgcgatcgtacgtgcgttcaccttcggcaagtccaagcgcaagtaattttttgcggcgcgggccgtaaagtctgattatctctgttttcccaggggcaccaagcaacagctcggtgccctttccatagcgaaatcgctttttataccaagattcaaagtcgcacaaccatgaatcttggtattaatactggtatataattgggtatgaaattcggttttaagaaaggtttatcatggcaagcgcacttgacatactcgatgaccttgttccaatcagcgagctcagcaatggtcgtacttccgcattgttgcagcgggccgaccacgatccagtcattctgatcaaacgaaacaagccgtcctacgttctcatgaatatcgaaaactatcgcgctctcatggaacgaatcgaagacaacgaagacttgcttcttgccgaaaaaagactcgacaacagtactggcacaactatcagcaacgaagaggtcatgctcgatctcggcatttccccaagcgacctcgccgaggcacctgagccggaactcgcatgaactggcaagttgaatggcttgacgaagccaagaaagacatgcgcaaactcggcaaagccgagcaaatccaagtactcaagggaatcgagaaagttcgcacaaacccactgcccacctcgcaaggcgggtatggcaaaccgttacgcaatgccgaacgaacgaaactttccaggctttgcaaaatcaaattcagggatatcggcattcgcgttgtttacaaaccgttactgcgaaatggaatcatgaccatcatcgtcgttggcattcgttccgatagtgacgcttacatcaaagccaacaagagacgcaaagaatatggactataagatgcgtccgccaattttcagcgaacgttactttttcttcaagattagccgatgattttacaaaagaagtgacgatcgtcgcatgacattgtcgacttgcccgacgtaagatgaaggcacaacagaagaacgaagaaaagaaaatagacaacaaacacagacttacggcagcggccagaggaatggacaagaaaacagatacgcgccgccaagccgaacgaaaggaaacatcatgaagaacaacactttcaaccaggtcatcaacgccaacctcgcttccatcgatccgggcttcggccagttcgcactcgccaaggcttcctccgacctcttcaagaaggtcctcaacaagtaagaccgcttcctagacgggaggcaaggcgcaggcgccacagcacctcgcccctcttctttccaatccttaaatcacatagcgggaggccgcggttccaaacggaatcgcggcctcccgcttttcacgtacgccggctacccctcctcaacagcgagattgcgggcggcggcgcgttcgcgtgggccgcgcgtcacgtagaagccgattgccacgatgacgaacatcaccgtgcagcagatccacagcacacggctgccgaacgcgttgagaatccagcctccgaccaacggcgagaacgcgttcgacagcgaccacaccaggttgtataacccttggtaggtgccgcgcacatcctttggcgcgatgttcgccaccgttgtggcggcaatcgggaacgtgcccagctcgccaagcgtccacagcacggtcgcgattgcgaacgccacccacgaattcgcgccgatctggaacgcgtatccgaccgccgtgatggacatgccgagcaccagcactcgggtgttgctcatccgctggaacagaccgatcgcgggaatctgcagcagacacagcaggccgccgttgatggtcagcagactggaatattcatccgtgccaaggccgatctgcgtcatggaaatcggcaggccgctgacgatctggtaatacgccagcgtgtacaggaacatcagcaccaccatcgacatcagcgcgccgtcggcgcatgcgcgacgatagctgcgccatacggagaaccgctgcggccgctgcgattcgccggtttgtttcacagcatgttccacggcatttcccgcagctgattccgcggcttgcgacgcccgcgccggcgcgacctcgccccgcgggcgcttgcccagcccgacttccttgaagaacacgatcatcaagatcgtggcgaacaccagcaccgcggcttccgcgtagaacatcagcgcataggagatcttcaccaactggttggcgatgatcgggccgatcgcgaagccgaaattcgcggcccacgtctgcagcgaatacgcgcgcttctgtttgcggaacggcaccacgtcggacacgtacgccgcgaccgcgggcgtcggcatggatgagatggcgccgtaggccagcagcgcgatcgccatgatccacggattgccgatgaacgccagcaggaccagcatcgcggcggagccgagattgccgatgacgatcatcgccgggcggccgaagcggtcggacagcgcgccgccatacaggcagccgaagatgccgccgaaaccgtacatggagacgatggtgccggccacgcccgcgctgacatgcatgtcagacaccagatacatggaaaggaatgacgtgacgaagcggcccatccacaggataagcagcgtgacccacaagccccagaacatgaggggcaatccgaaaatctctttgttcttctccattcttgccatcatatcgagcaatatcgagcggacgcgacgccagtagccttttcccggggtgctgggagaatggacaactatggcaatgaaaaaaggaccgaccaaggggtcgggtggaaagcatcgtaacgcgctgaggggcaagggaccgacccccaaggccgaagatcgcgtatatcacaaggcttacaaggaaaagcaggctaccaatcgtcgtaagatggctgatccgcgactggcggcacgccgtcgcgcggcaaagttcagctcagaatccgacgatctcgtcatcggtcgcaacgccgttctcgaagcgttgcgctgcggcgtgcccgcgagcacgctgtatgtggccgcacgcatcgagcacgacgatcgcacgcgtgaaatcattcgtctcgccggcattcacggactgaacctcatggaagccgaccgactggaaatggaccgtatcgcacgctcctccaaccatcagggcgtggtgatgaaggcgcagccgttccagtattcctcgctcgccgagctggtggaacgcgcggacaagaagtctcgtgccatggaagcggccaactccgcaagcgcacgcattgcggcacgtccgctgttcatcgcgcttgacggcgtcaccgatccgcagaatctgggcgcggtcatccgttccgcagccgcattcggcgccaacggcgtgatcctgccggaacgtcgttccgcttcggtcaccgcagccgcatggaaggtgtccgcaggcgcagccgcgcacatgccggtcgcccgcgtggtgaacctcaccaaagccattgaaagcctgaaggaacgcggatactacagcgttggtctcgacggtggcggcgacgccctcgttggcgaaaccggtttcgaaaccgatccgctggttgtggtgctcggttccgaaggcaacggcctgagccgtctcgtacgcgagacatgcgattccatcgccggcatcccaatgtcgaacatggtcgaatcgctgaacgcttccgtcgcagcgggcatcacgctgtattccgtcgcacgcgcccgccgcgaggccggtgccgccgctgacgcgaagtaatcaacacgaagcaacaggaagtaagcacaacaaggcagcaagtccgaaatacatatgagcggatagtccatacggattatccgctcattttgttgcgcaaatctgtacttggattgattttgcgcttaccgcagacccactcccccgccaacgatctctcgcaacacgttctctcactttcaaaagtcaaaatttttttgagttttgaaagtgaggggtgtgaagggataacaaaaagcggaggattattagtggtcctccgcttaacggctcggccctgcaatttttgactgcggctacgccgcagactcaatactgccttcggcgcggctatcgcctcgtctcagggcacattgatagaaaaagctccactggagctttttctatcaatgtgcccatacagctgcgtcgggatcgtcgtcggggttgtagccgtcgtcgggatcgtcgtaggtgtattcgtcgtcgatcacaccggaatcggcttcggcgttcaacgcgtccacatccttcgtggtgagcttgtactgcggaagcaccttctccacatagctttgcaccgcctcggccatcggcacatcatgacccgccttctcggccaggaaccaacggtggtcaagcacttcatggaagaactgagccggttcgatctgcgaacggtattcacgcggaatcatgcgcacggtcggttcgaacacttcgcgcatccaatcagtggcaacaatctcaagatcctcaccctcacgccatgtggaagcgcggtaggcatccaaatcgttcaacagtcgacgagcctgattctcctgcacatcaagaccagtcaatcgcagcagcttacgattcgcatagccggcatcgaccacacgcggacgcaccagcacacgcttgccatcttcggcggtcttcatctccagctcatccacatcaaaaccaagctcattgagcttgttgacgcgcttctcgatcttccacatctcatccggaccgaacttgtcggtatcggtcagcgcgctccacagcgaatggtaacgatccaccaaacggttgccgatcgcaatttcgtcaacaccgctcggcagcagcgaaccggacgaaagatccatcaattcgccaataatgttcgtacgggccaaatcaacgtcgtactcgcgctggccttccgtcagattaatctgcagatcaccggtttccgcatcaaccaaaaatgcggagaacgcgtaggcgtcgcgcaggaacaacacgttcgacagtgacacatcgccccaatagaagccagccaaatgcaaacgcaccatcagcacggccaacgcgtcgatcagtcgttccgcggtatcagggcgcagattacgcgcgaacagcgcacgatacggcagtgagaacttcaaatgcttggtgacaaggatcgcttccagcggctcgccttcacggctatgacggcctgtgaccacggcgatcggctgcacggtcggcagttccagcttctgcaggcgacgcagcagctcgtattctcgttccgccacattgcgcgtgatttccttcatggcgtacacttcgtcgcctacgtgcacgaaacgcaccacatgcctggaaataccacgcggaagattagccagcaggtcttccggccaagtagccagcggcttttcccacggcagggtgaacatctttggattcgagcttgcggcggtgattttcagcgcatgcggctccggagatgaggcagccggatcttcggccttcacggaagttgctttcagcacacggggatccatctgtggcaattcaagagattccatgaatcaacaatttacctgttgacctacccgaagaagcaagtatggacgaatccgtttcacctgccgatatgcgatgatctcaatactggaatctcactatccatctcatattacgatcgaatattgcgatcgatgctacaaacagacattacaagccgatatcgtgcttgcggaaaacaaaagaagccccgcaccgacgcggggcttctccaacgagacgataagagaggaagagcacgtctcgtttaatggttgacggaagttcgcgcttccgccaagtttttattcagccacccgccagccgatttccgtaaaggatattcccctgaagaaacagccaacggttggttactcgatatcagctcagttcagacgcagctcggtcgacggagcgaacaggtgcatcttggacgggtcgatcttgatcttgacggtatcgccgaccttcgggagagcacgcgggttcacgcggatcgtggtgagcttgttctgatcggacatcatggtggatgcctcagcagcggagccatcggtgatgatgttgccgtagatgtagccatcggagcccagatcctcaacgttcatgaccttgagggagaaggcgttggcgtcatccggggcggccagggaagcgtcttccggacggaagccgacgacgatctggttgttgtcttcagcggtgagcttgttgacggcctcggccggcagatccacggtgtcttcgccgatctttgccttgccgttgaccaccgggtgggtgttgatgttcatcgacggggagccgatgaagccagcgacgaagacgttggccgggcgatcgtacagctcggtcggagcgccgacctgctgcaggacaccgagcttgatgacggcgatgcggtcacccatggtcagagcttcggtctgatcgtgggtcacgtacagggtggtgacacccagctggcgctgcagagcagcgatctgggtacgggtctgcacgcggagcttggcatcaaggttggacagaggctcatccatgaggaagaccttcggctcacggacgattgcacggcccatggccacgcgctgacgctggccaccggacagagccttcggcttacgatcgaggtactcggtcaggtcgaggatctcagcggccttctcgacgcgcttgcggatctcttccttcggggtgccggcgatcttcagagcgaagcccatgttgtcggccacggtcatgtgcgggtacagagcgtagttctggaacaccattgcgatgtcgcggtccttcggctgcatcgtggtgacgtccttgccaccgatgaggatgcggcccttgttgacctcttcaaggccagcgagcatacgcagagtagtggacttgccgcagccagacgggccaaccagcaccaggaactcgccgtccttgatgtccatattcaaatcatccaccgacggcttatcgttgcccgggtagatacgagtaacatggtcgaatacgacttctgccatgatttgtcatcctttcagaggcaggtacgtgcctcacgatccgttgtaaagggatttcttttcggtgcctcgccttgcggcttacgacttcgacaaagccacaattcaaagcgttaatttatttctttggtttggcgaaggttctcttcgttgagccacgttccatgatacatacaacgctaaaactgtcaatgcgtgtcgcgagtcgcgctgtttacctacgctggcaaaagggggttaacggcgtagtaaatacacgcctttatcgccatcatgcaagacaatggtgcggagcgaaagacagaacagggaggttgcagtgcgcaatattagaatcggcgtggtcgaggatgatcccgcaagctgccagctggtacttgactatctcaaccgatatcagcaggaaaatgacgaacaattcaccgtttccgtattcgacgacggcgcgagaatcgtagagaaatatacccctgtttacgatattttactgctcgacatcgaaatgagcgaaatggacggcatggccgccgcgagacgcattcgcgagcgcgacgacaaggtcgtgatcgtgttcatcaccgccgcaccgcagtatgcgatcagcgggtacgaggtgcgcgcattgtcgtatctgctcaagcccctgccgtggttcgcgttttcacaggaactcaagaagtcgatcgacatggtgaggcgcaatggcgacgattccatgcttatcgaaaccagcaacgggcagatgcggctgaatcttgccgatattctgtatctcgaatcgatccggcataccatcgtcatccacacgttggaaggcaaactgtcgatcaatggcacgctcaaagacatggaagcgaaactcgccgaccaccatttcttccgctcgaattcctgctatctggtgaatctcaagcatgtgacgggcgtcgccgaccaggattgcgtgatgtcgaacggcgaacagttgcgcgtaagccgaccacgcaagaaggcgttcctcgccgcgttgaccgactatataggaggtggcaggtgaccagcgtgatattgccgaatgcgctggccggattggcaggaggactggcaggaggctccccttccataccttccgttttggtgaccgtgctttcggtgccgccgatgacgccaatcaccaacgctctgcccgacatcccccgttcttatacggcgatctgcgaatgggccgcgtgcatggtgtatatcgcggtgtcgtatcgtcgcgtgccgctccgacggtcgatcatcgtcagtgcggccggcttggcatcgctggtcgcggtgcagtatttcgacggcagtatgccgatctggttctggatcatcggtatgctgctcgcattcgcctgcatgtatgcgacgattctgctcggcgcgggcaccggcaaacgcgagggcctgtatattacggcgcgcgcgttcgtgttggccgaattggtggcgtcgctgcattggcagatcgttacgttcattggcgtgcgcgacggattcaccgattacgattggcgcgcgatcgcgctgcttgtcgttacgtatgcgctgtgcttcggtctagcttggatggttgaacgcggcaatttcagccaggccacacctaccttgccgaccgcttccgccgcgattgcgacgatggccattatgatcgtcacgttcgccatgagcaatttgagtttcgtgtcgacgaatacgccgttttccggttcggtcggccaggaaatcttctacattcgcacgctggtcgatttctgcggtttcgcgatcctatatgcgcagcaggagcaggcgcgccgtattgaggcgaatacggaactcgcgtcgatcaacgcgcagctggaaagccagcatcaggaatacctgcaatcgaaggaaaatatcgaatcgctaggccgtcttgcgcacgatctgaagcatcagcttgcggcgttgcgtgccgaagtcgatccgaagcatgccgcggccggcttcgagcagctggagcaatcggtgcagcgctatagcgcgcagcagcataccggcaatcccgtgcttgacgttattttgaccacgaaagagcgcacgtgcgccgatcgaggcattacgttcacggcggtcgcggacggctcgctgctaagcggcatgtcgtcgatggatatcgcatcattgttcggcaacgcgcttgacaatgcgatcgaagcgacgtcgaaattgccgaaacgtgagcagcgtctgatcaaacttgcgttatacgagcagaatcgctttattgttatccgggttgagaattattacgattcccgattgaagaaggatgcggaaggcaatctgcgcaccaccaagcgcgacgatcagcatcggcatggtttcggcgtgaagtcgattcgtcatatcgcgcagcagtatggcggcgaagtgacgattcgcaccgaagaccactggtttgtgctgaccgcgcttattccgcggaaaaccggccttatggccatgtaggactggccataaggcttaaggcggctccgctagttttcaagattctgcgcagcggcatcgccgtcagacgcatcaccggcatcaccgcctgccgatgcgtcgccaccagcatcgccggcattcgccgcacctccagccgacccgccagccgcagcacctccagccgtattgtccggactattcgcagcaccaccgttagagcccccgttagtgccgatattggtgttgttcgtcacggtgttaggagtcgacgacgcctcctggtattggtccatcgcctgctgaacggcgtctttggcggcattcagcgcgtcaacggcggccgtcacgtcgttttccttgagattggtgccattggcaaggtttctggccgagtcaatcgcctgctgcaatgccacgcgcacgctgtcatcggccaccatgccgtcggaattgtcgagcacggactgcgcctgctcgatcgcgtcattgagctggcccttcagacgattctgcgtggccagcactttggaagcgtcgacggcttcggccgcatttgtaatcttttcggccttgtcgttcatgctccgcgcctcggatgccatggctttcgcggatttcttcagcttgctgatgccctgcgacgtgtcgcacgacaggattttcgcttccttcgcgttagatatggccgcattgagcttagtgacggtgctgacatcggcgacttgatcggcagtgaccttcgcgccggtttttccgatttccaaagcgtcggaaagcgtgttattggcactttgcagctggctcgtggaatcctggcattgcgcggctgcgctggtaatggctgatttcttggaattattcgaaagcatccaacatgcaataccgccaatcaaagcaatcacgacgatagccgcaatcacgatagcgacgattttgccggtattcttcggtggtaccggaatttcattgctgtaatcgccgtaatcctcgaaaacactgaaatcgcttacaccgttcacatcgctttcttgcgaagcgaccgtcggaggcttcggcggttcggacatgtcagcccccatcacctcggtatccgtcggaaattccagcctgaaattgttgtctttcgtcatacgtccttcttcatcatcgggcgctcagcatcgaccatctatacgccgaccccctagtttaccgcctaacacacccttcaacgcgcattcgccttaattaccttcttttccgcacttttcgataggcgcaaagcggcaagcggctcccctaaacacgatgcggtgaacgcactcaccgcaaccgcgaatccaatgggcacaaacagattgatcggagcatccgcaagttccatcaccaagcaaatcgccataagcggagcctgttgggaagctgcgagcaatgcgcacgcacccagcagagcatacatgccaatcgaattcgtgtgaaacacctgcatccacagaacacccagcacagcaccccccgaagcgccgagcgcaatacccggctgcagcacaccgccggaagcgccggaacggatcgtcagcaatgtgacaatcgccttcgccaggaatgaaaccaacaaaatcggcagcacagccaaatcaacgtcggacgagaaactcaactgcgcggtggcacggccattgcccataacctgcggcacccaaatcgccaccacgccggtcagcaagccagcgagcggcagcatccacagaatgccaacgcccgacggcttggatttctcagcccactgcgagccgcgacggaacagtgcgccggccgcaccgagaaccagccccgcaaccagtgcgaacgccatgtaatcgggtgtgaacaggccgtccgctttgccgatcaggtagaacgcgtgcgtgcctttgaccagcgacgccacccacgaagccagcgcggaacaggcgaatgcgagcgtcaccgtttcgagggttatgtcggcgagcagaatctcgaccgcgaaaaacgtgcctgcaagcggcgcgttatacacgcccgcaaggccggcggcggccgtaatggccaccagcatgcgggtgtcttttgcgtcaagatgcacccaacgcgcgaaccgttgaccgaacatcgcacccaactcgcgcggcgccacttctcgaccgatcgacatgcccgtaccgacaatgaaaatctgcagcaacacatgcacgacggtctgccaaatcggcataatatcgccattcaccgcctttttgacggacggcaccttcgtactgcgcgtacgcaacagccaccaaatcacggccgcaatgaccgcacccgcggtcacggaaatcagtcgacgaatcgcaggaacgttgaacgggccggattcctgcgaattctcaacatagccgagcgcaagatgctcgacgccgtacagcataagcgtcagcaggccagcggccgcgccaatggccactcccacaatcgccaccgccgcaatcagcgccggaattctgccaatctttggctgcgttccttgaggattctgcgactcctgcgattctcgtgttttttgcgattcctgcgattcccgcatctgccgcactccttgcacaccgtctccttcgttcaattcattcccccaattgtcccacctgccgcaacgttcatttgttacgccccgagcgtggcgatcggcagcaccagaatgccgtcatcacgccggtatgcaatatcaccacgcccgacaataaatgccatgaattcaggctcacgaacttgagatagaggatttccgcacactttttctttgaaagcatgtagtttgtccacatttttctccatgactttcaagtcgctcagcttaatctccaccgcagcccagcgaccatccaccaattcaagaatcacatcaacttcaaggcctttttcatcccgataatatgcgattcgattcgtgccacccatcgattcgagatacacgcgcaaatcacgaatcaccaatgtttcaaacaaatctcatactgaatcagagacaatagtgatgacgctctcagcttatccagcacaactcattgcacatcatttgatagggattgctgcgagagctgcatctttaggtcatcgacttttaattccaaacgtctgatataaagcgcctgtcgacggataatcaaatcacgcatatcatttaccggtttcagggttaccttcattcgtgcgactggaagtaacctcagaatcggggagattcactctgtctaccgtacctggatcttctattcgtattgtcttcctccaacgatgcatgcaccgttcaatacgcttttcgcctatcaactcaggaccgagccccgcttcgcggaacagcacagtgggagattcaccattttcagcactcgaaacgcattcacgcttgaaccactctgcatatcggatacgtgaaccagtaatacttatgaccgcaggcagcgaagccagatattgtgcttgttccggagagaatcgttcgtcgctcatgcttactttttcacttcatcgtgcaatcatctgtatgggatttgccggccgaattgacgtcccgtatgcgacgcctcatgcgcaatctgaacaaaatgaacgcaacaagtaacatgagccccgctgccgcggcaatgctgcctacggcggcacccgtacgaccgataaggccaggattgcccggctcctcgctcgggttattttcgggcgggacaacaggagttccagtgctaaatttcagctctactgtgatgttgagatcagcggctgtgtctccgctgccgggaatcgagatgaagaacggatcacagtcgtatgctttgttggctttcgtcgaatccgtgcgggagaccagatatagaccgagcggcagattctggaaagtgagctgaccagctacgttagtggtgccggaatgctggtacagcttgtttttcgccgcgtgcgtagcgagcttcttggcagcatcgtgatattcacttgatgtcaggcgttcccaatcggcagtgaggccggaaaaatcgccgacggttttatatgaggagacgctaccatcattgttcgttgtgacggtggcgacgcgcacgatggaataggtgtcgccggcaagcgatttgggcgaagccgtgtctcggccccatacggcattgatggtgagagcgccgaaagaatcagcttgcgcatacggcaccatagagccgaaggctgcaagaacagtgaggacgatagtaacggcggcggcaatcatggcagcaatgcgcgccgcaccatattcgcttccgctatgcaggtctaacatgtctgcccggtccttttcgccgtgatgaatgtgattggttatttgtactgtctggctgaggaggcaagccaccgtccggctcgatggctgcggagctagaatcatcagacgcgaccttggcgctcccactctgtcggcgtcgccgctcatgacgctgccataaatgccatgcgatgagcaaggcaatcagtgcaagagacggcaacaagtactgcagcggaatgtccacgtggaacgtggatttggcgtcatcctgctgctgcggcgcgtatgggatgcgatggccgcgcaccagcagccgatgcgtattgaccgcatacggcgtacaagtgatgagcgtgaccaaatccttgccgggctcaattgccagttgtttggtatcggtcggcagaacggtagtgatcttatcgacctgatacgcatacgtgtctttaagtattgtgatgtagaacttgtcgccttttttcataaggttcaagtccgtgaacagttttgccgtgggcaagccccggtggccagacagcgccgcatgcgtggacgcgccaccaactggcagtgaggtctgttcgagatgtccgatgccggattgcaacactttctcggaagtgccgtgataaatcggcaaggtctcctcgagcttaggcacagtgatgtatcccatcatgccgtcgccgtcaatattgagcagactgttgtattcctcgtccgtggatgcggaattgacggcactggcaagagcgtcggtctctcctgcatcgttctgggcgagcttttcgttataggcgtgcgcagcatccagcaccttctggtactgttcctggctcaatgcttcaacgctggcgtcgtagttatttacggcgcggctggcgttgcgcataatgaggaagttgctgatcgtcggatagaacagaatgagcattccaccgagaatgaccagtaagggcaggatgttgcgcagtcgtttcatcgagcgttcttttcgcgaggaaaccgtgttgtgggcgtagcgggtgtgtgcccttcacgcccaaaacacggccatgctcgtcaggcgttcttgcgcttgagagtccaggcaacgccgagcgcgatgaccagcacaccaatcaccgtgaaggcgatggtacccatgccaccagtgccaggcaggatagcaccggacttgttctggaccgggatgacaccgttcgatgcggtctggttgtagctgttgccattgtcgttgttgtaggtgatggcgacggtggcatccgtggtgtcagtgccgtcgttcttgccatcaaccttcacgccgatggcgctggcgagcttgttgtagccggccggcgctttggtctcggtcagcgtgtactcgccgttctccagtccccggaagacaaccttaccgcttgcaggagtggtgatagtcgtcgtagtatctgtctcaccagccttagctacacggtatacagcgttcgcggtcgcactaccggcatcgacttgcacgaagctcatagcgatgccgttcttaggtgcaagtgtgaactcagcaccagcaagtcgagtagcgtcatcatcatatttgtcaccagtgtacttatcgacggtgaagccataagtgaagacgcgaaccttgctgggttcggactcaccggtgccaccgctgctcgggttgttggagtactgaattgttgcggagttggtgttaccaacaccgcccacaacagccttctcgttcagcgtggccgtgtaggtgacggtaatcttcttgccggcattggcctgctgcttggccttgaagtccttcatggcgacagtaagcgtattgtcggagaccgtaggagtggtgacggtgtagtcagtgttcacggtcagtggatcagtcacaccttcgaccgtaacggaagtgacttgtccaaaggtgaggccctgagacaacgtatccttgaagttgaaggtgtaggtgtcataggcggacatgtctggaatggtggaggtcagggtgaaggtcagggtatcaccgatcttcgcgtcagtggcgtccttaccagtgccgcctacctgtaccttcttgtcgacggtaggcaggtcgcccttaatgttggcagtcacattggtgctatcaacggaaactagcgtggcgtattgaccactggcgttggccaaggtcgcacccggcacagcgaccacgtagtagccgtagtcgagaccagtgaacgtcgccaagtacttaccgtccgtagcagcggcagataccttagcggtcgtgccagccgtgatgttgttggccttagtctgcgcccagttcgatgccttggtagcgaaagcaaccaagtcttcacccttcagcttggatacgtagtcgtttgctttatcgttgacgttctcgtcggtagcaccagtcagtccggaagcagtggagttcttgaagaacggcttccactcgtcagtcaacgtgtaggagacagccttgctgccaccgtcaccgctcacggtggcggagaacatcttgtaggcgttcacggtcttaccggcgaacttcgcgtcagtagtgctgaccgtcagcgtggcattatccgctgcgttggccgtggcgactgtcgtcgcagccaatccaaatacggtggcaatcgccgcagcggcagcgaaaacccttttcatcagtgatttcattactgttccttcctctaaatggaaatcttttctgtttggcagatacggtttgtctatgtagtcgtcacgcggcatgggcacctcgctttcgtatacggctggagcccgagcggactgtgccggattgaacgcgttgatcacgcacgtaccagaccacgccagctcccataagcagcaagccgaacatcagaaaccacatcgtgcccgcgcctcccgtatccggaagcaacgccgcattggtaacaatggccacgcgttccttggtgttgtaggagaccgatacttggtatccggcctccgcgggcttgatggtcttggtggtatcgccgtccttataggtcacggcggtttcttccacggtgtacgtgtagtaacgcacgatgtccttgccgttggcatcctgtccatccacgaatgcgaccggcagtccttgaatcaccttgcgccaggtgttgctccaggaagaggcatcggaggagtccaacgtcaccgtccatggattcttctgcgtcacggttgtgcaatccgcgccgaagcattgaatcgtctgcggcgtcaccgtattgccacggccatcggtatagtgcgcggcgatcttcagttcgaccgactgcggccgttcgaggttgccgtccttccacaccttctgcacggtcaagtcaacgctccggcagccgtccttgccgcacgggtcctggccgtcgtccggttcgggggtgagtccgccgttgttgtcggtcacggtcgcgtcgagcatgagcacggccttggccggggactggtaggcatcgagcttcgtcttggtgctgccgtccgtggagtcgaccacggcatccttgatgccaacccatgtggtaccagcgtcgccggatgcggagctgtgcacagcgctgctgtcgtatgtgttgaccacgtcgaacagcttcacttcccaacgatcgagtccggtgttcagcgcatcgtctgccgtgttcttctgcgagaagatcttgttgccgtcctgtgcggaggtgcgggcctcactagcgttcgcggccgccttgcggtaaatgcgataggtgttgtatgccttgtcgccgttgccgtcatcgaccggtccgaggatgtcgctcatggtgttgaagtcccatacggacttgagtttggtgttcgagaacgggtcgaccagtccgctggcaccgcggatcgtgtcggcgtagaccatgtggtcgtctgccagcacgccctcgtcgttcagtccggcgaagccgcccgtgtagcctgtggaaagatccttcacaccgtcggtatcctgagttgcccctccgccgaacacgtcatagccattggcgatgcccgttacggtggactgttcgacgcgcgtacggttgcccttgatgagctggacggtcaggttgctgcctgacccatccatatcaatgccgtctttgctgcaaggcagtttgatgacactatcgccgatggtgacaatcgccacgtcggtctgctgctggttttcatcatcagccttggacagagcaacactcaccttcagtccgaacaggttcacgtatagcacgtcgccttccgaaagcaccttgagatcgaataccttgccgaagatggccgggaaccacttgcctaaatcgatgacgccgacctgttccgccttgtcgaggtacaggagcttgaccagcgcgttcaccacttgcagcagcagttccacaagtacagagttgaccttcgcgtcaaccaaataggcacggctggtttcaccgacgaatccgccggcaatctcaccgctagtgaccttcttgagattgtcagacgtgcagcccttcaccctggccaaatccacgtatccaacaaaaccgcctgcgacctcacgtccggtagccttgtcggtggctttgccgtaattgtcgccatggtgtgtggcggtgacggtataaccgtccgggatgccggtgacgcgcgaatcgccaacgtgcgagccccagatgtcaagtacgccggccgtggcaccaagcagattgagcgcatccgtgccgagttgtgcattgtcggcggcgaccgtgccggatttgccaagatgcccgatgaagccgcccacgtagttcacgccggtcacactgttgaggttggtgaccgcagactgcttcacagagccattgatcagtccaccgccgaagccaccgaccgcaccggtgtaacgcttcgagtcaagcatgccctttgtggtggaatcatgggcgacaatctggatgccgtcgctcacaccgttgacctgaccgtcatagatgaaggtgcggaatgcttcgagcacgcccacgttgccaaccttgagcagtttgagcagcaggttggtatcctgcttatcgccggcctcgccgccgccgacggaagcgacgctggatacatcagcaaggccaaagaagccaccggcgtattgcccgccttcgacagcgcgcagcccgttaacagtaagagaagccgggtcattgttcggatccgcttcactgccggtgcctttggcggaatccttgtcaccgaggatcgcggcttgcaacgaaccagcgaaaccgccggcgttcagggcatacttggctgtggtattacccttatcgtccttgctctcatatgcgccattgaccgtgtatccccatgccgggtcatccgagctcacatgtgcaccgcgaatcgtcgtaaccgtggcctgcaatacgctgaccagacttgccgggttcgataccagcgagtcgaggattccttgcaggaatccctcggacgcattggtgtccacatccgcaaccgcaccggcagtggccacgccgataaatccgccgacattgttgcgcccttccaccttgcgcaggttggaaacgttggcgccggcagcggtgacaccctcgacaagcttctggccgttctggtcgagatcgccccagatctggccaccgaccgcgagaccggcatagcctccggcattaccggtaccgtgcgtgatgtcttcaccggtggccacgaccttcatacccttgcggtagccggccacgctcgaagatttgacgacgggcacaaatacctgtgccacgtcgagcatctgtcccaaatcaagtttgatgcctttgtcgccgaatagttggatagagccgaacgaggatgccgagccggattccatcgtgcccgcataaccgcctgccgcacgcatggcagagacggtcttgacatccatcgactggccatcggtgatcgtgccggtgcacatcagaccgacgtgtccgccggcgacgccggaatcatgcaagttcgcgccagtctgatactccgcacgaccggcgacgacgttgaatccgaagatgtaggattcgaggaacttgtccagggaatcctgatcagtaacagagcccgcaccatcgcccgtagctacctcggtaaattccttgccatacgcaccgtacttgccgatgttgtcggcccacgtcttccattggtcgtagctcatattgcgcaaaggaccagtgaccttcgagtgctcctcggtcgggtagaccacagacagcacgccagcgagattgccggccttgatgagaccgccaagcaaggagagcgaaccgccttgagcggtatcggccgcctccatgaagccggtgtaaccgccggcgatttcggcaccgtatacgctgcggatgcgcgcggcgtaggctacgcgctgcggcccgttgtatttgccgtcggtattctcctgcttccacgctgctgtgttgttgccccagatatgaccgccacgattacgacctgcatagccgccggccatgccgcggcgtgtggtcgtatccgatgccgcctgggcacgcaccgcgccgccgcacactgcggcatcggtcgagctgttgcgaatcgtcggcacgaagtcctgcacgagcgagagcaggttgtcgaggttgacaagcttcttgagcacgctgccgtcaccaagcacgttcgccacggctcccggctgcatggcgcccacgtaaccgccggccgaaacctggccgatgatgtatacgaactcatgagagctcgagtcctgaatatagccgccttcaatgtctccggcgaaaccaccagccatacccagtggatcgggctcattgttggcattcctatgatttgcggtgctggccagaacggaatatccgccgatgccgccagtcacatcggagtgttcaatcgacgagacgacgacatccagcacactgagtacatcgttgagattgacgttctggccgagcaggctcaggccaccgcccacagctgccgccgagccgatgtccattttgccgatgtaaccgccggcgtatcgcgcagcggtgactgcatatgtgctgtctttgctcagataggtgccatcgattgatccggcagtttccagattcttcggtgccttgacatcagtacggcgcagttgggtcacactggaatgggacacctgcacaccggaaccgtatccgatgtagccgccggcggaaccggattgcgtatcggactgatcaaatcgggtggcggaaacggtgaagccgggatcatccgggtcggaaatcttgttaccgctagttgcctccacggtggtggcatcggaatgcacacccgcgtaggagatgaatggcacatagccctgcaccacctgcaacaggttggcgagatccaccgtaccgaatttgccgagcaaactcaggccgccgttgccagccgaagcgagcgcaccggagacaaccttgccgccgaaaccacctgcgtatgcgccgccagtcacatggtcaaggttgacaacggccacggggttggtttgcacgcgggactgtacaccggccagcgttgagtcgttcttgagatcggtttcggagaactggttgaccttgccgctttggaagtttcccgcatagccgcccgcgatatcgccttcgacataaccgccgttgacgtacgtcacggtggtatccgtataacttggaatcagatacggtacggcaccgagcaagtcgttcacggacagcaggccgcctttgatcaggtcatccaatatgctggaatcttctgcgttgctgagcgcgtcggcgaggccaccggtggtggagaagcccacgaaaccgcctgccacaccatcggacgtgctggtatcggctgtgaccgatttgaggtttgtcacatggctttcccgggtcttggtgctgttggcctgaccatagaaaccgcctgcagcgtaatcggttgtttcgttgttctcgttcttgccggttgccgcaaccgtgaatccgccagagatgccgttcacgttcgatgcagtgactgcaaccgaagaatattgggcaaccgatagcagaccggaaagcttgataagcccaagcacattgagaccgccagcgccgatggcgtcgcctggtccagagaagccaataaaaccgccggcttctcccctggccgagaccgtggccagattggtaaggttcgtgttggccacgtcgccgccggtggcgcatccgatggcaccgcctgcataatatgaaccagccgtcactgtcaagccggatgccggagcggtgacagacatgttctccacggtgaacgcggcaaactggtcgaacttcttgagcgtggcaatatcgccaattttcaccacactgttgagcaacccagctaccgttgtcggttgcagattgccggcgatgccacccgcgtaggagcccgtggccgtgaccgattcaagaccttctatggtggtggaacgctgctgtgggaagtcacgaagattgttgtacttccagaatgtgagattcttgagatgatcctgtgaggagtcgccgatcaccgtacccgaaccttcgcccacaaggccgcccgcgtaatcaccgccggcagcaactgtgagggaacccttcatttgtgtaccgagaatcacagaaggattcacaccgacgatggatagcagttctcctgcaccgttatcgctgccgctcagcaatttagtcacagccttggtgagctgtttcaacagcgatgcattcgtggtatcgtccgtaccgagttccaggccccatcccacggaggcgaatccggtgaatcctccggcgtgggatctgtcggcagtcacggcgaccgaagccgtaatcgaattattgacagcataggcattggccatggcaccgttgaagccgccggcgtagtcttcggcctgcacggtgatcttatcgtcaccgtttaccgtcaggccactgttttcgatgaggctctgcggacgcagcgcagacagcaagtcgacgccaagcgagttaatcagaccgcccacgttgccgttgcgacttattccggcaaaaccaccggcatattgcgttgcccgcacggtgaaaccattcgtgctcgtcaccgaagagttctcaatgattgcaccaatctgtgcaccgacaaagccgccggcctgcgggttgtccttgttgccgatcaccacgttctctttgaacccgttcaccgaactattcgagataaccgggttgtagtagccaaccggaatcaaggcattcagcccgagcgtgccggacagcaaccagtccaccaaatcgcccagcccgaggaacgggatgacacccaagatcttcgagagtacattggtgagcgctcctacgatgccggagactgcatcgtatcgggttgcgccctcaacatatcccacgaaaccaccggtcatacggcttacgctagataccgaaacatctgctacctcgcagtccgtaaccttggtgtccccgtagatacggccggcaaatgcacccgtggcgaggttggaaggattgtctttgtgcagggtgagcagaccttgaagattgaggtcaagatctacttgtccgagtgtcaatagttttaacgccttcaacagtgtgtcgagcagtaatcccactgccgaagtgagcataccgagcaaggtcggcggaatatacgattcactcgtatgattcgtcaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggccgagctgcggtagcgtgaaccacgcttgcgccatcggccccaacagccttccacaggctggcttcggtgtcgccgtcattggagaccgcaccgagcatagtgccggagaacatgagcggagtccactcggtgttgttggtatctgccgcgttcttggacaggtcgatgtcacggaagatcaggtagttggcgtctgcggaataggtcaggccggtgttggcagcggagtagtccgtttgcgtgccatcagcacccacgccgtaatacttggtgcgggtcctgttgacgcttaacgccgtgcatgccagcagtggactgtcgtggtcggaggcatcagtatcgcgcaaaatatctgaatcggagagatcggcgtcaccggcgtattcggaagacggcgtgccgtccacccactgataattgagggctccttgctgcatgcaagtctgcgtgaccttgttgatgcggccaataaccttcttgccagaaccaatcgcacgcagctgctgctcgttaccaatcaggatgtaggtcttgccgttgatctccttggtggcctgaccctcaaagtcacggccgccaagcgccgtcgcggcgacctgcacatcggccttcgccggcgattgatccgtcgcatttgaggaatcgttcttggcatcttgagaagaagcatcgtttggagcctgcgtttgggctccatcattagtggaattgccagcggtagcttctgctgagtcgtccgccttattgtctgtcgcaccatttgaggattcggaagaatcaccagtagtagaagatgaaggagatgaatcctgctgtgcgtcttgattcgtttcggaaggtgttggcgcaccgtttgatgtattggcctcttctgacgtcttatcgtcaacgttgacattgcgggcagaaggagcagctacgacagtattacccccccccctcagaaattacggcgttaggagagctactcacatcgtctatattctgagcatatgctgcaggcaccatgcacacgatggacaaggaaacagcaataaccgaagcaaggcaacgcttcaaagacaggcactgccgtccagattcctgttccgttcctccgttaaacccgcaacggacgaacttcaattccgagctcattgtctcccctcatagattcgcaatcccctttcgggagattactgcatacaactatacggaagaggttgacaaaagaacaaaaaacgttcatttgctggggccggttagcgtatgtctttctgagcaaaaagaaaagccccgcagctatgcagggcttttccaacgaggtcatgagagaggaagagaacgaccccgtttaatggttgacgaagctttaggacctcgccaaatcactcatcattccgcactttcaagtttatgccaatcccgttttcgattttacgctgttttgactttcgattttacgccaatctcgttttcgattttacgccggcaacactgctgacgattgcatttcgatattgagaaatcacaagaaactacaggaaagcagcaaaaagggcataagaaagcccgcccgggaaagagggaagaccgggcgggttgaggaagggaagaaaaagaagtcagctatgaagggttacttggccgtctccttggacttgctcttcggcataacccagaacttgagcagcgggtagctcacgatcacggcgagcagggtgttgaccacggaagcgatggtgccagcaatgccagcgcccatgccccaaccctggcacagaccggtcacatagcccggcagcacaaggttcacaaccacgatgatcacagcgaggatcacgtacttccaagcggcatccttgaagctggagtcagacttgaacacccacttcatctgcacgaagaagttcaccacctgggcgagcgcctcggcaagcaggaaggtgaggaagccgcccagaccgttgccctgagtgtcgtagttgaagatcaggaagtggaacggctgcgtcaggcccatgccactgatgaagatggcggtgccgatccacgtcaccacgaaacgggtgatggtggagatgttcgacagcacgttgaacaggatgaactcccagatgttcgggtggtccttgatccactggcggatcggaccgaccttctcagccggctgcgttgcgttgttatcagtcattgttcagctcctttgcagtacgcttgtttgcggattggttgcggaagaagccggcgatgacgccgcccaatccgcggaaggtgtgtccgttggcgattttgacgatggcgtcgaccatcgcggaatcgaccatgccttgggtcatcttgctcatggctcgcggaggcatgttcaggatgaacagggtgttgaggtccggagcgccggtcttctgacgaatcttggcctcctgcttggtgagcgtcttggcgacggtacgcgccacgaagcccttggaatccacccacgacatgatcggatcgttcacgccgaacgtcaccggcttgcccggtgccacaacctcatggccgaacagcacggccatttcggcgtcggtcacttccttgacgtggccgctgagataatggccgagcgcagtatccgcggcaaccggattgacatcgcctgcgacggtgcgcggaatcgtaagcggcaggtgttcggcgttgtcgcccaccatcagcgtccactcgccggtttccgtcttccattcgttgctggcaacgtcgaagtgacggaaggtgtaacggtcgaaatcgatgtgcacgctcttgctttcgtgtgcggcaagcgaaaccttggcgaagcccttgagctcgcgatccggacgcaacacaccaccctgcggaccgcgcacgtacagctgtacaacggtcgaaccggcaacatcggaatcgttgctgaccatcacgtcaatgccgttctcaccagcagtggcggcactgtaggtgaacgtggagtagctcaagccgtaaccgaacgggaagcgcacgggcacaccggcggtctcgtaataacggtagccaacgaacgggccttcgcgatagatcgcatcgcgaccaatcgccggataccaaccggagctcgggcaatcctcgtaatgcatcggccaggtttcggccaagtggccggacggattgatctcaccggtcagcgcgcgcacggtcgcggaagcgccggcctgacccgacagacccacgtaaagcactgcggcaacgtcgtcaatccacggcagttccaccggagagccggcgacaagcacgaccacgatcggcttgcccgcgcccttcagcgcttcgaccagatcgttctgcacctgcggaatcgccatggtggaacggtcaaggccttcggattcgctgcgttcgtcaagaccgacgactgcaagcaccacatcaacgctttccttgccagccagcgcgactgcgtcttccacgagcacgcggtcagccttgccctggcggtcatagccctgctcatagccggcaagcacgaggccttcggcgttcttgacctcttcaagaatgttctcttccttggtggcgtttaccttggaggagccggaaccctgataacgtgcggttgcggccatatcgccgatcaccgccacgcgggtgccggccttgaatggcagggtcgcgttatcgttcttcaacagcacactggagccttcggccaccttgcgtgccacgtcgtgatgcgctgctgcgatatcgtctttgagcagatcgttacgtccaacaccgaccagcttggtcgctgccgcgatttttgcgacttctgcggcacgcgcgttgatatcggcttcagacagggttcccgccttgaccgcgccttccagctcacgcacggaagtgaagcccggagacggcatttccagcgatccgcctgccttgactgctgcgaccgcggagttggatccgccccagtcggagatgaccatgccgtcgaagccccattcgtcgcgcagaatctcctggagcaaatgtttgttttcgtgcgcgtagacgccgttgatctcgttgtaggaggtcatgatggtcagcggcttggcttcacgcactgcgatttcgaaaccggtcagatacaattcgcgcatggtacgctcgtcgaccacggagttgctggcctggcggcgcagttcctggctgttgactgcgaaatgcttcgggcatgcggagatgccgttgctctggatgccgcggatcaggcctgccgccatacgtccggcgacgatcggatcttcggaatagtattcgaagttacgtccgcacagcgggttgcgcttgatgttcagacccgggccgagcagcacgttcacgtcaagatcgtgcgcttcgctgccgagggcctcgcccatttcttcggcgagcgccggatcccaagaattggccacggttcctgcggtcgggaagcaggtggccggcttggatgcgccgatgccgagatgatcgccttcgccgagctggcggcgcacgccgtgggggccgtcgctcatcacgaagctggggatgtctgcgcggtcgttgcctcgcgaatcccattcggatccaccggaaagcattgcggccttttcaacgaccgaaagttcttcgagttccattggctctcccttgcactaagtatgtcgcaaacccacttcgtcaggtctgtcttgctcggcttcactgtggtttttcttgcgattttcccgctgccgcaccgcgctgcatcgtgccgtgccgcacgcaggttttcgccgctagtttgattgaaccagcttttgtcacatcaccactgccgtattacacaacctgtcgttttgcacgcacaatcggatatccccaaactgatttcggaatcaaaggaactcacatggcagatacgtttttaccgctcccccgcgctttcgcatgcgttccatacacaccatacggcgtaggaaatgagcggacagatggtggcggaaataatcacgtcggtcggatagtgcaagccgagcagcaatcgcgaacaggcgaccgccatgacaagcgcgacagcgccgatgatcgtcctgcggagaaacacccgtcttctgtttgcacgcccgtcatcttctccgtcggggaagcatttgcgcgcgaaattacgcacggtaagaatcatcatgaccgatacgatcaccgcggctgccgtgtgaccactcggaaaacttggatcgcccggcaacagaccattgccgacagacgtgatcggacgggggcgttcgaccagccatttgacgccggtcacgtacagtatcggcgccgccgacacggcgacatcgcggatgacgacgtgcctgctgccggtaatacgcaaatcgacagcggcgagcgcagcgacgattgcgatgcagcctaccgttgaaaacaagtacgcaagtatcgtggagcagtcgcgcaacccttctggcagcgccgctaaagcctgcaaaatattggtttcacgcattgttgcgattgcagaatcgcgcagcgcgacgccaatcataggcacaatgccgcacaatatggcggttgcgattaccacagccgccgccctcgcgatacttccgttcttcatatgcataattccagttaagcacagttcactgtgccgtcgccatgtgttcacatccgggatatccccgaaaatcggcggattatccttcaggatgcttccatggcttccctgacacacgcgctgcaaacggccgtgcaacgcaaatatggcatacccgcacagaaaataccgtgaacgatgcgagaatcggagttgacgttcaagaaaaaagaaggaaatatgaccgaaccgatagcaatgaccatacgccatatgaaaatcgaggattatccgctggtatacgaactgtggatacgatgcacaggtttcactatgagagatatagacgattgcaaggatgcgataaagacgtttctcgaacgcaatcccaacacctgtttcgtagccgaggacgatggcggaagaatcattggcgcgattcttgccggccacgacggaagacggtcgcgcatctaccacacggcagtcgaccccgacgcgcgcggtagaggcattggctcgattttggtgggccgcgtggttgaaacgcttcgtgcgatcggcctgccgaaagtcgctgtcggagtgcccgcagacaacgatgccggcaacgatttctgggaacgtcaaggctttgcagtccgcgatgatttggtttatcgagaactgccgttgtaataacgaaccatccacgatgccgtgcacgtcgcctcagcccacgttgttcgcggacagcgagtagaagccggccagcatgccgccccgcccatggacacgtaggcaacggcggcgatgccgcggcccaacgcgttcattgcgtggcgcaacagccacgcgtcaagagggccgccgcgatggaagtccgagaggccatcgatggtgaatcgctattcggacggaagacacggtctatgcgaacgagctatgccttggctagcttcttatgtctgagagtgtaaacggcatcggcggaatcggcgacacgcttggaatgcgtcaccacaatgacacatttaccgagttgatgagcggcctgccgcaaaagatcaatcacctcgtcagtcatttccggatccaagctgccagtcggctcatccgccagaatcgcacggccgggcgccactagggcgcggccgaccgccacctgctggcgttggccacccgacaagtgcatgatgttgcgcttcgattcctcacggctcagccccagatcctcgaggatcttcatatcggccttgggattgaccaagcgaagattctcttcgggggtgagatagtcgatcagattatggtcctggaacaccaaggacacgtgctcgcgacggtgctttgagtaacccgtcgtagctatatccttgccctcaaaacgaaccactccatcagagggggcatccagaccggccaacagagacaacaaagtgctcttccccgctcccgatgggccggttatcgcatacatctttccggattcgaaatctgcgttcacgtccgaaagaacgcggatcttcgccgcgccgtatgagtaattgacatggtccaattgcagacagatagtcatgattaatatctcctaacgcatagaggaaagaatggatttcggggatttggccagcactgcggcgcacgacacggcgagcgcgattgcgatgaccgcgcatccgagcagcagaatgagcagcgtctgttctggcggcagagtctccacctgcaatgattcaagaggcgcgactcccgaatcgtgcagtaggagtgaggacacgtatccagacaatagagagcctgtgcccagcgagcacagggcggcaaccacagccatgagaccggtttcgattgcgaactgggcgataatctgcatcttaccaatgccgagagccagaagggtgcctatttcatggatacgtgagcggatccagaagacaagcgccatgcccagtaccaacacatcagccaggcaaacggacaacagcaccatgcggaccagatcgcgcaccgtttccactgactgcagcacgccggaaagccgtgccgagtcatcggtgacgccatacttgcttccagcgattttttttgcttgggccactgcggcggagagagcctgcggattatccgaaaggcaccggatcgtgccgacccgttcctctccagtcagcgcggaaaccacttgaacgcccgaatagataagattctccgatgcgtccgatggcatagggctctgtgcctgcacattgccagagaagattccggccacgcgaacggtggaatcgcggtcttcctgactgagccggagtgttgatcccaccgatagcccattctcacgtgcgaaatcccggtgaatcagtacgttccggccattacctgaaatgtggtgtccttgttccaaccggtacagaccgctttggaactcttcggacaacgaggagtcagtggtgcccagcacgctgacctgcgtggatagaccggaatccagccgaggaccatgttcggggacaaccggatgcgctccatccacccctgccaaggtcttacgctcgtaaacggtttttcctacgccggggatgcgcgagaaccggctcgcttcctttagacttgcaggattctcgcctgtgtcgacagtaaaacctattcccatgcttctgccgatatcgtcggacattttctgaagtgccgttgacactccaacctgagccacaagactggtgaaaaccatcagcatcagcagtccgatgattccgctgcgtaccggtttacgcacgattgccagcgtggcacgattccacacgttcatgcccgtcatcggagctccgacaggcttcgcggcgacttgcgcagcatcggtatgcacgatatggcgacgcataccagcatcaccgccagcaggccgagcgacacatacagtacggcagtcgtgtcgatcgataccgtgagcgaatccaaggtacgaaccgacatattggattcgagatcgccgccaacctgccccatgctgctcagctccttcgccgcggaggcgttcacggaacggagggccgaagtgccaagccattgggccactcctcgtgcgcacaaccatccgagggccagggacggcagaccgatcagaatcatctcggttagatattgggcgatcagggatggcttgccgatgccaagggacaccagtacgcccatctcctgacgtcggtcgttcatccacagtaagagcatgagactgagaactatcacggccgaaatggtcacgccgatcaaagcgccgagcatcatggaacgcacacctcgggcggcattcagcatgctcgacgtatattggtcattgcgcgtgatctggtagttgttccaatccactggaagcttcttcgccgcttccatggttttctccacgtcgacacccttgtccagaacgaaagtggcatcctgatatatttccttgccggccttgtactggtacagagtacttgtagtgtccaaatcggtgtacacagtgttggaggtgagttccgcgcggctggatacctttctgtcgctgtctcctttgaatattccaacgatggtggttttgacggttgccgtcgaatgcgactcattgtcggcatcatatggattggccttgagcgtgagggtatcgccgactttaagcccattggttttggcgagatcctcatggaccatcgacatatgcttatcggatgccttgagatgacgtccgtcgaccatgctgagcgtgtgcgacgtgaacacattgagttttgacgaatcgtttgtgcctatgacgttggccgtattgccgaactgctgttctttctccgcatcgtaatcatcgccgccggggaccttcaccacgctggctcccacgagatcggcggtggcgttctgcctgaccatgtacgagtcaacaccggacagcttcgagattcgttgcacatcagcgggacgaaccattccgcctccgcgaggtgtcagcatgctgccttgcaggttactggccagcacgaatccgccgaccgcctgtttctcaatctgtccggcctcatgttgcgctgcccgagaaactgcggttgcggacagcatactcgccgttatgatggtcagcacaatgaacagcactgcggtgcgcactcgctttctgagcacatagcgcgccgctcgtgagatgaatgtcattaataccccctgtgaagctgggaccttctcatccgaaacaatgaaatctaattcgattcttcgattggtcattcgccaaaatacatggttcacctcggaacatggcaagatatgccttgagcgaaaaaacgaaacaacattggttgcattatgctccgggacatcggtcgttttgttcatttgacaaactttgaacggctataaaacagtgcatataccaatggaggccccaatcgaaattggggcctccatcagagagaaaggaaggagtggcaagtattggttatttattcggtcagaatcttggccttctcgttgacgcttcaaccgtctcgaccgtcttgacttcctcgtcggggatctcaccggccgcgagcttggcttcgagctgctcgacgatttcggcgtgcatcttctcgttgatcttcaccttgaacatgaacaccagcaggctgagcacgatcaggtcgagcggcacatagaaggcgcagacttcgaaggtgtggatgttcgcggcggtcatgttggcggcggtcgcgtcaccggtcatacctgccgcaacggcgatgaagccgacgatgccgttcgacagggcgccaccgacaccttgttcaagaaggttttcagcaagtaagatttgagtctttatcaaacgcctcggctgctgtgatgaaccggtccagcagccgaggcgttcccatatatgccccagccgttcccaaatccacctatccgcttcgccgacttcgtccaactttcccgacaatgccattgctcaatggcgacgaaggatcgcagaacgcattggccattgcctcacggaacgcctgacggccaaaatcaggcagattgacatgaaccagaccgctcatgatttcgtgattcggattccaaggcttcaatgcgttgatgtgcgagaacatatcaaccaacggcatccgcgaagggctcggcgttgacggccaaagacgcccctttcatcacttgaaacacttccgatgccatgggcatgaaacgtcggatcgcatccaccttgccgatggccagcactccggcaagcgatggttgcggaccgtagggaccgtccaccaccatcaacaacgcatggtcgaggtcatcgtcatctaacagcagcaatgtatcgccggaattggtgagacgaatcctgtcgcgcaaccgttcgcgcgcgacaggatcccagtcgtccaatcgtgattccgcgcgggctgggcgctgtagtcgtagttgcgcaactgggataggcgactgacgaaccggctcgggaacagcggcaccacctcgggcgttccatccgccttcagacggcgctgtcccgcccctggatactggacacaatctgcaagttgcggtctacctcgatacacgccaccggcaacccgttgtccgcatggatgatttcagcacgcaccacgcgacctgcggcaccgtcttgctgaagaagataaacaccgccagcccgtcaacgctgcgatgttccctgctaacaccggttaccgtgccgttgtcttcgatgccaaggtacaacgacccgttttttcggtattggccaacgccaccacgttgtccacgagctcatcgtcaatctgaggtcgggatgcctcgcttgtaaactcaaccgtcaagctttcatggttcagcagcacaagtttactcacattgataccgttccataaccgttttcgatgtgaataagctcacggtcacaacccacgataatcggccacggaatcaccgtaacggcgttatagtgctgtttgtcggcgtcgacaagagccagcggcgccgatgaaaacaacaccaaagatgttcagcgaattgttcgcagtacatgtggtgtgcatccgtttcctcgacgaaactcctcttgttccaaccggcaggtcatcgtacgccagttgcgaaaggattcgcctatacatggcaaggtttaccaagaatcgttggaccagcgcaatcatccccgcactattgatccatatcccaatcggtaccgtctattgctggagcgtgttcaagcagttgatcgcggaccagcttcacgccagccccgcctccgtggaatggggcttctctctcgccatcttctttctcggcatgtccgctgcattcgccgggccgatggttgagaaaaacatcaagaaatctgctcttatctcaatggtctgctttgtggtcggtttcgccggtacgggcgtgagcatcgccttgggattcctgcccggcgtgttcatctgctacggcgcgatcatgggtgtcggcctgggcatcggctacctgaccccggtcaagaacctgatgctgtggttcgccgacaacaagggcctcgccaccggtatcgcagtcgccggtttcggcttggccaaagccattgccagtccggtgatggaatacctgatcggctcgatcggcctggtgaacatgttctatacgctcgccgtggtttacgcgataatgatgctcgtgggattcctgctcatacgccgccccgccggctgggtctatgatcccgcgacctcctatgtcagccgcgtctcgattcttaagaaacccgtgttctggggcatctggctcgccttctacatcaacatcacctgtggtctagctcttatcagccaagagaaagacatcctgcatgatgtgctgaaggcgttcccgcagtacgctccgctaagcccgagcgcgttcgcggccgccatttccggcattatcggtttggtgctcgccgtggattccgtgttcaacaccgccggccgcgtgggcttctccacgctgtccgatcacctcaaacgccgcgaaaccgtatatcaggtgattttcgtgatatcgatcgccgtatgcctgctgcaggtttgcactaacagtatcgaccgcgctttgttgtgggccgtgttgatgatgctgttcctcgtcaacgccggatacggcggcggcttctccaccctgccggtactgctcgatcagcacttcggcacgaaaaccgtatccaccacgcatgggctgaccttgagcgcctgggcattcgccggcttgtccggcaatcagctggcgtcgttcgtcgtcacgcacacccccgatcaggcgcaccgttatgccgcgttgattccggtactcatcgtgctgttcataatcgcgctgatcagtatttcgctggtcaaggccgcaggcaagcgcgtcgccgtcgcctagtcccccataggttcgtggttcctagttcgtgggattacagcggataatcccacgaactgggtgcctgcgccatcgcatataaatatgcccggaatcaagccaaaacctgattccgggcatattcgtcatcgcgtggcattcggttcacagaatcaggcgacggaatcccgtgggccgaagcgtgctcacgcgcttatcaccgtttgtcacacgcttgtcacgcgccgatgagatcaagcatctgaggaatgctcttcttgccgaattcgacggtctgctcgccaccacggttgatgacgatgcagggcacgctcatcgcgccataatggtccctaagctcggggaagtgcgcaacatcgtaggcctcggcgcgcacggccgggttcagcgaggcgatgcgctgggaagcaagcactgtctccgggcacatcgtacaggtgagcgagacgagaatcatgatactcagcgggcttgcaatggactttgcccgttcgatcagatcatcgcccaacggctgaccaggaccagccacgttgtacaggcccaacacgaacgaattaaattcatgaccggaaggcacgccatggaaggcgagaccagtcggctcgccatccaccaccatgcgcacgcatggacgcgctgccggcagcacgctgtcgacgtcgaataccgcacgacccgtatcatccttctcgtactcaccatcatccaccgtcgatttcagcttgccaccggacagcgcgaccaacgcatcgatgaatccccgcagttccgtggacagcggcgtatcgtccagttccagagcaagcgtgaccggccgagacatgcggccaaagaccacgttgagctgctgtctggtggcgtcggagaacaattcgccgggcttcctaacggcgttcgccgcggcatcggcgttgcgtttggtggcgggcgcaggcgtaggtgtaggcgctgtagcgtccaacgaggcagcatctgtcttcgttgtggactgctcgtaggcgcaagagaccgggcgctgtggcgtcaaaccggttttctcgctcatccgcttggcgtaccgttccaactccactgcggcaatagcgccatcggcggtggcagtaaccacttgccgcaggttcttggcccgcagatcaccggctgcatacacgcccggcaccgaggtttcgagatagccgtgcgtgaccacgtaaccataatcgtccagctccaccacgccgcgcaccagattcgtggcgggcacatatccggcgaacacgaacacgccgaacgtgccgccatcaacaggtttccacgtttcggtctggccagtggcccggtttaggatcgaagcttcacgtaaaccaccttgcccggcagtgacaccttgcagctcgacctggtaacgcacgtcgatcttcggattgttttttgctgcggcggccaccgcagcgtcgcaagtgaagtcctgttcccgtacgagaacggtaactttggaggcgtatgtggtcagaaacacggattcctcggctgctgcgaaccctccgccgaccaccagtacttccttgccggcaaagaactcgccatcgcaggtggcgcagtaggccacaccgcggccagcatattcggactccccttcgaaccctagtttgcgtgggctggcaccggtggcgatgagaataccaaaagctttcaagtcgccgcgcgaagtatgcacggttttgacatcgccgtgcacgtcgaggccgatggcttcggcggaaaggaattcagcgccgaaatcctgcgcctgttgacgcatggtctgggtaagcgcacggccagtggtgcggccaacgcccggatagttgaccacctcattggtgatggtgatctgtccgccaaaatcatctttctcgagaatcagtacgcgatatcgggcacgggccaaatacaatcccgccgtcagaccagcgggaccgccgccgatgactatgacatcgtacaaatcatttcgagacataacgactcccttcgtgccttgatctggctattcaggaggtgcccggaggattctcctgggcaccccgtcggattagcttgacaagccgtccgtcaagcgacgatcacagttgaccaacaagatcaaggctaggttcaatagtgtcctcgcctggagtccagttggcagggcaaacctggtcgccatgttcgtggacgaactgagaagcttgcacacggcgtagcagttcttcggcattgcggcccacattggaagagatgacttcataagccacgaccttgccttcggggctcacgatgaagtcaccgcgttcggccatgccatcgacttcgttgtaggtgtcgagatccttggccaatagagcggtcgggtcggcaagcatcggatattgaatcttggcgatcttttcattggcgtcatgccatgccttgtgcacgaagtgggtgtcgcaggagacagagtagacctcgcatccaatttccttgaacttggcgtagttgcgggccagatcctcaagttcagtggggcacacgaaggtgaaatcagccgggtagaagaagaacagggaccagtggccgagcacatcagccttggtcacctcatggaactcgttgttctggaacgcgttcaccttaaaatcggtcagttcatgctgcaggagagtcatcatcggtcctttcgctgattgtcaattatcgggcttctgccgttttccatcgtaacgtgattctctggaacccgcgcgggcgtaacgcgtgagcctcatcacatcattactaacagtcacgctgacggaccatgcgatgcaagggtgttgtggattgggagcctcccgcgcgtcgcgggaaacaagaaccaaaagacaaaaaagagggttcccggagcgtcacgctcgacgggaacccccaacgaaagaatgcggcggcgtgctactctcccacaccctctcgagtgcagtaccatcgccgcgaccaggccttagcttccgggttcggaaagggaccgggcgtctcacctgggccatgagtgcctgcagaagtactggcagtccggccttgccgcaggcgccgtcaaggaatgatcgcaacggtcgcatgctgaaatttcggtaaagcgcataccgatttttcggcaatcgtccgaaaagaacaaaaaataagacctcgggggtgtcatcgtggacatccccgggaccatctcaaatatcttagtaaatatatatactagattttataaaaagattttacgagagctttcgaagggaagctgtcgagctggcatcctcagcgttatagcggatgccatacgcacacaaaggagtaatccatgcatcgcacgttcaaatggccggaactgctgaccgacaacggcaaaggcatcgcatacggcggtgattacaatcccgaccagtggtcggaagacgtgtgggacgacgacgtccgcctcatgaaacaggccggtgtcaataccgtggccgtggccattttcagctgggatcgcattcagccggaagaaaaccgttgggatttcggctggcttgaccgcatcatcgacaagctcggcaaagccggcatcgcggtcgatctggcctccgcaaccgccaccgcgccgctgtggctgtacgaaaagcacccggaagtgctgccgcaagacaaattcggccatcccgtcaacgcgggatcgcgccaatcctggagcccgacaagcccggtgttcaaggaatacgcgctcaccctgtgccgcaaactggccgaacgctacggcaccaacccgtacgtcaccgcatggcatatgggcaacgaatacggctggaacaaccgttacgattactccgacaacgcgctcaatgccttccgcctgtggtgcgaacgcaaatacggtaccatcgaaaacctcaacaaggcgtggggcaccaccttctggggtcaggaaatgaacggtttccacgaagtgctcatcccgcgtttcatgggcgccgactccatggtgaaccccggtcaaaagcttgatttcgagcgtttcggcaacgatatgctgctcgacttctataaggccgaacgcgacgccatcgccgaaatctgccccgacaagccgttcaccacgaacttcatggtctccaccgaccagtgctgcatggactacgccgactgggccgaggaagtcgatttcgtgtcgaacgaccattacttccatgagggcgaatcgcatatcgacgaactgttctgctccgacgctttgatggattccctcgcgctcggcaagccgtggtatgtgatggaacattccacttcggccgtgcagtggaagccgctcaacgcacgcaagcgcaagggtgaaaccgtgcgtgactccattgcgcatgtggccatgggtgccgacgccatcaacttcttccagtggcgtgcctccgcattcggagccgaatccttccactccgcactcgtgccccacgcgggcgaagacaccaaactgttccgccaagtgtgcgaactgggtgcagcgctgaaaaccctcggcgacgctggcgtgcagggtaccgaactggaacagtccgatacggcgatcctgttcagcgcggaatccgaatgggccacacgctccgaaaccctgccgagcatgaagctcaaccattggcatgacgtgcgcgactggtaccgtgcgttcctcaacgccggcacccgtgccgacattgtgccgttgaaatacgattggagcgcatacaagaccgtcgtactgccgaccgtgatcatgctcagcgccgaagatacgcagcgtttggccgatttcgcagctgccggcggccgtgtggtcatcggttacgcaaccggactgatcgacgaaaacttccacacctggctcggcggatacccgggagccggagacggcctgctgtgcgaaatgctgggtattcgcggcgaggaattcaacattctcggcgcggaagccgaaggcgaaccgtccgaaattcgtttgagctccggtgcggtcacccgcctgtggcagaacgatgtgaacgtcgacggcgaacgcgcgcaggtattagccacctacgaaggtgaagaagccgacgaatgggaactcggcggcaccgccgcaatcacccgcaatccgtacggttccggcgaaacatacttcgtcggctgcgatctcaacgtcgccgatcttacggaattcgtgcgcgagaatatcgtggaagattccgcaaatgtcgccaatccgaccgattccgacgtactgcacaccgtgcgcaagtccgccgacgcaaccttcgatttctatctgccgcgcggcaagaaagaaatcgcattgcagggcatcgaaggcgaaccaatctacctgttccaagcggaagcagaggaacagacgggcagctacaccgtgcatcgcaacggcgtactcgtcgtaaagcgcgcataattccgcataatttcgcgcaatttcgcgcaatttcgcgcaattgattgcgtaacacaacaatctcacacaacctgagcccgccattctgaaactcaagaatggcgggcttgccataactggtaaactttttaccggcatattcaacaatcacggagacgaacatgggcgagtcaaagccggagccgaagccggacaaaaaacgcgtcaccctacgagacgtggccgaagaggcaggcgtttcactcaaaaccgcatccaacgtgatcaaccattccggccgtatgaccgactccacgcgagaaaaagtccaggaagtcatcgaccgactcggataccgcgtgaacgtgtccgcgcgcaatctcaaccgcggcaaaaccggtttcatcacactcgccgtaccaacattgaccgccccatacctgtcggagctcgccaaccgcgtaatcgacgcggcccgcggctacggctactccgtatacgtcaccacctacgccgaaggatccgcacaaggagcgcaatcactcctgcgcaacttcaacaccaccgtctcggacggcatgatcctgtcgatctccgaagtcgaaaaccttgaagcggcggacttggacgtggactatccgctcgtatgcgtgggcgcgcgttccacacacggcaaagccgaccacgttacccccgacgatattcaggaagcccgactcgcagccgaatacctgttcgaccatggcgcaacccggctcgcggtggtcggatcgcgaaccgaaccggagcatatcgattccgtgcgtgaagcagtggaaggcaatgcgcaactgcgacttcgcggcgtgctcgaagcgtgcgccgcgcggggagcggcattcgattcccgactggtaatgagcactgggcaggattggacgattggttccggcgctcgcattacgcagcagcttattgattccgggattccattcgacggtattgtggcgttcaatgaccagcttgcgttgggtgcgctgttcactttggctgcgaacggcatttccgtgcctgaacagatgcaggtgatcggcttcgacaatattgaagaagccgcatatttccagcctccgctgaccaccatggattcttgtctcgactggattgcgccgactgcggtcagtcgcattctcgaccggatcgacggcacgcgtgtgctggagccgagttacatcaccacccagtcgcacgtgatcgcccgcgccaccacgcgcgtgtagctcgccgttggtttcgtgccgtcgcccttcgagccatcggtttcgtaccgttgtccttcgtgccgttgatttcgcgctatcgccctttgtgctgttgatttcgtatcgttggcttcgcgacgcagctcgcgatgtttgtgcagacccgaatcaacctcggtgttccggcaattcctgcgcgggcagctgtgccggtcgactggcggacaactgcgcgaggcggctgtgcggacgcagctgcgccggtcgactgtgcggacaccgaaatgggacccacatcaggaacgaccggagagcgtgagaattacaagaatcacgttaagtgcgacaatcagcgaaacaactaccatattgatcgcgaatttcaccggaccatccacataatcgcccattaaagaacggtcgtgcgtgtatttcatcagcggaataatcgcaaatggaatgccgatcgacagcacaacttgccctatgatcagcgcttccgtcggattcttagcaaaccacaacaccaccaacgccggtacgagcgtcaccacgcggcatgcccacatcggcgctttgatccgcaacagtccatgcatgatttcggcgcccgcatatgtgccgaccgacgtggaactcaggctggaagccagcaagccgaccgagaaaatcgtgccgatcaccggacctagcacatgctgaatggcctgttgcgcaccctcgatcgtatccgtgccggtcatgccatgcaatgaattcgccgcaagaatcaatagtgcaagattcaccgatccagcaagtaataatgcccagaacacgtctattttgcttccgtgtagcagggtctttacgctcggtttgggctctcctggcacgtaatggtcgttcaccagcgtggaatgcaggtaaatcgcgtgcggcatcaccgtggcgcccagcatggaagttgccatcaataccgtttcggttcctttgaaatgcggaacaagaccttgtaaaacttgcgcaggatttggtggatcaataaaaaggcctgcaataaatccaaaagtaatcaccagcagcaatgcgataatcagcttttcaaaaatatgatgcgtggcactcttttgaaaaataagcaagaccgtagaaataatgccgattatgcacccaccaataaaaagcggaagtccaaataataatttcagtgcgattgcgccgccaattacttccgcaagatcagtcgctattgcaatgacttccgcttgcatgaaaaacatgaatcgaccgccgtcgccaagtcgttctcccaggatttcgggaagactttttccggtgacgataccaagttttgcggactgatattgaatgagcacgctcatacaattggcgagtaccagcacccacaccagcagatatccgtacctcgcgccggatgtgatattcgccgccacattgccgggatccacgtaggcgacggccgccacaaaagcaggtccaagcatgccggcaagcgcgtgcccgtggcgggaagagaaatcgtgattcgcccgtgccgtttcccagcattccacgccatccgtcgcacccgcattgaccatgcctcccatgccgtccatatcgttcgcgtcgtctgtactgttcatgttcgtcgccctcttatccgagcaatgttatagcgcacgagactgcgcggttatgttacgtacgcgcatatcatctgtcggcatatgcgcgactcatgcaacggcgcgtccgaaccgttccaagacgcaatgcgaggcatgtgccacgaaatatggccgaattgcggcgacctgcggctaagctggaacaagcatgagaacggttgagaataatcgcctgaaacacagccttcgaaaggacaacgcatggcaactttccatacccccatggtcacattgaacgacggcaatctgattccgcaaatcggcttgggcgtgctgcgcatcgacgatgagggcgttacctccgtagtggagagtgcgctggaagccggctaccgtcatatcgacggcgcggcggggtacaacaatgaggccggcgtgggtcgcgcgctgaacaatgcgggattcacggaaggtgagcagcgcaaaaacctgtgggttacgacgaaactgcgcgattccgagcaggggtatgacagcgcacgcaaggcgttcgaccgccagcttggcttgctgcagctcgattatgtcgacatgtacatgctgcattggcccaccccgttcgactggcgttccagtgaaacgtggaaggcgttccaggaattccgcgcggaggggcgcgtgcgcacgctgggtgtgtgcaatttcctgcccgagcatctcgaccgcttgcatgaggagaccggcgaatatcctgccgtcaaccagattgagctgcatccgacctggcagcagcacgaggtcgtggactattgcaaggcgcacggcattgccgtggaagcatattcgccgatggctcgcggtgctgatttgaacgccggaaacggtgcgattgagcgcatcgcagcggagcatggggttacccctgcgcaggtgattctgcgttggcatatcgaaaatggcacgatcatcatccccaagtcggtgcatgcggatcggcagaagcagaatctcgatttgtttggattcgtgctcacccctgaagaacatgccgcgatcgacgcgcttgacggtccgacgcgcgccggacatgatccgatgacgttcacgtacgcctgatactccgtaattccgtaatttcgtattatttttaataattatgcctcgaaagaataatcgtaattcttataattatcggaatattgaacgcgacgtgcgtgatatccagcgggccggcaagcggttcaaaaaaagttggatcaacgccgacggtccgctggaacgtattcttattttgctggtagtcgttgcggtaatcggcgtcactatcggcatgctgctgccgaaagtcaatccgaccgtaggcgaaatcaccggcgagtacacggcaaccggcacagctgcggaaacgttggaaaaacttaccgtcgacgacaatcccagcaaggccggatatgatcgcgatgcgttcggattccgcgaaaccgacgacgatggcaacggttgcgacgtgcgcgaagacgtgctcgcgcgcgatctgacggacgtgcaatataagaacggccgtagctgccaggttgcgtcgggcacgcttgacgatccgtataccggtcagaccatccaattcgtacgtggagtgaaaacgtcttcggcggtgcagatcgatcatgtggtcgcgttggaaaatgcgtggcagtcgggcgcgaacacgtgggatcatgcgaagctgtaccaattcggcaacgacatgtacaatctgctggccgtggatgggcccgcgaatcagcagaagggttccgcttcggccgcatactggctgccgacgaacagtgaataccgttgcgattacgtggcccggcagattggcgtgaaagacaagtacgggctgactgtcacttcgcaggaaaagcgggcgatgctttccgtattgcacggttgcccagcgcaggaattgccggaaagctgaagctgctcatttaggcgcggatatttgcgggtgctggctgggaacggtcgtagttgtagacggtgaacgttcctttgttgaatcgtttggtttcgtacagcgccaagtcggcctgtgcgacgcattggtcgaaatccacgcttccgatcgcgtctccatcggcgcgccccgtgccaaggctggcaccgtcagcggctgcaatgcggcacacgcctacgctgcaatgcacgtcttgcccgtgctgttccgaggtgcgtgccaactgttggaagaacatgcccagcgtggtttcaagcacctgttcgctggcggtgttgcgaataagcgccaagaattcgtcaccgccatatcggcagataatgtcatcttgccggtagatgtgccgaagttgggatgcgacctcgcggatccagaaatcgccgaccgtgtgtccgtatgtgtcgttgatggttttgaaatcgtcgatgtcgacgaacattagcatcgcttcgtcgtgcgaacccatgcggtcgaaatatttgcgcatgtgtttccatcccgcttccttgttcagcaaaccggtcatgccgtcatgttcggcttcgtaccgtgctttttcgtaggcggcctgttgcgagtggaatcgcatgttcatttccacggtgtccatgacgaacataatctgtgtggaaatcacgatcgccaaacattgcaatgaaaaactgtatgccagtgcttggtagatggtcgccaatactggtagcacgaagaacgacatcatggaaaggaaaataatgcgatcaagattcttgcgatatgagatcaacatgaagaggcataatgcgattcccaagaccgcaattgcctgcgaaagaagatagaaattaccgcgatggtaaagattgtggtcatcgaaatagtagaaaagaccagtgaattgtgtgatgataagtaagagaattccaattacggataatgcgtagacagcacgcaatgcggctggtttgcgatgctgatgtttgctcactgtcaaccaaacataggttgcgaagaaactcatgaaaacatagttgatgcagaatactgagaaattgcttatgcgaaccatatagtatgcggtttcgtctgcatctacgcgaaaataccagctgagcgcgtcggttccaagaagaagcatgcaggcgatctgcatgagtattttgatgcgagttcgtctggttttgtgtggtgttgcaatgaaaattccgcctgcgcaaatcaggcatatgaaaataccccacaactccatgcagatgtggaacatggccctgaccgtcattatcctccacccccccctttcgacgctgcctgcgtcgaaaacttgcctacctctttcgtgtgccatgatacctctaaataggggagcgttaccccgaaatgacaaaaacaggaatccgcaggcgaatatccatgcctctgtcatacgggctatcatatagtttgtgcgtttgaatgtggagaaggtgattgatgtcagcgaagcggaacatgtcccgagcgcttactcgagaggaatcatatcagaacggtcatttaacgcgcacggcgtttatttccattgcgattcttacatttattacgttcgtcggtaatttcacgcaattgcagttgagcgccgcgttgccgacgatcgtcagtgattttggtatttccgttacgaccggtcagtggctgacgtcgattttccagctggtcatgggcgtgatggtgccgcttacggcataccttacgagacgtttttcgacgcgcgaaatcgtgcttgtttccatggttgtgttcacgatcggttcactgttcgcttggcttggtccaacttttttgatggtgctgatcgggcgtttgcttgaggcggttggcacgggtgtgatgtggccggtgttgcagatcacggtgttttcgatttatccgctgtctcgccgtggtttcgcaatgggtacggttggcatggcgatgagcgtggctccggcgatcggcccgacgcttggcggtgtgcagacggacttgaacggttggcgttcaattttcctcacgttgaccattatcggcgtaatttcgctgcttcttgcctattttggattgcataatttcggtgagaacgataaaaccgcgaaggctgactttttttccgttggactgtctattttcggtttcggcgggctaatgttcggctttacgaatattgaatcgtattcgtttgtaaatcctatggtttggctgccaatggtgattggcgttgtgggaattatttggtttgtgctccgccagattcatggcgcgcgcaggcagattgaaaatcctgaagcgcagccgccactgttgaatttgagcgtgttgaagaatcgtagttttactgttggcacgatcacggccgcgctctcgttcttcgcgttcagttcgattatggtgatcatgcccctgtacattcaggattgccgtggctattctgctgcgattagcggcttggtgatgcttccgggtgctttgggccagtgcatttcgcagtttttcggtggtaaggtgcttgaccgtttcggcgcacgtccggtggcgttgataggcacgattaccttgtgtttcggcacggtcatgatgagtttgatttccatgacttcgtggatttggtgggtgtcgatttggcagtttgtgcgccagatcggcatgggtttcgtgttgatgccgatcaccacatggtcactgaattgtttggaaccggaagaggtgagcgccggatccgcggtgacgaatacggttcgtcagattgcgggcgcgattggcgctccggtgttggtgattttgatggagacgttcacgtctcttcgttggactgcgcttggtggcacaaaagccgtgtatgcggctgccaacgtgttcggcattcagtgggcgcttcgtatcagtgcagcaatctgcttcgtgatggtgctgatggtgttcttcggcgtgcgcggccagggtgccggttccacgcatgaaaccgtgcaacgcgccctcaaccgtaggcgtgccgcctgaccgtgcatgctgcgacggctactcctcttcgttgggcttgtattccactacgctgagggccaccacgcctgcgctggtgtgcacgaacacattggcgctcccgcctacggcttccaagccttccaccaagtgtgagatcggctcggaatcgagcactggcagcacttgcgccacgccgtctgcgtcggtgacggtgagcgtatcgtccaaatatccggaggcgagcgtttcgtcgatggcgctttcgaattcggccagcttgctgatttcctcttcggcggccttgtttgcggccacttccacagcttgcgccacttcttctcgcattgcctcttcgctcatgactacctcttttgttaagcgccgttttgtaacctatagattatcggatgaacgtatcagaacgattccaaatgccggaaagtgtccatatagtggcgcttttgtgaaagcgtcaccctcaatgcgcgcgggaaacatatgcggggatgaacgcgggtagcgttcacgagaagagatgttgtgagagatgttgtgaaaaacgatgcgtaagactatcggttgcaacatgtgattgcatacgattgcggattgcgctgaacaggaagatgaaacgggaatatggaacaggaaaggagcgcgcatgactcgacttggcgatgtccaacgaagtgagacgcgtcgtgaaacgcgcacttcactgcttacggcgttgctgtggttcgcatccgccgtcatcgtgttcgcgatgcttctgcgcatgctgccgaacagtctcgatggtaaacgctacgtgcctctgatcgtcgcgctcatgccttggcttggcttgctttccgtgattatcgcaattattgcaacagtttttcgcactgtcggcaaacgaaaacttttagtcgcgttgagcgtattgtgcgtgatcatccagattatttggcattgggggtatgtcgttccgaccaatgatcgtgccatgcaaccttctgcaacagtgcgtgtcatgacgttcaatacgaagcaaggttgtgccgatgcgcagcaaatcgtgcaaacaatccaaagcgagcatgttgaaattcttgcaatgcaggaagtttcatcaggattattagatcggttgcatgatgctggaattgaggattatcttccgtattccgtttccgcgcaactcacttggcacgataatggcggtgtgaacgtactgtacagtgcgcatcctctgcagaaaacaacacaagatctcattcctattgaatccagtagtattcctgccgcgacagttgatttcaatggcagaaaagtacgatttggatctgttcatccgttttctccacgaccaagcaatcagggattatggaataaaagtttggattccatagcgcaattacagcattacgataatggggaatcgtatgtgctgatgggggattttaattccacgtgggatcatgcaagcttcagatatttgttgggcgatcgctttacggatgcgggagagagtgccggcgagggattgcatatgacgtatccttcggtattccctatcgctgaaatcgaccatatcatctacgacaagggtgtgtacgccagaaatttggaaaccaagcggattcaaggttccgaccacaaggcattattggcgacgttggaacttcagtaatgctgccgtcgcgggtcatgcttgagttgtagcaatactggtttgcaggtcacgtttaggttgcatcagttcttgcgttaccggcaacagttgggcagtaataccgccgttattgccccgtttttgctccgtaggtttcatcgactccccctactattacactggggaatccgaagtgcttgcaaacaattagggagcgaaacggaatatgaacggcgcgtctgatcagcctgaagaattcggcgtccagcctgagcaaggccgtcaggaggagccgcagtctaatgccgattcagccgccgacgcaaccgccagtccagaagattccacttccagcgccccgcattcccgccgcgtgcgccgccgtatgagcgccgagcatattcgccaaatcaagcgcaaacgtcgccgtcgcaagatcctaatcggcgtactcgtgatagtcgcagccctcgccgttttcgccggcgcattcgtatggtctgcgctgcacgtgaaaaacgagctgcagcaggcggtgtcgagtgctcaaggcttgcagcagaccatctccgaagcggacacgtccaagcttgagaagcagacaaccgcgttctccgatcacgtaagcaaggcctacaagcaaacctcttcgccgctgtggcaggtggcgtcggtcgtgccgtatgtgggcaatgacatttccgccgtacgcaccacggtggccgccatggagaatatttcgtcgcaggcgttgccgcaactggtgaaagtcgccgaaaatgttgatctgaacagtattcatgtggaaaacggcacgatcgaaatttccggattggaagcgtctcagcagccgctccaaatcgcggacgatacgatcgacaaggccacgcgggaagtgaaaaccgtgaaaaccccgcatatcgcgcaggtcgcggacgccctgaaaaccgcggaaacgtattgcgaaaaacttgacagcatggtgcattccttgaattccatcgtgcaggtgctgcccagcatgttgggtacggaaagccatgcgaatgatgctccgcgcaattatttgattcttgcgcaaacgaatgcggaggcgcgcccgtccggcggccttacgggatcgctcggcctggtcacggtgcagggtggtcacgtgaacttgcagccgttcgtttccgattcggaaattcagaatgccgatgagccggttgtggatttgaccgccgaggaacgtttgctgtttaccgacaagcttggcaaggatattcgcgacgtgaatttcacgcctgattttccgcgcaccggcgagattgtgagcgccatgtggaatcgccagtatggcgttgcggttgatggtgtgatcgccattgatccgctgttcctgcagaacatgctggcggtgaccggtggcgttgccatgcctgacggttcgacgttggatggcactaataccgcccaaacgttgctgcatgacgtgtatgcgcgcatggctccgcaggagacggacgagtatttcgcggttgccgcgcaggccgcgttcgaccatatcatgcagaatgcgggcgatttcaaatcgtatgtcaaggcgctttccacgtctgttgagcagggacacgtgatggtgtggagcgcgcatgaggatgagcagaatctgattgccgattccgctatttccggcaaattgattacggaaggtgcgaaaccgcaggtcggcgtgtatatttccgacgaaaccgagtcgaaaatggactggtatttgcatcgcgaagtgaccactgaattccagaaggtcgcgcgaaacggcgcgaaccagtatacggtgcatatcaagttgcagaacaccataacggcggaagaagcggcttccgaagctgactatgtgaccggtgccggaaatatcgttccgaaaggccagatcaagacggcattgttcatttacgcgcctgcgaacggtcgtttggtggattgggaattccagaatgccgacgattacaagggtgtgactttgcacgatggcctgaccgtgggcgtgggcgatgtgaccttgcagcccggcgaatcctatgagatcaccgtgcatgtgcagtccgctccagatacggatgagccgctcaccctccgccagaccccgctgattgaaggccgctagacagttccgtaggtaacctaagcagctaagcaagcggctctagacaagccatcttgcaacaggggagtatgggggaatatgtgggtatatgcgcatgtagcctcacgttcacggaacggacgtcaacttttcatccgttcttgccgcgcgtttcgcggtatcgcgtcaaaagcaagtttccaatagtcatttaaccgcaaaagcgagttggagatctactctgttaacagggcttatgatactatctcttcatggagggaagcccccttcttttcgggtgggggtagttagtagagggaggagtcatgcaaggcggtttccgcagctctgagcagggttcggatcaagtagtgagaacccaggaaatccatatcgtctcttctaactctcgtcaccaggatcagaagcaggagcgacatcagtctcaagacaacagccctcagtttgagccgatgatgttttcgaacacgccattttccgttggtgaagatggaaagcgcaagggcaggcggaatcaggttgtgcccgcatggcgttattcttttgtcgtctgcttggtgatggtcgatcttgcggtcatgctgatttcgctatccatcagtctttgggccaacgatgccgcatataatgccatcaatggggccatgccgttctggctgttcctcatctgcttcagcctcatctgggtgttgagcctcacctttgccggaacgtatcatcgccatgtgatggcggaaggctacgagctgtatgcgaaaatcatcaacgcgtcgctgctcaccatcatcacttactgctcgcttgcttttattttcaatctttccttgccgagaaccgcgcttatcgtcgccccgatcattgcattcttcctagaagtcatcgcccgttggcagatgcgtcagtggcagcatcgcagccgtcagaagggcgcctgtaagtataagaccgtggtgattggttcttccgacggtatcaattgtgcgttgcgcaccatgcgggactactccaattgggggtattcgccgattgccgtgtgcccgatcgaagctgacgacaatgagaaagacgcttatgtggtcacgtcgttcgagcctgatccttccattgaaggtgccgacaagctgaaggtgattccgttcaatgccgctttcccgcgtacgtgcgaaagcttgggtgcgcaggaagtgtatgttgccgacgtgctgtcccgcgattccgaaatgctgcatggcatttcccttgcggtcgagtcgcttggcatggagcttgcgttggctgtttccttggctgacgtgagcggccaccgcctgtacttgcgtaatacggccgaacagcctgtattgctggcaagtttgccgcagtatacgaatacgacgtacgtgattaaacgcctgctggatatcgtcggttcggctttcgcgctgctgatttcctcgccgctgatgctgggcacggcgattgccatcaagcttgatgacggtggtccgattttcttctcgcagcagcgtatcggtttgcatggcaagccatttaccatgtataaattccgttccatggttaccaatgcggaagaattgaagaagaagcttgccgaagaaaatggacagaccgatcgtttcattttcaaaatgaaggatgatccgagaattacgaaggtcggtcgttttattcgtaagacttcgttggatgaattcccacagttcttcaacgttttgaagggcgacatgtctttggttggtcctcgcccggcattgccggaagaggttgcccgctacggttccctttattccacgcgactgctggttaagcctggtattaccggtccgtggcaggtttctggccgttcggatctttcgcaggagcagagcgaatatttggacgtttcctatatcgaaaattggtctattgcaggcgatcttgcgattctcgcaaaaaccgtgctcgtggtcttccgcggcgccggatcttactaaattccgcagtacttttcgcacgaatcgtcgtgcaaatcagagcgctccctcccggagcgctctttttgtgtttcctgacttgtgcaggcgggaaatgtgtttttgtgtggttgcgacctcgcttgtttgattgtgggctcgcttgtttcttgatgggaaacaattattcgtcatatgtatatttttgcagttattgggatacgtttattcgtgtgaggaatattgtgatactcatgtgaaacagattcaacttgtataatcatatccaccatagctaagtattgccttttgatatagctcatatgagatttggattttcaaaataggtaaatttgctttctcttgcgtattatgtgataattaatgtaacgtggcgccatgatttctgtaacgttatccctcacagctgagggtggtcccacgcacttcggtgcggattgaaatatgcaacagaacctataaaaggaaataatcatgcgtagtcatgggaagcgggcgaatgtgtgcccgcgaacgcaaggtaagtatttggtttcgacggtgctgaccgctgttttcgcgctcgtaacgctgtctggaacgctgctgttctctacgggtgcggttgccgttgccgccgaatctcaggcggtcgcgcaagtgggcaacgcaacctacgcgagcgtacaggaggcaatcggtcgaacaacgttgaagaacacgacggtcacattgctagccgacgtgacggaaagcgttacgattacgccaccgaaaggcgtgcgaaacgtaacgtttgacctgaacgggcatacgctgcaagccgctgaatccggtggaacttctggggttgctgcgatcactgtgcctgcgaacatgcagctcgccattgtcggcccgggaacggttgcgggcggaacacagcctgcggtcgattgccgtggcgcattgcacgtggagggtggcacgttcacctcggatgcaacgttgatgcggtttgccgaaacggatgaaacttccgcgcaaggcagtttttcgggcggaacattcaccgcgccgacgcttttcaacctgctggatgacgctaaaaatcttggctatgtgaccgttcgcggcggcgaataccggggtatgattccagctggactgaacacgctcgtcttgttgagcggctcgttctccgactcgtcgaatcttgcgccgtacttggctgactcgcttgggctgattccagatggcactagcggtgacggtacgggtgatggaatgttccatgtcggcgatctggtgatctccagcaagcagactttggttgaattgaatccggcgagcggccttcagcggctgagtgctgacgacctactaaccttgacgggaacgcaactgaacggcatcgctgattaccgtcttgtgatggatagtgaccagttgcaggcgttgaacgatcagatcgatcacgcaatgcaggcgatggagaagaggaaagccttcgaaaccgtgagccagaacatcaccatcaccgccgtgcgcaacacgtcggatgatgactttacggacgcaaacgcggcccgttcttccggaatgccgaatggagcttcctcgcgtggcagtgccaatgcgagtgggggagcaggtatgcaattgcgcacttccgaccacgatggcataagcgcccaagtgacggtaaccatcaaagccgtcgccgagccagaagagccagaagaacctggcaaacccagcaatccagaaaagccagagaagccggaaatgcctcgctccggatccgcagtccaggcgctcgccatcatctcgctgctgctggtgatcgcttccgcaatctgcgcatacgcaacggtccatctgcggtcgtcgcgtctgcacaactagtattttccgtccttttctcgggttgtgcagacatggaacgcgacttgtgtggacggactatggttggccgcacaagtcgcgttcgaatcttgacattgacattgttccgcaggaaagcgctccctacgatgatctagttatgagtgtttcggctgtgtgcgatgggagatgtattgcacggagcaaagagtttttcatcaatgtggagtgagattgggcagtgcggaactgtttggacgcttactatgtgaaacacgccgaagtcgaaaaacagccatttttcgtataaattaaccatttgtgataaagctgggcggtgtccagttcgcaaaggtcgtctttcttcttggaaagacgacctttgtgctttgattggagtcttcatgcataaaccttttaccacgatcgaagatcaaatcgctcttctcaattcacgaggacttcaaacggattctaggacatcatggattcttgagcgcgaaggatattacgcgactgtcaatggatacaaaaaaccgtttctcgataatcaagcgcgaaaaaagatgaagaagacaaatatcgcgaaggatcctcatacaatgacttgtataagctgtacctgtttgataggcagctccgttttctccttttcggaatgatcacgattgctgaggcgattctgaaaacagtctgcgcatacgaattcaccaaggcaaatccggctgagaagaacccctaccttaatatcgacaattatgctcgtaccggccaagctcatgaaaaggcaagtcagctcattccgcgattgcaaaagatacttactgacaacagtgattgcgagagaaaaggcagaaaagaatatctcgttcattgcctcaatgagcacgatggagaggtgccgttgtgggttttgaccaatgatctaactttgggacaaatatattggttctttcagtctcaaaatatattgattcgcggttcaattgctaggagtttcacagttctgtatggagattcgcacaggcataagacggaaatcgatgcacaacgtatcgataagatatatcgcagaatgaaagattttcgtaatatttgcgcgcacgatgaacgtctttattgtgcgcatccgcatgattccaacaatacggttttccagcttgttaaggatttacgtttcgtaatcgacaaaaaacgttatctggaattcctccagcaatttaattctttgctcatgcatttaggtgaagacatacctgcgtacgtcgactctgtttaccgggagatgggcttggatttcccgcgtgagcttcacgaatggatggaactcgcacggacgagctgagaaacgcgtcatgcttattgtgagctttggattctgtatgccttttacttgccgatatgtttgacgtcgattgcatcgtttgcgctccttaagaagaaggtggatagccataatggctacccacctttggtggtgcgtgttgtggtttcttgcttccgtgccggtccatatgcaagcgagatacggaagcaaaccagagtttttcccgtatgatctggacgttagctgttgtctacatgtgtggggtgtttgcttggttattttcgtctctgatttttccatagattgctgttgtaagatcgaggttcgtatccgtcgtcgatgcggcctgcgggcctgtcgatggccgtaggccagcttcataacttggtcttttcggacgggtataattgggggtattggaaaagataagagaaaacgaagggaaagatgattataggctcaaagaccacggcctcccataaggccgtcccgccgacccgaatttcaaattggggggggcgtaattccagcatagaactgctgcgcatcgttgcaatgttcatgattcttgcccaccatttcgtcgtccataacggctatgacgtcaagaatctttcactgggacctgagaggactttctttcagctcgtcatgcagggtggtggcaaagtgggcgtcgtcatcttcttcaccatctccgcgtggttcttcctcgacaagaaacagaccatcaaatcgaacctcaagcgcatatggattttggaacgcgaagtgctgttctggagcgctcatggcattctttctggttttcgaccgtgctgacttcggtatgaaaacgatcgttcgcagcgtcgcgccgaccattatgggaatgtggtggtatgttaccgcatacgccaccttcctcgccctgctgccgttcctttccaagggactacgcgcgctcggcgaacacatgcattacgcgcttgccataacggtgctggcgatctggggactgacaagcttcattcccggaacttctggagtgaacgatagcgtgttcggcttcatctacctattcatcctcatctccgcgtacaagtggtacatgaagccgttcacactcaaacagacttggctgatgaccggaatcggactgggattcttcctcttgtacacatgcgcttccgttatgttatcgttgttcggaatcgataagggcatcttcatcgccggatcgttcaagctgcccgtcatcatggtgggcttcgacatgtttctactgttcgaccggctttccttccgcagccggatcatcaaccgcatagcccggtccgcattcgcggtttacctgatcaccgattatcccgccacgagaacattgctttggaagcacctgttcgtgctggagaacctttatcagcagcctttcgccattctgcaaatcctcggcatcctgttgacgatctatttagtgtctgcactctgattgacttcatgcgtcaaggactgtttgcggtgaccgtaagctgtaaccgtggccgctggttcgaactggtgtgggacggagtcgaaaggcaaattaaacatctgcaggaagggcgaacgcttagctgagcttgctagttggtgtcagtgcggcagatcatctgttaccactgacgccaccattgcggatgaatgcaattaatgggcaaagcgaaatcgagatgccgacttcttacaggtatcacaacgacaaagcgacgttccatcgcaactatgatgccaaccgcaaatgttctcccatcatgcccttgccttgccttgcgaagccagattgtgacgggaactgccgattaacacgggagcaaacttgcccataatgagatgaacagtaacgcagatagctacagtgacaacagtcaccagcatcgcatatacaagattcgctcgcaatgcatctgtattcatcccaagaattttcgccataacaaaaatcagcactcgtttcaccggttcatgcacgcacatgatggtaagcgacgccctgccaaggaactgcagcagccggcagtcgatagcaacgcaaagcatgagcgacgatataaaaccaagcaatgctgcacatagcatccaaaatggattgctggtacttgcgtcattgaggttgacgcttagtccggtcaactcatcgaataccctcagcaggccaagtcctgccataccgatagcagcatagacagcatgcaacgatgccttcggcttggatttccgcatgcatggcatgagaaaacgactcagcaagtagccaatgcaatagaacagcatggagaaaggcaggatatcaagagcccaaggaaggcggagccgatcaatcggcagatcgaaggaatgcatggcaatgattgagagaaagctgaccgtggcaagcgtcgcggcaacagcccaatcataccggatcgctctctttgatttgacgaaggtaaagattccaaggaacaacatctccgtgacaaacagacaaggcaggaaccaaagcgccgcattctgcgggtaattatcgctacctgcgcgagcgagaacaatatttgccagcgcattcggaacagatccttcgtctcccctgagacgtcgctcgataagagcccaatacgcaagagtcaccgttccgaagaacacgtatggcacgagtagccttatcgctttcctcttgaatgaatccagaaactgcctttcgtgaaacagcattcctgaaatgatgaagaacaatggcatatggaatgaaaaaatccacgacaccagaccagcagaccatgatgtgtgtcccaaaacaactagtagtatgccgaagcctcgtagcgaatcgagtgcagccagcctagaactttatgccatagtataatctcctcatttactttcttttctttacaaaacacaatacatcattatccaagcattattcaaaaacttcgttgaggcaaaatcccatactgtaattaaactccccgcttctcaatctaaaagcatcgcaaccaacagtcacattaacttatcatatagcgaaatggtatggtaaaataccatttccattaactgccaatgtgtgtaggaacatgaaaaaacaaaaagataaatataatatctttataagcattttatttttttctgtaatatagtattcaatatagtacggtatgctaagaaaattaagcaaataaaacaatgcagaaactctctgacctagtggtataaacaggccaatcataatagctatggatcctatgaaatgtaaatttctaaaaatattaaaccaatgatcatcctctttagattccgtaaacaaataaacaaagaagaaacctacaaatagtaaagatgataatgaaaatgctttgctgggatctggccagtagccggatatataattctcatactttgtccctttgagcaaaatgccaataactgcaacgaaagtaggtacgagaacagccgaagcgaaaaaaagggacaaatatatttttttgtcaagctttagatagaggagagtgataacaacaaaataaattagagcggaatagtgaaaacctaccgctatcgcaaccaagaaaaaagctgcaaaaagactctgtaatcgttttttgccatccatatttctttcaacaaacaataatgcacaacagaatagtgcggtagctattgtctggcgaaccacattaaatgagtataagaaatacccaccacacaaaaaagaaacagtcagtagaactttcgaacatggcatattatatataacaatatatattaaacctatgaatataaagcttgtaataataaatatagactgataccaactacctgcaaaatcaatgcatagcttgttaagccatagaaatattggctccattggtggaggtgtgccattatatatctgtttataagttggaacatatgtaaaaaaataatctgttccaactccatatcggaatccagatattgtaaataaaatcaaaaaaacaatagcaaaaggtaaaacctctgcttttttatttaatttatctgcaacacataccaaaagtatgcagcagaaaacagatgttatataaataaacattcttttccttattttgatgttttatattcacaaaaaggggttttgttcaagaaaattcatcccatagaacaaacagcatagccagttgatcaaatacgactaacgcttcataaaccattgccatacatgtctaaagacatccgcccttgagacatgtatggcagaccagacgcaaacagagctccgtaagccacggccaatccgcgaaacctcttcatcatcaataaagttcggtttggatgacgaagaattacatatgcagtaagtagcaaattcagcgttaatggcaatccggcaacttgcgctccagctttgggcaatgatgtggtgacgaaaacatagagtgcgtccatggaagactccttgctgattatgcgactgtatctgatcgcgcagatgcaagtacgcgaacgggaatatcagtctgtggttactgcaagaccgaggtaatatctgagccttggaatcgagtggaccgacaggtacgtgtttcgtccaagaaatgtccaacttcgatatacatgacgggtacttcgttatcaggcaaatgcaaaagtttgcgggttttcttttctgcagttgccgtaaacatggtattgagcggacaagctccaattcccaaagattccaaagataatagtagtgacattccgaacaggccaccgtcggtatatccctcattgcgctcatacgatgtcataaacgcacgcaagtcagaagtaaccatcagcaatgcgggaggggctggatatccattaacaccaccttgaatgtgcaaagcctctgcgatgacttccttgtcgagaatgacatgcaccctggtgggttgcctgttacacactgatggagtgcgcatggccatctgaattgcctggttaagttcgtctagggacaccggctcatcagcaaattcacgaactgaatgtctattttcacttaacgcagcaaaggaaagatctttgttattgaacttgtcacttttacggatagatatgcttccaccatcgtttgattcggcattcataatgcgttgccactgatctgcagtgaataacgattgctgccaagaaatatctttctccgcatcgagatgacgctgcatgtactcatgaagcgcagcaagactttctttgtacacagtgttattagcgaaattcagatctgcttgttccagacgcgtaagcagggtcggaagctcgttaaaaacttttttcccaaacccatagcgaaaattgtgatggctcagacccttttcaatttgatggctgagaaacatcactcgtgtctcgattcttactcgttcatggggcataatgcgagagtagctacgattaaaccgcttggcttgtgcccacgaatcttgatatagatgaatgctttgacgcagattcttgagaggagcgataagcggttttggcatccactgttctacagtgctcttccaattcataatgacattcctttggactcttgattaatgttgatttagtggttccgatacgctgctatgcaaataagctaatgactgtttacgtaatgaagcgagtagagtattcggctgcgtatagtcgatgtggttgctcagcagatcgccactggtaacatgtctgtcttttaacgccagcgaatccagcaggtcgagcatgcgtgaatttgtggtctgcttaactgtaaagaagtggaatggtttgttgtacacaatagagaacacagtgccatggaatgaatttgtcaccacggctttcgcattgcgaatcaggttcacaaaagtgttaggggaagcattccaaaaataacggtcctgatcaagtgtgtaatcttcgatggcagtaccgatggtatagactttcacgcctagcttcttggcaagccgacgtgcataagcgtatacatctttctggcggttatagccatacaccagtacgtaatcttcagtaggagtgaaatcgctggcatcggcgattacgttccaatcatccttctcaagcagaaatactgggtcaatgacggattgaacattactaatgccgagatcttcaagcatgggcaccgacgacggttcgcgcacagacacggcatcgaaatcggaaatcagtctacgataacgatccttctgatcgtcaggaatttcaggcatggcaatgctggcagcatacgctactttgcgagcgcccgcaggcgcaaatgacaggaagaacgcatcatctttaccattaagcttgttcttacagttccaaatttggtcgctgccacaaatatagacgtcggattggggggtgtcagcctcaatctcggcaagcgtacggtaagttttggcgctcataggtatgtagtcctcaaggaatttgccgaacactttgcgccccttgaccaaatcagggaagcgtacgatggcgcgaagcatgcgaataggcagcggccgcgtagacgtgtagtagtatttggggttgtaatccagcaccttggcgtccacacccatcttgcgtagagcggtgttcaagccgtaagtttgcagaacagcgccataattagttggtctgctgcaggtaatggtgtaagaagtaattgagtctttcatagaagcctctttctctgtgctagctgttaagaatttgattcaacgtatttgaggaatgcctcatagctgctaaacataggttcgctttgaacaaacgcttgctgtgaacgttcggtattgttatcaagctggaaaaccttttggaatacctcatccagctgagtgttcctaggctcaaacagccagaagaattcccgaagtagcttttttggcggccgctttccatatgtctgctcgtactcacgtactaataacacggcttcatttaattgaagtttgcggcgtttgtcgatatacgcttccaaggaagagattttctttgccggagcaccggcatatacagcgttcccatccaaacggcctgtcaccacgctgccagctccgatgatggtgttgtctccgatctcagctcctttgagaatcaacgacttctgaccgacaaaaacattattgccaatacgaaccgttccgcatgatcccagcacttcacccgtaaggcgttgtattactgcccagctatagtcatgctgcaaaatagagcaatctgcggtgatatgtacgttatcgccgatttcaatcatccaaggtctctgagtatcgattctgatggaccatggcgtatatagatgcacatgctgtcccacgtgtactccctggcttcggagccatgatatgtattgctccgatgaagccttgtggccataaactaaccgcatcgcaagttgtttaatgctcatttttcacttgctccgttccggatgaatacgtttatgaagtaagaaaaacacgccataaagcgttggagagatggccatgagtttgagctgcaggcgacgcccacgagggagcgtcacggattcagtaacagctttcatgttttgattgacgaaagtgcgagtgtcttctgcgaaatctcgccattgctgttctttagcatgccccgtgacaagagcctgatcataaaggctcaccatacttctcatttgtccatacaacgcaaaaggaagctgttcggggaatttttgatgtaccagtttcaccatgtttttggtagcttcgtaaccagcaaaattgaaatttgtgctcgtgttagaaaggcttcccgcaacttgtcgataatggtactgcggcgttgaatcaaaagtagttcgtacgctcgctgcaagtatatcgtaggtgaattgccaatcttcgccagtgcacccttccgggaaacgaatatttcctagagtggaacgtttgatgagcttgctccaagcagagattgtcgaataacctggcagattaatgtatttaaaggattccgaagtggtcattaccagatgtaaatcaggatgataaagatatatttgtcgtccgttaggatattccaagacaccggtgatcatggaggtatcagcgttttctttggtgagagaacgatataggacttcatacatagtcggttctaaccaatcatcagaatcaacgaaaccgataagctctccggtgctgattctgattccgctatttcgagcggcacctaatcctcggttctcctgatgaatgacacggatcctgcaatctcttgccgcccaagcatcacacatatcagggcaagcgtccggagagccatcatcgaccagaatgatttccaaatttcgatacgtctggtcgacgattgactgtatacaacggtcaagatagcgctcaaccttgtacacaggaacaatcactgaaatcagggggagatcttcagttcgggttttctcaggcatggcagatggattagtactcatgctgtgtacttcctccttgtgaatatcagagtaataagaggcttaagttcataacattgcacgaatgcaataagcaacagacaaatcgatgaccagaatagataatggttacattgattcgaggttaccaaggactggacagtaagcagcgtcatggtaatggccgtaggaatcggcctcatattgatggccatcagacgacgcacatcaatcacacgaaccacgaaaatcaccaagctaccgacaaacacgccgaatgcagcagctgaaataccccagtcatgtacgaggacagcggtaaatgcgaggcatgctacggctcccacaactgttgccacaagtaacggctttgtacgcatataagcctgataaatcgtgccaagaaagttgttgatagcactaagataaaaggcaagcacaagaatggatataagaggccatgccgagtaaaactggcgctgcataagcaccctagcgatgaacggagagagtgtgattaccaatgcgcttcctaccgacatcagggcatggtacacacgccagattacatcatagaaatgcttgagcccagagctcttaaactcttggaacgcggaaagctgccaagcctgttgaacaatctgttgaagcacattcagcaaattaggaatctttgaagctgcagcatacaaaccagaagcggaaatacccagtacacctgtaataatgaaacgactaaccgtcgtctgaatctggttgcacaatgaattcggagccaatggcagcgagtagcgccaaagctgcttacgaagagacgcgttgtttcgccatactgtaaaatcgataaattgatactgcttaccggcgaaaagatataccaggatcgctgaaccattgcctacgatataagagtagaaataccccataagaccgagattcattccggcaatcaacgcataagcaagcgcgcccataataagcgcagacaatattgaggcgtaagcaatgagtttcatctgatccatagccctagcgacagtacccatcacagagggaaaacacaacgccgcataggacaacaagaaccaaattttatatctacctaatccaccaaaaataggcaaatcaaatactggcagaataattgccaaaagcacacagcttgccaacatgaccagcatggtttcggtaatataaaacgcggcttttgacttatcatcaagcgtaaaacggagcatgccctcgctgatgagcagagttagtacagggaataatgtggtcaccatgatggtagccatgtccatgatgccgtattcctctgtagataggtacagggtatacaacggcatcagtatgaatgccatcagtttggtggctactgcgctgagtccgaagatgccgacattgactagcagattcttgtacttacccacgtagtcacctcagacgaatggctaattgtgccatgtatgtttctttattgaattcggaacgtaatgctgtttcatgcgcgcccatggcatcacgttcgtcggagtctcgagcaatctttgtcatagcatcagcaagctggtcaacaagttgatcgccacgctcaaggatgatggctgactgcccatcggcgtattcggggatgcctccggaacgagtggtgatgagcggcttaccagaaaccaagctttcgattaccgcgaggggtgctggatcgtcccaaattgacggcaatacgcatatatcggccatggcataaatagctggcatatcttcgtaattcacaaagccagtgaagatgattcgatctttcacaacaggatttgaagctaaatcgcgaagtttctgttcaaatggactcacgatattcgaattaaagaagaaagctccggcaataaccagcttggtattgggaactttctgcgctacttcagtaaacgctttcaatagttcttcagcgcctttttccggagtaagacgcccggaaaacaggaaaacaatatcattctcggctatattgaatttctttcgaaattcaatcgccttgctattagcctcctccgaaccaaaccggcttgtgtcgacgccattacgccatacagctttctgatcttcgcgcagaccaggctcaccatgctctcttaaatacgtgtcaagcgtgccaacaatatatttggaaactccaagtacttttttgactttggaaatctctttaatgcagccgaaatcattaagaacttcgttatgcaggtggtaatacacttttcccgcatatcgctcggaattaccgtgcttctgcatggtcatgaacagcgtggcgtggttttcgatcattatcttgtcgaaagctgggccgccattctttgcgggctgtgcgagcttcttggaaaccttgttgatataccacaggcgttgcgcaatataccgatagctcatgagcttctttttgtggagcacatgcttggctgcccaataaatgcaacgatccgccgcgcgaactagcaatggcgtcttgataaagcagaaatcagtatgcttgaaattaccttcacccacgatctgatctacgccgggtgcccaagaagaaaaaacagtgaaatcaaaattcggagtcttctcattctcctgaaccatcatcatgtccaatgcttcgacagctccgccgagaacattcggtactggcaaatagcctgaagtgattacagcaacgcgaggattcacagcgtttcctcccatccattcgcgctttccgcactgcttacgtacagagaggtcagacgattcgcactggctgaaatgtcatatttttcagcacatgtgtttgatgtttcaatctgccgattcgctgtttgcgaggaaatgttgagtacagttgaaatccaagaagatttattttccaagcttatgaaagatgtttttctggaaatatcggcttcgtgcggaacctgatcgctgaggacacaggggcatccggcgacctgggcttcgatggcgaccatgccgagaccttcataacggctcggcagacagaaagcatcgaacgcctggtaaaggtggttgacgtccgtgcgctggcccaagaacagaatgtggtcaccaatgccgagttcttgggcgtgctgctgtacgtctggtctgtctggaccgtcaccaacgaacgcgagtatcgtgtccggcttctggggaaggagctcggcgagaacgtcgacaaggaaagcctgattcttctgcggcatgaaacgacccacatggccaatcaggaacataccatcggctatgccgagttccttgcgggtttcctggcgaaggactgggtcgaaatggaacttctccagttcgatggcgttgggaatcactgtgaagtcagcgtctctgccgaacagccattttccggcgtattcactgcatgcgaaacattctgtagggtaaaggttcgagagcggacgcagtgcaagcttcatcaggttcttggcaaactcgcccttgcccatcgtggaatgcgagtgggcgatacggaccggcactccagcctttttggccgcagacaatgggaatacgctgagcgtattgatgtggctgtgcacgatcggccagtgttcctcatggaaaagcctgaccaattccttgcggtagcgaaggggatgctggtatggagggatgcgaaaaacgcggccgcccaacgctttgatttcctcttctggaacgcgagtcgaatcggcatccaccaaaaaatcgaactgcactttgctacggtcgatatggcggtagtagttcatcactacggattcgacaccaccgccaagcatctttcccatgacctgggctacgcgaatcggcactggattaccgtcctcgaaccgggactaagccgacataacggccgttatcggctcttcttgcaatcgatcgacctgtggtcggcatgcgagtcccgtcctttccctccaaatgaaccccgaattggtgtttttcaagcgcaacgcgaaacgcgcaggaactgccaaaccccgttcattatctgccaaagtcgatttttacatccccctcagacacacccagccccccatcactcacttcgggggtattcttcacgggttttccatgaacactttgcttgttcgtgacttaaaaactgtgtttggaatctgcttcagtcggttttccggacgtttctaaatgagcgaaaagagccgataacggccgttacgtcggtttggctagtggtcagactgtgcaatccgctgccatgcataacgcttgtggcattatcccggcattctgaataactaagggcgaccggtgatggttagtatcgtgatgataggtcataagcgcattccttcgcgtgaaggcggcatcgaaatcgttgtagatgaattagctacgcgtatggccgcaaaggggcatgatgttatcgcatacaatcgcaaggggcataatgttgcgggtgccgaatttgacggaaacgttcattccgcaaataagccctttgtatacaacggcgtgcgtgttgttccagtgccgactttcgaagcgaaaggtttggcggctctgacctcctcattcttcgcaacactgaaagccattgcggccaaaccggacgtcattcactatcatgccgaaggtccctgcgtcatgctgcgtctggcgcattgggccggcatccgcacggtggcgacgattcacggcctggactggcagcgcgccaagtggggcaaattcgcctccgcatatctcaagttcggagaacgtaccgcagtgaaatgcgcggatgaaatcatagtgctcagcgaaagcatgcggcagtattttcaagaaaaatatggtcgcggtacacatttcattcccaatggcattgaatatggtgagccggtttcggcgcaggaaattaccgaaaaatatggtcttcacaagaacgactatgtactgtttctcgggcgtattgttcccgagaaaggcgtgcattaccttatcgaggcgttcaacaagctgaatacgaacaaaaagcttgtcatcgctggaggcgcttccgactccaacgagtattaccagcatattcagcagatggctaatcaggattctcgtgttattttgaccggattcttacaagggcaggcgctcaaagagctctatagcaatgcttatatttatgtgctcccaagcgacttggagggcatgccgatgagtctgctggaagccatgagttacggtaactgttgccttacgtccgacattccggaatgtgtggaagtagtagaagggcacgcagcgacattccatcatggttctgttgaatccctgcggaaaaacttcaggaattgcttgaaaacgatgatcttgtacaacgttacaaggcaaatgccgcagattacatcgttggtaaatataactgggatgacgtcaccgatcagacactgaacctgtatgggggagagtgagcatgcgaattctcctagtgaacaaatatttctatcgtaaaggcggtgcggaaacctatttcttcgcgttagctgaaggattacgcgcgctcggtcatgaggttgcattcttttccatgcagcacccgaataacgagtcaagttattggagtaaatacttcgtttccgaaaaggactatgtgggggatatttccgctttcaagaaggttcaggaagcttccacactgatttactcttttgaagcgagacgtaagttcgaagctttgctagaggaattcaagccagatgtgatccacatgaacaatgtgcatcgccagctgacgctttcgattcttgatgcaccgtatttgaagaaacatcatgtgccggtggtgtatacggcgcatgactatattctgctatgcccggcctatacgatggtgaatggtaggggagaagtgtgcgatgcctgcttggataaacatttcatgcatgctgtgaagaacgcttgcgtgaaaggatcccgtgccaaaagcgcgctcgcttccatggaagcagggttcctgaaactgcatcatagttatgacaaaatcgatttgattattgctccgtctgagttcatgaaaagcaagcttgaagagggcggctttgctggcaaagtggttgctttacagaatttcctgaccgattcacaaatggaaatggctcgtaaggttgcgaatacgcataaattcgaggatgctgttgacggaaaacgaccatacttcctgttcttcgggcgactttccaaagaaaaaggaatcttgacgctggttcgagcctttttgaaggctgctgggctgacggctccttatgattctgctggaagtgacggtgctgtatgccgcgcgaccgaaagttctgaagctgcgaacgataaaactatccttccttcaaattgggatatccatattgttggcgatggaccagagcgtctcgagatagagcgtcttgtcgccgatgcaggatccgaagctgcttcacgtattcagcttctgggctacaaatctggcgaagatttgcaacgcgaggttggtaacgccaggtttagcgtgctgagctccgaatggcgtgagaacatgccgtactccggcttggaatccctggccgctcagacgccgatcatcggtgcatgcatcggcggcatccccgagctggtggttgaaggtgaaaccgggtttgcgttcaagtcgggcaatgtggatgatttgactaaaaccttcctcaaagcctcgctcgtgaacgaaatcaactatcaatccatgcagcaggcctgcgccaaatacgtggataagcgttgtctgcaggatcgatatatcaaacagctgcttgatatctatgaggcagcggcgaatggaataacaccaatggggaggtgagataccgaatgagtacgacatatgacttacgacatttacgcagaatacaagcagtatttggtagtcgaccacggaccgccaaaggttccaaagatatcttcatcacgctcacggtggcattctttcttcttacgtttgtgctcaaggcgctcactgatggcatctttgtgacacttggtcagaaaggtgccattacggattccaaatacctcaccatgggaggggctattttctttggcatatgctacatgggcaggtcacataagttcggaatgttttggagggaattcaagcagcttgtcatcgtggttcttgcctttgtgctggtgacatgtggacttgtgctttatcgaggagaatttgacagttggcaggttcgtgacattctgaacctgctgacgcccatgttgttcgcttatgtagtgctgaacaccattcccttcgaagcgcttcacaaatgcatgaaagtggtgttggtgtcatcgttcatcggttatatcatccagttattgcttcgtggtgtgacttgggctgatatttgggcttccagtttcgacaattccacctcggcgctggaatctaacgatttttcggcgctagcgatcatgttgtgcttctacttctgctactaccgcaaggacatgtcctgcactatcctatccgtggtctttgctgttgccacgttcaaaagattagccatcatattcgccattgtcattttggtgcttccgaaaatcgttgaccccaatcgccatttgcccaagagaagtggattgttctttaagatactgtttttcgccttggctatgggatacatgtacttgctatggcccactacagccgctgtgcgtgtgtttggtcaagattttgatgagatgaccatggggcgtgcggattttctgcgtgtacttatcgacagtgggttccaatcttttggatatggttcggtcgaagcgacgcttggatacagcctcgaaatgtgcttcattcgcatctcattggaactttcgcctctcgcaacattgttgttcatcaataactattggaatctgacgagaggaaatttctattgtgtgttgttgatagtcttccagttccttaatctcactaccgctgactccatcagtgcgatgttcgcatgggcggtagcttacattcttattggctctattcattatcgatatcagttggctaatgcaatgaacattgatggtgtcatatacgtcccctctagaagccggtagtaaaggaaagtaaaatgcgtgtttttatcactatttgtaccagtgattcttatgttcccggtgttcttgcgctcaatcgatcgttgaaagccgtggagtcacggtatccattgtatcttctgacaacatctcagctatctgataccagtctgactcaaataaagggcgagggtattgaggtgctatttgatgcccctataacgcctggagcatacgtacgtcatcagaatgagattaacggatctcctaattggaataatacttttttcaaactgcgcatatttggattgactcaattcgataagctcatatatcttgactcggatatgattgttgcggcaaacattgactacctgtttgacaaaccgcatatgtctgccgtggcagcgggtcgcggcttcaatccgacttggaggcaactcaattctggccttatggtcatcgagcccgataggcagatgatggatgatttgcttaagttggtcactgatgagcctgacccaggtatgctgaacgggcagggcatcggtgaccaagacatcatcaactggtattaccgcacatggcctgagaacgagtggctgcatcttcccgagacttataaccagttcgtcacccttatccccgagtatcttcgcagcggtctgcttgattcctttgcagatatcaaggtcatccatttcgttggcaaagtcaagccttgggcctataagtcgcgagaatacctgcatgcgttggctagagcagtacggtaccgcagtctcaaggagttccgagctatttcattgttcaaggagttgctgggatgagtgaagcgagcatgacagaggacaagagaagcatgcaacagttcgcaggggttgctgggaacagacactataacgatttggacgggttccgtgctatagctgccatagcaatcgtggtcatgcacgttcatgttcgtggcgaatacgtacatacatcaacttggttgagcaccgcagtggaaccgttgggtacgttcgtcacgctcttcttcatcatcagcggcttcggcatgtgttgcggatactacgaccgtgtgaaaaacggttcgatggacattgagcggttctactcgcgtcgaatcgctaagatactgccgtttttcgctcttctggtatgcattgacgtcgtagcggaaggattcagcccgaatgcgctttgggaggcatttgctgatgtgacgttgatgttcaatcttcttcctgacctcaatattcaggtcatcggcgttggctgggctttgggcgtcatttttctcttctatttcctattcccgttctttgtctttctcatgagcaccaagcgtcgggcctggggcacattcgtggcatccgtggtgttgagcttgtcctgcgtctttcatttcttcaagaccaacgggaatatcgatgaccgccggttcatctaccaattcatgttcttcgtcgctggtggattgttgttcctgtacaggcatcgcatagaatccttgaacagtgttgggcggagactggttcttcttgttgctgtggcggtgctgccgttgttgtacgtcgatgtgcctgcatgggcatccaatgtcaagcaattggtgttatggattccgtggatggtcttcgccatagctaaggaccacaaggtgtttagcaatccgctgacgaaattcttgagtggcatcagtatggaaatctatctttcgcatctgttcatcttccaagtgatcaggatatgtggtttggcctatgtgtcgtccgatggcaccgtctcctatgtcgtggcattggcgctgactttggcaggggttatggcgttcgccttgctggctcatcgatgcatcgcagtagccagtcggtttatcgcgacgagtcggcgtactggacaaccgcggggaaagcatggcgttgccgaaggagacgtacgatgaaagtgctgtttgtcaatccgatcatttacacaccggagaacgcgcatattccccaaatcgattccatcgatgacacgatgagttatgacttgtgcatggcattccaacggcatggagtggacatcaccttggctgcggccgaagaatggaagcctcggaaggaacgcgacttcccttttccgattctatggatgaaaagctcgtggaagcgggtctttccaattcatcgaataccggtcaacttgggtttgatcacctatctgcgtacgcatcgtttcgacatggtcatcaccagtgaggtgttctccatggacacgttgctctgtgtattgttcgcccgcgaaaaaaccgtgatctggcatgagatggccaaacacaacagaatgggtgggggtatgctgtcccgcttatggtatggcatcattccaaagctgttcatgcgtcaggtgcctgtggtggcgcgcagcgaacaggcccgttgtttcattgcgcagtattgtccccatgtatgtgacacagtcatcgaacatggcgtcgatctgaaggtttttccagccgcacagaggaaaaccaatacattttgcgtggtgtcgcagcttatcagacgcaagcgtgtcgaccggacgattcgtgctttcgcccaataccttgattcctttgatatgcagtgcgaattgaagatcatcggtgatggggatgaacgcgtcaatcttgaacgtttagtcaggcaacttggtatcgagcgttcggtgactttttacgggcaacttgatcatcggacgttgcaacgttatttgggagaagccaaggccatgctggtgagcacggagaaggacaacagcatgatttccattgtggagtctattgcaagcgctactcctgtgattaccacctcaataccgttgaatgcgagttatatcagattagagcggcttggcatagtcaaagacggttgggatgctgcggaacttgcacaagtggacaagcaccttgatgagtttgttggaaactgcatgcgatacagggaaagtatgtccactgatcataaggtggaacaattccttgatatttatcagaaaaggattttagtatgaataaaattgtggctgttgattgctacttatctcataatcttggcgacgatttatttttattcacattattgaaacgctatccgaatgttatgtttaatgtgaatgctgattgcagctatggatatcttactcatgattttaacaatgctaatttggtgataagtggtagtaactctgattcgggtagcttgcttttgaaaatgaaacgttattgttcaaatatttgcgagtacttaactgagctacataatgctgacgctttagtaactattggtggttcactatatatggagaatgaaaatagaacactgagagctgttgttgccgaaaagcgtcgttttttcagagataaaagaaacgcgcgaaaagcagccaaatattatgttttaggtgctaattttggtcctttttattcaaaaagatatttgtctttttataaaaaattcttttccaattattgtcaagatgtatgttttagggataggtattctgcgagtttattttctgatgtttcaaatgttcgatatgctccggatatcctatttaacgtagagttacctaaggttgttcgtcggaaaagctttttatttctgtggtggacttaaatcaagtaaataaatttaaaaatctatctaaaaaaaggctggcatatgatcagctgattatgaaatatattagaaaatatgaccatcttggatatgacattgttctatgctctttttctcgtcctgagggtgatgaatatgcagttcgtagattgatgcaatgtgccaaatcggaaagaatcgctgtacggacgctttattattggaataatatacaagaagttctcacggaacttgcatcttctaatatggtaattggaacaaggtttcatgctgttatccttggtcttcttgctggagccgaagttctaccaattatgtacagcaataagacaggttatgtccttgatgatttgggttttgatatggcgcatgccattgatcttaaatctgagaattggatgcattatggccataagctaccaaatcctattgcgtggaatgtctcctcatctgtagtggcttctgcggagcagttttctgctttagatacgtttttgggagaataataatgcaaaaaaaagagactatcaagagattgctgattagtataataattccggttttcaatactgaggaaaaatatcttcgtaagtgtttaaagccttttctccaaaattatgacccacgtattgaaattattcttgtagatgatgggtcagatgagcctacgcgcaagatattatgcgacttagcgtcgcaatgtcgtaatgagatacatgtgatatatcaagagaatggaggacagaacgcagctcggaatgcaggcattgaaatttcccaagcagaatatatcgagtttcttgatagcgatgactatattgtttgggaagaagaagtgaaaattctcgatacgttagaaaatcataatccggatattcttggaataaatacctcatatgttaccatggatggccatgtgattgctgaatggaattattcaaagaatggttctgcatttaatgtagttgacaagttcgaaatacttgggaagtgttcagctctttggcaacaaatcgtccgtagatctttattccataaagcaggcattaagcttttgcaaggaatctatatcggagaagatatcgcttcgataatgcctttggttatggctgctgatgaggtggcaacattaggttctgatgtatatcgatgtgtgtgccgaatgacaagtgttacacatgatgttcacccggatcgtttattggatattactaaggcatttaattttatattgaagtggatgaaattaaatggctgtttgaatcaatattatactattgttgaataccaagcaattgagcatgtacgttttgctggcattgtgagagctttagagtgggaaggtaccacagcaaatgcaattgtcaaattaatccattatatggatgttacatttcctgattggcgctcgaatattttttatattcaggattctgatatgcatggattaaaatataagcttattttatctgggaaatatcgtacttattctttttttagatgtgctaagcattttgcttttaaatttgcaaaaacagttaaataatattgtttttgcaggagatcttccataatgcatctaaataaaaggaaagaataataaggagttgcaaagaaaaagcatgggtaaatacaaagacctcatggtgaatacaggtttgtttgccttcacgcagatagcaacgaaacttatcactttttttctggtgccattatatacggcctatatgtctaccgcggatttcggtgtgacggacatgagctctacggtggtgagcatggtgttgcctctggccacattgtcggtctccgatggtgtactgcgctttgccatcgatgataagactaatcgcgatcgctatattagtcttggcttggttgtggttcttttcagtattattgtggtggcggttttatctccaatgctaagcttgtcatttttcggaggtttggatcggtatcgcgggttgtttattgcctcctatgcgctgtgtgctcttcaaactttttttaacatgctggctcgtgccttgaataaagtaaggataattccgatttcagccattgtcactactgctctcactgcgatatgtgctgtggtattcattgcccatatgggcttaggggcatctggttttttctactctttattagtcggcaatatgggtggtgtgttgtgtttcttctttgtcggaggtatgttccgacattttaagttgcactttgagaccaaagacatagcaattcttaagcgaatgcttatatattgcattcccatggttcccaatgcgcttttctggtgggtaagtagcaacattaatcgtttcttcatcactggcatgattggtataggtgtcacaggcttgttcgcggctgcacagaaaattcctggcttactaaccaccgcagctggcatttttcaacaggcatggcaactgtcttcgtttcaacagttccgtaaaacaaatatcgctaagtttttcagtacagtattccgcatttatcatgccggaatctccattgtggctacgataattgcagtgtgttcttcttggctggcatcctttctgttgcagaaagagttttatcaggcatggacgcttatccctattatggttgttgcgttctatttcaatgttcttaattcgtattatggaaccgtatatactgcgacacttaagacgaagagtctatttactacaaccatatggggtgcattgtgttgtgccggggctacatggatgcttataccgtgcttgggcgtcgctggtgcttgcatggggatggtcttatccaatttgttagtatttgtgctacgtgttttctcttcacgtaccattcttcggtttgaggtccaatggtcattggttattgcgacagcagtgcttttgacgattcaggctatggtcatttggctgcaaactccatatgggaatattgttgctattgctattgctattgccgtggtgatatgtgtgctgcaggtgttttctgttgctaaatatatagatgtctttatcggcagaattaagcatcatagtaagtaagaggataaatactatatagtgcattggcctatgacttatgattgatttgttatgtattgggcgtttttttgatggaaaataatggaattatatacaaatgcatatgtgggtaggtggtagtgcgcaacctttcgggcgctacccgtcgatctcggcgtacacgcgcttgagcttgtcgctcaatgtccgggacggcatgcggtcgccccacagcaactggccggtgtcgtctacctgcctggtggacgacaccggccgggtacatgccgatcagcgcctcctctacgctttccccgcgtctgcggtagcgttcgattaccgcggactcgaacagggcgcccttcaatttcggcaccttgagctcgagcctgccggccttggcggtcaggctccggtcgtagtggccggcccggtacgccttccgtccgccggaacgctcgtatctcgcggcgttggcgatctcgtccgcctgaagcgtcgggcatcgcgttcagcagctcggtgaccttctcgcgcaccatggcgtcgagcttgctctcgaacatggcctggtcgaactgtatgatttccttggacatggctccgtgcctctttccaatcgcggtttttcattgtctggcgactgaaaatcgtacccggcacggcccatgtccttttccatcaaggccggaatctgaaaatgtgcaagaattcggacgttatcttcatgactgcgatagaacgtgtggctgaatggctgaatcagtacgggaatgcggtcaatgctgtgtcgacgattattgcaactgtcatagcggtagtgggaattgttgtctcctgcagatctattggtgtcgctaacagagcgaataaaatagcccagggttctttcgattattcacgagagaaggatcggaaagaagaggaacgtgctcaggcggtgcttgtttcagcctgggcgacaccggacggtgacggctatctggcgaatgaggcggagaggaaaatagtcgtcaccgtgtgtaatggcagttttcaaccggtgtacaacgctgtaatttccatgggagccattcaaggtggtgctccagagctaattactggtgacgatgccgttcctattggtacgttgctgccaggaaaataccaggtcgaagtatccaagccgacacctggaatgtgcgcgaagttcaatgcttctttaggttttactgactctaaagggctttcgtgggctcgggacgccaaaggcaagctctttcaaattgatgagcacctctatgactatttcgagttgtcccttcccgtgggtgttttgggcgctctggcacctgttcacggcgactgagtgtttgtctgcccccagaagtttgagatctatcgtgtggtttgtcgcagattctcttggtgctgccgattctcaggtgcgtgttcaccagcgggacgcggattctgcgcagcgtgctcattcggtgagcaaggtgaagcggcgctcgattggggtaatcccatcagtggggtagtgtctgtcgtttctcactctgctcaaccatgcttgtcgcgaacttcacggattacggtctgtgcacggtggacggcgtcagcgcggcggtcaaacccggtgcggggcatatcgtttgccctgcccgcgatgccaggtatctgaggctcaagtggtactggttcttctctcccgccccggatgagggccatggcagctcttcctccctgttgttggtccatcttcggctttaattaagccgctgctcccaggcgggtcatggcttggtctgattctctcctcagcagggcgtgattgccttgtccgtgaataccctcttggtattgaacgcagacgagcgccgctacctgttcggcaagctaaagcagaagctggggtgatgaattgtgaggattggcttgtcgctatccgatagacttaggttgcaagacattacgctgatgcgtcttgtcagagccaaggatgtttctgtagggtctgttgagaggagcacagatgactgatatatatacgactgaactggttgctcttggtgcgaatctggcgcaaatggctgttaaaggtacggccactgccgtgtcagctaagattcgagcaataaaagatgagaagaatgctgagaaaatacgcaatacatatgacgagatagtcaatgagcttcttagcgagcgagaagaggccgttaggattgcacaggcgtataagtcggagctggagaaggtcgttatcagcgatgaagatattcagcatcttcataatacggttgcaaatattttgaagattatgacggatattcaaattgctggcgccgaaagggcaggagaagctgctgttgaggcagtgaaagaacaaaccaaagtatatgagcagtttatggaactgattagtgtggatacccttaaaactatgcagctaattggtttcaactataagactgccataggagaacctctgactcttatgctcaagaatttccttctttcaaaggtaaaggaacctgactctgtaagtatgttcgagaaagtcttaacaccggagttggttgaaatattgaaggatgatacagcatatgagaatttcagagggatacttggaggagaatcaaatgattaagtgaacgcattgtctgttcaatgtgtttcggcagcaggtttccttgtatgcaacatgaggaaacccgctggatgctctgtgtcgccgataattcggttatttaggaatgtacctgctgcggtaggaatatttctttgactctggtgagtatgacatgggaagcacgactgatgagcgcgactggtacgagttgcattcggacggattgtgcattcgcaacatttcctgcaaggatgtcgttcccactgcacagaaaacccacctgtctatgttgtgcagacatcatcagtgctatgcataatctcgcttagacagcgaggttgctgtcctgcagtaagtcgaaacgacttggagttatgcctgcgtcatgttccatgcgctcgatacatggtagaaccatttcagtgcgctcctcggcggattcaggtgctttggctctttgtttctttgctgaaagaatctttgtccatgttgcgttgcatttatcaggaggcatagttccataggggccgaagaaatccgactttgattcaaccgctggtaatgcagaatcacaatctggaaggaagaccggcccaattggggcagtagtatacgaaagccatgctgggtcaaaatcttttgaaattagaacagctgggaatgtgtgtgctgtcccgcaaagtatccgagtaacttcgccattttgatacatgaatttttatttcaagtgcaacggccggaaaaggcaagggcccatgggtcaccgatacgatggtgcttgcgacagacaaccagacatcggaggacgcatgggccggtacgcacatcctgcactggcggagcgcgaggagatcatgctgatgcggcacgaaggcaggagcccggccgacatcgcaagagcgacgggcagggatcggtcgaccatcagcagggagatgcgcaggaactcgttccgggtcggcgcgggaccgctgctaccgggcatcgaccgcgcaacgctcctacgaggcgcgcaggctctcctgcgtgcgtcccaggatcctcgacgacgcggggctcgccgggctcgtcacgcggctgatcgtgcgggagcgctggtcgcccgagcagatcgccggcaggatcggggtcgaacgtccggacctgtcggtgtccgtgtcgaccatctaccgggccgtcaacgacggcaggctcgactcgcccgagctggagcgcgccaaacggggcatcagggcgcgcctacgccacaggggcaagcggcggcaccggaggggcggtgtgtgtgatcgaataaaggtgttcactgtcggcacttgttcctgaacaccctgagtgcctgcagaagtactggcagtccggccttgccgcaggcgccgtcaaggaatgaatttgttaggatagttgacaaaaaaacaaaggagtggatatgactcaacgtagagcctatcgttggccgcagccgttggctggacagcaggaacgcatctggtacggaggtgactacaacccggaccagtggcccgaggaagtgtgggatgatgacgtccgtctgatgaagaaggcgggcgtgaacctcgtgtccgtcggcatcttctcgtgggcgaagatcgagacgagcgagggcgtgtacgatttcgactggctcgaccgcatcatcgacaagctgggcgaggccggtatcgcagtggacttggcgtccgccaccgcgtcgccgccgatgtggctcacccaggcgcatcccgaggtgctgtggaaagactaccgcggcgacgtgtgccagccgggcgcccgccagcattggaggcccacgagtccggtgttccgcgagtacgcgctgaagctgtgccgtgcgatggccgagcattacaagggcaacccgtacgtggtcgcatggcatgtgagcaacgagtacggctgccacaaccgtttcgactattccgaggacgccgaacatgcgttccagcagtggtgcgaggaacgctacggcaccatcgacgcggtgaacgacgcgtggggcacggcgttctgggcacagcgcatgaacgacttcagtgagatcgtgcctccgcgcttcatcggcgacggcaacttcatgaacccgggcaagctgctcgacttcaagcggttcagctcggacgcgttgaaggcgttctacatcgccgagcgcgacacgcttgccgagatcacgccggatctgcccctgaccacgaacttcatggtgtccgcgtccggttcggtgttggactacgacgattggggcgacgaggtcgatttcgtgtcgaacgaccattacttcattccgggcgaggcccacttggacgagctcgcgttctccgcgagcctggtcgacggcatcgcacgcaaggatccgtggttcctgatggagcattccaccagcgcggtcaactggcgtgagatcaactaccgcaaggagcccggccagctggtgcgcgactctttggctcatgtggccatgggtgcggacgcggtgtgctacttccagtggaggcagtccaaggcaggcgcggagaagttccattccgcgatggtgccccacgcgggcgaggattccgccgtgttccgcgacgtgtgcgagctgggcgccgatctgaacaaactgtccgacgagggcattctgggatcgaggctcgcgaagtcccgtgtggccgtggtattcgactacgagtccgaatgggccaccgaacacaccgccacgccgacccagcacgtgcatcacgtggacgagccattggcgtggttccgcgctttggccgatcagggtgtgaccgccgacgtggtgccggtgcgcggcgcctgggatgactatgagatggtcgtattgccgagcgtatacctgctttccgaggaaacgacccgcagggtgcgcgattacgtcgtgggcggcggtcgactggtcgtgacctactacacgggcatctcggacgagaaggaccacgtgtggctcggcgggtatccgggctcgatccgtgacgtggtcggcgtgcgcgtggaggaattcatgcccatgggcgacgatttcacgggcgtgccggatcgcctcgagttgtcgaacggcgcggtcgcgcacgatatcgccgacgtgatcggctcggtcgacgggacggccaccgtgctggaaacgttcaaggacgatccgtggaccggcatggacggcgctccggcgatcgtcgcgcacacgttcggcgaaggtcgcagcgtgtacgtgggcgcgcgcctcgggcgggacggcatcgcgttgagcctgccggaaattcttgattcgctcggcatggccgaagcgggcggaaacgacggccgagtgctgcacgtcgaacgtgagggcgcggacggttcgaggttcgtgttctcgttcaaccgcacgcatgagacggtccgggttccggtggaaggcgaagtcgtggtctcctcgttcgcggacgtggacggcgaaacggcctcgattaaaccgaacggcgtgatcgtcactaagcagtaagcggacagcaagcaaataatcgcaacattatgggtgtcggcaggttgatgattgtcaatctgccgacacccatttaatttatactattcgaataaaaactaggcgtggaattccactgcagcccaactgattgctggcaaagtgcagtgaactgatccattgtcgattgttgcatgaagctcttggggtgtcactgcggttgggtcgtctgcggaattacgctgatatggattgtcgtcatgcagaataatggccttgtctatatggaagtcggatatgtcgaaatacggcagttgagacagagaagccgtaaccttatgtgcgtcggatgcgtcgcgattcaccataagcagaagaccggaatgattcgtttcgtcccaagtgattactgaatcaagggcattgaccaagccgaaagattcagtctctacgttgggagagtcgatgactggactgtaggcaatgccatgggcgtgttgtgcggcttcggcaaacggatagaagacagtttgacgccatgcgggaccgttcttttcggccatgattggcgcaatcacattgaccaactgcgcgcgcgaggcagaacgcactcggtcgcagtgcttaagcagagtgatcatcagcgacccttctaccactgcatcggctgcattgtagatatcttcgagcagacgcggtgctttcggccatgactcatgatgaagatccttgcctgattgggctttccattcagcttcctgctgattccagacgtcggaataccagacgccccactcatcaaatgacagtgctatatcatgatcgcctgtgtgggcatttttggcttcgtctgcacatgccgccacggtggagatgaacgtttgcatgtcttgtgaacttgccagataatcttgcaacgattttgccccacgtttgtagtagtaggcatggcaggagacgaaatcgagattgtcgtacgctttggtaagcacgctgcgttcccaggatccaaacgttgacatatgggcgctggaggagccgcaggccacgagttccaagcctgattccgcgagtttcatggcgtgtgcgactcggtccacggctgcggcatactcgtcagggctcatatgtcccacctgccaagggccatccatttcattgccgatgcaccacattttgatgtccattggttcggtgattccgttacgtacgcggcgatcggcaagctcggtgccgggcgctccgttgacgtattccaactcttccagtgcggccttcaatcctcgggtgcccatattgacggcaagcatgatttcggtaccggtcttcttgctccatcggtagaaatcgtcgataccgacttcattggtttcggtgctgtgccatgcgagatctcgtcgtattgggcgttgcccccgtggccctgtgccatcctcccaattgtaggcagagacgaaattgccgccggggtaacgcacgcaggtcacaccaagttctttgactagattgatgacgtcttggcggaatccgttttcgtcggctgtggggtgacttggctcataaatgcctccgtagacacaacgtccaagatgttctacaaatgatccgaaaatgcggggtggtatatcggcaattgcgctgtttttttgcactgtgattgtgctggttccggaagtcatgccgttcctttcgatgagtggtctgatgaaatgtctgcgttgcgcgagcttcgacggatatgcatacgtctagtatgcaatcatatcgtgtttgcgtagctaaacaaaatatgctaggtaactaaagaaatactgtaaaatcaacgatttgcctatttgtttgcgtaaacataacttttgtgttatcctcatgactgtcggaagggtcaatgaatgattcatagccgataatgttggtcgatgtaggaggtcggccatatttaaaggaaggaagaacgatgaagttcactgcatccaagaaaacaatcgctctggttgctgctgctgcgatgctgactagtgtcgcagcctgcgggagttcctcgaattcgagttcttcgggggtgacagagggtggtaagactgaaattacggtatggtcttgggattccactttgccgcgtaccgtgaaggattttgaaaaggccaatccggacatcactgttaaggtgaccaatgccggcacgaacaagaccgaatacacggctttgaacaatgcgctttctgcaggtaaaggtgcgccagatttggtgcagattgagtattatgcacttcccgaatatcaggttcgtggagagattgaagacctgagtcagtttggtgcgggcaagttctcggatttctatacgccgggcacgtgggcttctgtgaaacttaatggcggtgtgtatgcactgccgatggattccggaccgatggcatggttctataacaaggatgtgtttgataaggccggggtcgatccgactcgggtgaggacgtgggatgagttctacgatgctgccaagaaggttcgcgcaacagggtcctacattacgtccgattctggtgatgctggcttcttcgattccatgacatggctggcgggcgcgacgccgttctccactggttccgatggacagtccgtcaccatcaacctcagcaatgattccaaggtcaagacttttgttgatttctggcagaagatgattgatgatgatcttatcgataccaagaccgcaggctggagtgatgattggaacaagagtttgaatgacggctctatcgcttcgctgctgaccggtgcttggatgccgtacaacttgctttccggtgctcctgacggtgaggggaagtggcgtgttgctcagatgccgactccggatggatctgaaaccaattccgagaacggtggttcttcgctggcgatggtcaagacggatgacaaggccaaggccgaagctgcatacaagttcgctgaatatgcgtgccacaatgccgaaggcatcaagactcgcgtcgctggcggcgcattccctgccgataacgacactctcgcttctgatgacttcctgaacatgacctctctgactgattccgatggcaatgcgcacgaatacttcggtggtcagaagttcaatgaggagctcgccaaggctgcggccaatgtttcgactggctacaagttcctgccgttcgaggtttatgcgcgtggcgtatatagcgatgatgccggtggtgcatataccgacaagtccgtcacccttgctgaaggtgttcaggcttgggaaaagaatatcaaggattatgcatctcagcagggctacaccgtgaagtagctgcatgattccatagtggaatcggtaaatatgagcgtctgtggattgagggattgtcaatcggcggacgcttttttgagctatcagtggattgcgtggctgaatcgaagagattggaggattgtacgctggctttcgggtgactgacgtacactcgaatgcgtatgtctgtacgtacgttttcgtgtgggaacatcaaacggaaggaatcggcttgaaactggtgaaacgactcatcgccatctgctgtgcggccattatggcagtcagtgcggccgcttgcggagccaacgtcgattcccgcaccgaaatcaccgtgtggtcgtgggagccgagcatgaaacaggtcattgccagcttcgaaaaggaaaaccccgacatccacgttatttggaagaacacaagcggttacgacaatctcaacaacgccattcaagacggttacggcattcccgacgtggtgcaattggaatactatgcgttgcgccagtacgcggtaagcggccagctggtggcgatcaccgggcgtacggaaggctacggcgatttctacacgcccggtacgtgggcttcggtgcagctgaacggccgtgtgtacggccttcccatggattccggtccaatggcgttcttctacaacgacagcgtgttcgagcaggtaggcatcgatgcctccaagattcgcacgtgggacgactattacgaggcggccaaaaagctgaaaagcatcggcgtgtacatcgcagccgattcgggtgacgccagcttctacgacacgatgatctggcttgccggaggccgtccgttctccacctccaacgacggcaaaaacgtgacgatcaacctcaccgacgatgagggtacgagaaccttcaccgaattctggcagaaaatgatcgacgaaggtttggtcgccaccaatctgaccacatggtccgatgggtggaaggaagccgtgggggaggggaagatcgcctccatgttctccggtgcttggctgccgtcgctgctcatgtcgaaccttcccggaaccgcgggtttgtggcgtgtggcacagatgcccacgccggatggcagttataccacgtcggaaaacggcggttcggcgctggctgtgttgcagcgttcgcgcaagcccgaagcgtcatatcgtttcatcgaatacgcatgccataacgcggaaggcatcaaagcccgtgtggacggcggtgcgttccccgccgataacatcacgttgtctgatcgggaattcctgcgcaaaaccacggtgaccgacgaacgtggcatcgaaataccgtatttcggcgggcaggaatacaatcgcgtgctttcccaagccgcggaaaacgtgtcgaccggttaccagtatctgccgtttgaagtgtatgcgcgaagcgacttccgcactaccgtaggcaaggcctacaaatggtcgagccggttgcgcaaagagcaggacaggctgaatatcatcgcggccggtggcaaagtgtccgacaaatccgccatcggcgacgcgttgaaggaaactgattccgctgatcgtctcaaattgaaaagcggtattgcgctgtggcagaaggatttgaaggaatatggagccaatcagggcttcactattcaataaatattaattattcatataagatgtcagactataacctgaccgcagacggctacggcatgacttctgccctaaatgccagaaccgcagccgacgccatccgccagcgggaatttgatttagcgctgctggacatcaacctgccggatggaaatggttttgagatgtgcaagctgataaagccccaacacccagacaccatcgtgattttcctaaccgccaacgatcaggagagtgaccagatacgggggctatgaggcgggcgcggtggactacatcacaaagccctttgtaatcggggccttgcagcgaaaaatcaaagccatgttcaccatgctgaaacaccacagaccggccaaggatatttacgacgacgggcggctgtttctggacttcccggagcagacggcttccttaaacggcaagcccctgaccctatccccgatggagtacaaaatgctgaacctgttccgcaaaaatccccggcaagtgctgacccgcgggcagcttttggaaaaactgtgggatatagacgaaaggtttgtggacgaacacaccctgacaacctccatcagccggattcgcagcaagatcgaagccgacggcggcgcaccctacattaagaccgtttacggcatggggtatcgatggacgggaggcgaggcaaaatgaagtttcaaaacctctcagtaaagcggctgtttggccgggtggcaatagggttgtcctctccgtgtccgggatcaccatagccctgtttcttgtgacaaaacaggttgcggtgctgctgacgggcggggcgccgctgcttgtgcgcccttgtggggatttttgtactgacgcaggcgtttggaaagcggttgtcacagtttaccgctgacctgtgccagactttagaccacatgatcgccgggaatgaagcgccccagcgcccagaggacagcgaaacccagcttgccagaatcggacaccggctggcaaggctttaccagatcatgcaggagaaccgccgccgggtggacgagaaacggcaggagttacaaacccttgtatcagatatttcccatcaggtaaaaacgccggtaagcaatctgaaaatggcgacggacaccctgctggaaaagcccatgaccgaggtggagcgcaccgattttatccggggaatccgcagccagacggataagctggactttctctttcaagcccttgtgaaaacctcccggctggaaacggtcgtgatccagttggataagaaatcgggccgcctctttgataccgtggcgcaggccatgagtgggatcgtgtatgcagcggagaaaaaggaaatcgccgtgtctgtggactgcccggaggatttgaccgtttcccatgacagcaagtggacatccgaagccctctttaacctgcttgacaatgcagtgaagtacaccccggcaggcgggaagatctctgtgtcggtggtactgtgggaagtgtatgtggagatcaaagtgaccgacaccggcaagggcatttccgaaagcaatcaggccgccatcttccggcgcttctatcgtgaggaagaagtacacgagcagcagggcgtgggcattggcctgtatctggcccgcgaaatcgtaacgtggcagggcggctatatcaaggtgatttcggagccgggcaaaggttcgaaattttctattatgctccctacaaaatgaaagtaaatgagcgaggtgtttctattatgaatgaacgagaaaaaacgatccgactgtggtttgatatgtggctttatcagaaagatatgggtattgatgatatttttacagaagatgtcctctatacagaaagttggtgtccccagtatagcaatcgtaaaaccgtaaagcattggtttcaggaatggaatacccgtggaaaagtggtaatttgggaaatcaggcaattcttccataaagacaatcaaatgattgtagaatggtatttcaaaaatgaaatgaataatggggatatagaggaatttgacggcgtttctttggtcgaatggacagaggacaataaaataaaagcattaaaagagtttgggtgtaaccgtaatacttataatccctatcaagaaagcgacatccctcaatttagaaatcaaaaggcgaattggttttagaagtgtatgaagttctacgcaattcggagaggcttgtattttcttaaaatacaaaaataatgatggttgtcttgtattcgattgaaagcaagacaaccatcattattatgtactgagattgcacatatctaaaatataagattttctatcgtacgttacgctcgtaaatatgcagcatgcctttgaaaatcagatcagggtcataaatgtcgatcatgtcggtatcgtcggcgaacacgcggcttaatccgcccgtcgcaaccacgcggaaatcctcgtcgatttcacgatggaattgcgcgatcgtacgttcgatgccgccaaggaagttgtaatacaggccggcctgcatggctggcctggtgcttttcgccagaatcgacgaggggcgcgtgatctccacttccggcaactgggccgtggcatcccacaaggcggccgcgcctgtgcgaatgccggtggtgatgagcccgcaaatcaccgacgcatcggcggtcacatagttgaatgtggtggccgtgccgaaatccgccaccagaatcggcccgccatactcgtagtaggctcccgcacagtcggcaatgcagtccgcgcccatattctgcggattgtccatgcgaatattgatgccggttttgactcccggtccaacaatcatcggatcgatattgaggaatttcacaatgctggcacggaacgaatgcatgaccttcggcaccaccgacgtgatgatcacatcgtccacatcgcccggcgcatagccgctcagccgcaggaattgcgtgatcatcaggccatattcatccgacgtgtggttcgccttcgtggtgatgcgatacgtgccggcgatatgcccgtcatcgagaaagccgatcaccacattggtgttgccgatgtcgactgcgaccagaagcatgtcgaattctccttacgattgctgtattgacgctatttcctgtgatgttggttgatagttacgatgcttgcgattcagcggattcggtattgcgcaacgctgccaattcggtgaggatgcgttccgccaattcctgcttgctcatcttgttccaatgctcgatgatcggttcgtcggtggtttcgccgggtttcagcacggtcaccacattcgtatccaccgcgaatccggcgccgggagtgttgagattgttggccaccagcatggaacaatgcttggatgtgagttttttcgctgcgttcgattcaagatcctgcgtttccatggcgaaaccgcacaaggtttgaccggcggttttatgcgcgcctgcccatgcgagaatatcgggattcgaagtgagccgcagatcgatattgacgcgcccgttcttcttgattttctccgaagactgctcaatcgggcggaaatcgccgacggcagcggccataatcgtcaaatcggcctgcgtgaaatgctcttgcaccgcgttgaacatttgctgcgcggtgatgacatgaaccgtatcaatgccgcggggagcgctcaatgtgacagggccggataccagcgtcacatccgcgcccatatcgcgtgcctgctcggcgatcgcatagcccatttttccagtggaatgattggtgaggtagcgcacgggatcaagcggctcctgtgtggggccggcggtgacgagcacatgcaatccgtgcaatggcaacgtttctgcgggctggttcgcacgcagcagatcagctacggcagcttcgatcgcagcaggctcctccatgcgccccttgccaacatcctggcaggcaagcataccggatcccggctccacaatggtccatccaagttcacggcaggcattgagattgcgttgcgtcacggcattctcatacatgtgcacgttcatggcagggcataggattttcggtccctcgctataggcaagcacggtacttgtcagctggtcgtcggcaatgccgcatgcgattttcgcaatgatatcggcgctcgcgggagcgatgacgagcatgtccgcccatttcgcatcatccacgtgattgatatgcagcggatcggatggcgtatgcgcaacatcgccgtcattgcgctgtgctgcgaacatggacgtgcgcgtctgcgtatgcgtgagcgagctgaacgtcaacggggtgacgaactcctgcgcggccgcggtcatggccacgcgaacctcatgtccctgcttgctccagtcggaggcgagatggcaggccttgaatgcggcgatgctgccggtcacgccgagaagaatatgcgccatagccgatattgtccttcccttgacgttggcaagacttacgaaaactgcgtcaagtatatatcgaaccggctgaggcatgcggcattgcggcattgccgtcagatgaatcctgcgggcatggcggattgtagaatcagactttggtgatcgacccgtacaggcggtcaaccagaacaaacacataatcaaacaggagcaatcatgtcgcaatcttcaggtgcgtacggcgaagccgacgcaaccgaacagaagaacgaacaacacaacaatcagcccgcaaactcggcaagcaccgacgcaactttgaacgcgcgtgccaaatcaccgaaatccaaggggcccaacaagtggatcatcgccatcattgcagtgatcgcagtggtcgccatcattgtgggcgtcgtcgtgttccgtaacaacaacgcatccagcgataccgcggaaaatggcacctccaacaccgtgaccattggactgaaactcgcccccgtaagtctcgacattcgccaccagtccggatcggcgatcgaacaggtgctgatcggcaatgtgtacgaaggactgctgtcgcgcgattccgacaacaaagtgcagccgggactggcgaaaagctgggatatttccaacgacggcacaacgtatacgttccatctcaacgagaacatgaacttctccaacggagacacgttggacgccgaagatgtggcctggtccattaaccagctcaaagaacagcagtattacaacgccaatcaggtcgaaagcctcgaaaaagccgaagcggtcgatagcgacaccgtgaagctcacgctcagcacccccgattccaacctgctgtggtacctgaccggacgccccggcctggtgttcgataaggacgccgaatacaacgcgaaaaccgaagccgtcggatcgggcccgtacacggtggaatccttcgattccgccagcaaaatggcgctcaaagccaacccgaagtattggggaagcgcacacaaggccgcaaccgaaaacgtgatcatcaaattcctcaccgacgataacgcagccgtcaacgcgctgaaaagcggcgaagtcgacgtgctttccccggtgaacgccacgctcgccaaatcgcttgacaccaacacgtatcaggtgtccgcggcggacggcagcgacaaatacgtgctcgccttcaactgcgcgaacagcaagcttgccgacaagcgcgtgcgtcaggcaatccgttacggcatcaaccatgaggaaatcatcgcttcgcgcggtaacgtcgactatgcgctcggcgggccgatcccatccgtggacccgggctatgaggacttgaccgacctgtacccgtacgatgtgaacaaagccaaggaactcatggctgaagccggctattccaccgataatccgctgaaactcaccctcacctacgccaacacgtacggcacggaactcggcgaccaactgcgtagccagctcgccaaaatcggcattgatctcaacatcaactacgtggaattctccacatggctgcaagacgtgcacgccaacggcgactatgaactttcgttggtggaccacgccgaaagccacgacttctacaagtggaccacgcccgactactacttccactacgacggcaagcaagcccaagaactgtatgccaaggcgctcgccgccaccgatgaggaatccagcgcaaactacctgaagcaggctgcgaaagcagtaagcgaggatgcccccgctgactggctgttcggctatcgtgtgacggtggcataccacaagaacgtgcagggattccccagcaagctgagccagacggtgctgccattgtggcagatcaccaaggcgcggtgaatcgacgaaaaacgatggaaaatcggcggaaaacaagtgatgaaaactgatgtgtggcggtgtttgcagcggcatcgttgcggcaccgccacacgttggcgcgatattgttgggtagggtaatgacggtgaataggtgcgtatcgctgcaaacgcacggatcgagcgatagaccaatggtggttcaactatgagatttgtagtcaaacggctgggactgttcgtcgtggccctgttcggtctgtcgcttctggtgttcgtgctgttgcgcatgctgccgggcgatgtggctgcggtgatcgcaggaacgaacgcagcccctgaacgtatcgcgtcgcttcgtaccgaacttggcttggacaaatcgtacgtggcacaatacggcgattggatgctgggattgctgcatggcgatcttggtgtgtccaccatcggaggcaaagcggtgtcggcacaggttgcgtctcgtgcttcggtaacgtttccactgatcatcgtgagtttgctgatcgcattggcgattggcctgccgcttggttgcgctgctgtgctgacccgtaatgcccgcttgcgtgggctttgtcacggtattgcgattgttgccggcgccattcccgcattatggggcggattgctgttgattctgctgttctcacgcggttcaggactgttgggattgctgcctgctcaaggttttcccgataatggctggggcgcgcccttgcaggcgttggcttctttgatacttccggcgctcgccaccggcgttaccgcaggcgcgtccattatgcgttacacgcgtgccgccgtgggggacaaggcctcgtctcaggcggtcgacatggccatggcatgcggcatgacccgcaaacaggcggtattgcgcgtcgctttgcgtcttgccacaccgcaattggtgtcggtgatcggtttgacgttcgcccagatggtcaccggtgtaatggtggttgagaatctgttcgcgcttccggggcttggcaccatgctggtcaccgatgttggcaatcgagatctgattgcagtgcagagcgaattgttcctgttggctacgttcttcctcttgcttggattagtggttgatgtggtgcatcgtgcgcttgatccgcgtctgaaagatgccggattggtgtcgggggaggtgcttgcatgatgaaacagtctgctgagaaaactacttcgaaaaacgctgtgaaaaccgtgattccctccatatggcgtaccgctggtggcaagtattcgctgatcatgcttgcgatatggctggttgtgtcggctatttcgctggtgtggacgccatattcgctgcttgatactgacggattcaacacgtgggcttcgccgtccggcgctcacatgttgggtactgatggtgttggcgctgatgtgttgagctggctgatggccggttcccgtacgaatcttgcgatcgcgctgcttaccgtggtggttgccgcggccatcggcctgctgctggtggcggccatggtgtctcgccatggcgcattggcttccacgtcggtggttgtggtggatgcgttgatttccattccaacagtgctgatcgccttgatgctttccgtgccgttcggcgcgtcggcagcggtgatcatcgccgcatgcggacttgcatacgggctgaatttggcgcgtattctacgccccgcggccatgctcgccgcacgttctgactatgtggaatcggctttgtggtcgggtgcgagttcgttacgcgtgtttttcacgcatattgtgccgaatacggttccggtgttatgcgttcagctgtcgatgagtgcgggcacgtcgctcttggcggaggctggattgacgtatctgggtgttggcgtcggtgcgggagtgcccagttgggggcattcgcttgccacgtccgtgaaattcatcagcatttatccgatggctgtggtgtggccgggattggtggtcaccttgatggtgatagcgctgaatctgtttggcgatgcgttgcgtgacgccatcgatccgctgacgaatccggcattgcggcaaggtgaagccacccatgttgaatcggaggaacgcgcatgagcgtcagcatccgtaatctcaatatcgtcatcgatggaatgccgattgtgcatgatgtcgatatggacatcgccgacggtgaacgtgtcggtttgatcggttcgtccggttccggcaaatccatgatcgccaaatccatcatgggcttgctgccgctttccgcgcaggtttccggcagtattgacatgggtggtactgaaatcgtcggagcgtcggatcaagcgatcgccgatctgcgtggtcgttatgtgggcatggtgttccagaatccttccgccgcattgaatccggtgatgaccgtggcgcagcaggtcgcgctgccactgcgtttgcattacgatctgacccgtgacgaacggttggaccgtgtcaaagcaatgttcgccaaagtcaggctgccggaagatgtgctgaacaaatatccgcatgaactttccggcggacaacagcagcgcgtcggcatcgcggccgcattggtcacgtcgccgcgcctgattatcgccgacgagccaaccaccgcgctggattcgatcacgcaacggcagatcgtcgatctgctggcatcgttggtggacgattccggcgcatccatgctcttcatcacccacgatttcgcggtactcaatcatgcaaccacacgctgttatgtacttgctgatggacgtgttgccgaatcaggacaaaccgccgatatcctgcagtcgccgcacactaaagtcgcttcgcaattggcgacttcggcacgtgcgctgtcgttgcggatcgatgccgaaaccaaataaggagaacggttgtgacgggcgaaaacgaaaaaaccacaatgctgcaaggtcgcggcatcaacaaatactacggtgcgaaacaacagcgtcgtcaggtgctgcacgatgttgatatcgacgtacgttcgggggagtgccttgcggtgatcggcggatccggatccggcaaaaccacccttacacgagtattgctggggctcgaacacgctgaaacgggcgagattacgtatttcggcaagcctgtgcaaggcgaagtcgccggcgaactgcggcgtagctgcggattggtgttccaaagcccattcggctcgttggatccgcgttggagggtcggcagatccgttgccgaaccattgcggttgcatcaccctgattggtcgcaggaacggattgcggaacgcgtgtcggaagccttccgcatggtgagtctcgaccctgccgcatatgaaaatcggttccccgtggacctctctggcggtcagacgcaacgcgtggccatcgcacgtgccattgcggatcatccgaaagtattgcttgccgacgagccgatgagcgccgtcgacgtggccgcacgaacgcagattctcgcatcgttcgctgcgattcgtagcggcgaacctgatatggcgctgatcatggtgtcacacgatttgggagtggtgcagcatatcgcagatcgcattatggtgttgcacgatggttgcgttgaggaatgcggacttacggaaaccgtgttgcaccatccgaccagcgattacaccaaacgattgctggacgcggcttcgctctgatttgtgacactgcgcaaaaagcctgcgatcatgttgaaatccgcatgattgcaggcttttttgccgctatatgaacaggtaagacacgccgatgtcgttacgtgtgctattgtgtgagccatgttcaatttctcttgttgttgctgtcgctgaccaaccgcccgaggggcgcgtggttcatcgaagcataacttgagacagggcattctttttcggcatacgcaacttgcgttgcatgccagagtatcgcagaaatcatcccataaccagtgccttacgcggttggtattacgcggcatatgtggatgaaccgcagcgaaaacaccatcacaggtcccgtttcaaatcattgcaagtgataaacgcgagcttctcgaaatcaaaacaacgaaatcattcatcggaagccaacggaaatcactcttcgcaaggaaacgacatgaccatccacaactccctttccgagctcatcggcaacactccgctcgtcaaactcaaccatgtgaccgacggcatcaaagccaccatcgcagtcaaagtcgaatatttcaatcctggcggctcctccaaagaccgcattgcggaacgcatcatcgacgcggccgaacgcagcggcgaactcaagccgggcggtgtgattgtggaaccgacctccggcaacaccggcgtaggacttgccctcgtggcccagcagcgcggataccgcaccatcttcaccctgccagacaaggtttccgaagccaagcgtgcggtactccgcgcatacggtgcagaagtggtggtaacccctaccgatgctggtccggatgatccgcgctcctactaccaggtggcggaacgcctcgccaaagcgattcccggcggataccgcccgaaccaatacgacaacccgaacggaccggaaagccactaccgcaccaccggtccggaaatctgggaagccagcgaccatcaggtcacgcatttcgtggctggcatcggcactggcggcaccatttccggcaccggacgctacctgaaggaagcttccgacggcgcagtacaagtgatcggcgctgacccggaaggatccatctattccaatccgaacgacgtgcatcagtacagcatcgaaggcgtgggcgaggatttctatccgaaagcgttcgaccgtgaacttcccgacgaaatcgtgcaggtcaacgatgccgaagcattcgaaatgacccgccgtttggctgcggaagaaggtttgctggtcggaggctcgtccggcatggctgttacggcagcgcttaaatacgcacgcgagcacgatttggacgaagaccagctggtcgtggtgttgctgccggattccggtcgcagctatatggaaaagatcttcaacgacgattggatgcgtgccaacggattcgccgacgttgtggaacgcacgtccaagccaagtcttgcggaacagtatctgtaaaccgccaattcatatctcaacatcatgcccatcattcgttcaacccaaaccattcgatattttcaaggagttcccatcatgaccatctcgaccaacaccgaagccctgaacgccactgcactcgccacccgcgccattcacgcaggtcaggaacccgatccgaccaccggagccgtggtcactcctatttatatgacatccacgttcaagcaggatggtgtcggcggcctgcgcaacggttatgattacagccgttccatcaatccgacccgcaactctttcgacgagcagctcgccgcggtcgaaggcgcgaactacgcgctgagcttcgcttccggactggccgccatcgacgtgctgttgcgtgccacgttgaagccgggcgacaatattctgctgggcaatgacgtatatggtggcacctaccgtttgctttccaaggtgttcgtgccgtggggcgtcggtcttgacgtggtggacatcaccgacacggcggccgtttccgcggcgctcagccagaagcagtaccagtacatttgggtggaaaccccgtcgaacccgctgctcaacatcaccgatatcgcagccacgtcagcggtcgctcacgcgcatgacaccaaagtggtggtagacaacaccttcgcatccccggtattgcagcatccgttgacggatggcgccgacgtggtcgtatattccaccaccaaatacatcggcggacattccgacgtggtcggcggagctgtggtgctcaacgacaaggaaatccgcgatgaagtggcgttcctgcagaacgcggccggagctgtgccatctccgttcgactcctggcttgacattcgtggcctcaaaacgttggatctgcgcgtcaagcagcacagccgtaacgccatgaaggtggcgcaatggctggaaacccgccctgaagtggaacgcgtatggtacccgggactggaatcccatccaggccacgagatcgcggcacgacagatgcatggcggcttcggaggcatgatctccgtacagatcgcagccggattcgaagcggccaagaagttcgccggtgctacggaagtgttcactttggctgagtcgttgggaggcgtggaatccctgattgagcatccgggcgccatgacccacgcttccgttgccggtaccacgctggaagtgcccgccaatctcgtgcgactttccgtcggtcttgaagatgctgacgatttgatcgcggacttggagcaggcatttcgtcgtgtttgagataagatcgcagcctcgttacggttttgtgtaatccgtcaaaaaggcaaaacgtgcataaatcctcgccatcggattcgccaaaagcgtatattatgctatttcgaatctgcttatggcgagggttttgccatataatactttcgacaacgttcgtgttcatctaccagcgcattctctgtggaatcgaacgcccatgattatcgagacgaggcggcatgctgcaaattcaaggcatctccaaacagtataaaaccggcgacttcgtgcagcgggcgctggataacgtcagccttaacctgcgtgacagtgaattcgtggccattctcggaccttccggctccggcaaaaccacactgctcaacatcatcggcggacttgaccactatgattccggcgatctggtgatcaacggcatttccaccaaacaatacaaaagccgcgattgggactcctatcgcaaccacaccatcggtttcgtgttccagagctacaatctcattccccatcagaccattctgtcgaatgtggaacttgccctaaccatttcgggcgtatcgcattcggagcgtcgagagcgtgcgcgcaaggcgcttgaacaagtgggtttgggcgagcatgtcaacaaaaagccgaaccagctttccggcggtcagatgcagcgcgtggccattgcgcgcgcgttagtgaacgatccggacatcgtgctcgccgacgagccgaccggtgcgcttgattccgatacttccgtgcagatcatggatctgctcaaagaggttgccaaagaccgcctcgtggtgatggtgacacataaccccgaactggcctaccagtatgccacgcgcattgtggagctcaaggacggtgtgatccgttccgactccgacccgttcgaaccagcccagaacgaaacggccaccgctcccgtgcacaagaccatgggccgcgcatccatgtcgttcggcacgtcgttggcattgagcttcaacaatttacgcaccaagaagggccgcacgttccttacggcattcgcaggatccatcggcattatcggcatcgcattgattatgtccgtttcggcaggcgtgaacacttatatcgacaatattcagcgcgagacgatgactgcttacccgatcagtatcgacgaacagaccttcgacctgaccagcatgatgacttccggtcagcagagtgcggacaatcaaggcaagaagcataagagcgacgcgatttatccggatgatgccgccatcaagggcaccgcttcgatgaccagcagcattaccgaaaacaatctgagcgcgttcaagaaataccttgataataaggacagtgacatcaatcggtatatcggttccgcgggaatccagtattcgtatgatacgaggttctccgtattctcacacgatccagacggcacgcttgtcaacgccgatggtgtgacggtgggcaaaaccggcaccaaatcgatggccgaccagatggcggatggttcgctgatgtctgccgactcgtccacctttacgtcgacgcgcgtgagcatgctcacgggtaaaaccgaccagaatgctgcaccgagctcgttccatgagatcatgccaagcgctgatggcaaaaagaacgtcggcaaggtcatttccgacaattatgaggtagtcgaaggatcctggccaaagaacaagaacgaggttgtgctcgtacttgacgagaacaattcattgtcgttaaccgctgtgtatgagctaggcctcaaatccgccagtgaataccacgatatgatgaaccagctcaattccggcgacgatgtgaaaaccgataccaagaagattgactattccgacgttatcgaccgcacgctgaagctgctgccggcctgcgaccagtatgtcaaaggcgataacggccattggacgtacgtgggcgacgatgtggaccagattaatgcgctgatcgactccgacaaggccatcgatctgaagatcgtgggcgtggttaagccggtagaggatgctgacgcaaccccgctttcctccggtgtgggctatacgcgtgctctgaccaatgagctgatcgaccgtgccgaatccagtgaaatcgtcaccgaacagcagtccgataaagaccacaatgtactcaacggcatgacgttctcgccatccgacgatgccaccaaggcccaggatgcccgcgattacgtcgcatccctcggcgtaagcagcaaggcgcagatggcgcagaacatgatggcggccgcagacgcatccggaggtgactcccagcaggccgcggccatggctcagatgggcgaacagcagctcgccgaccaattcgacgcctatatcgccaccgccgacgaggccacgctggtcgccatctacaaccagtacgtgtccaccggctcctacaacgataatctcgctgatttcggcgtggtcagccgtgacgcaccaagctccatcaacatttacgtcgacagcttcgaagacaagaattccatcaacgacgccatcgacgaatacaataagaccgccaaggaaaaagacaagatcacctacaccgactacgttggtctgatgatgaactcggtaaccaccatcatcaacgtcatcacctatgtgctgatcgctttcgtggctgtgtcattggtggtctcgtcgatcatgatcggcattatcacctatatttccgtactggaacgtaccaaggaaatcggtattctgcgcgccatgggcgcatccaaacgcaatgtgtcgaacgtattcaacgcggaaaccggcattatcggcctgctggccggtctgatcggcgttggtgccaccgtgctgctcaacttcccgatcaacatcgtgctgcaccacttcatgggtaccaccgaggtcagtgccgtgctgccggtcggtaatgccatcgctctggtgattctcagcgtagtgctcaccctgatcggcggcctcatcccaagtcgtggcgcctccaagcaggatcccgccaccgccctccgcaccgagtagaggcggtggatactagactgctgcgtatgacagagtttacgtcggcgcgtgacgccctacgcacctacttcggatatgacgccttccgtcctggtcaagaaggcatagtcaatgcgattatccaaggtcgtgatgcgctcggcgtcatgcccaccggtgcaggcaagtcaatctgctaccaaattcctgccacgcttcttccgggcatgaccgtcgtcatttccccgttgatctcgttgatgcgcgatcaggtcgacgcgctcaacgacgtgggcattccagccgcattcatcaataccacgcaaagtcccgacgaacaggatctggtgttcgtgcaggcgttgtcgggacggatcagactgctgtatgtggctccggaacgtttggaaaccgaacgtttccgcacgttcgccagtcgtgtgccgatttctctggtcgccgttgacgaggcgcattgcgtgtcgcaatggggccaggatttccgttcgtcatatcttggtatcggcgattttctgaaggcgttgccgacccgtccgacggttgccgcgttcactgcgaccgcgacggaacgggtgcgccgcgatattatcggaattctcggattgcgtgatccgtccgtcaccgtcaccggcttcgacagggccaacctgtatttcgacgtgatcaggatggaaaggaaacataaggcttcgtgggtggcttcgtatattgcggatcatcctgacgaatccggcatcgtgtattgcgcgacccgcaaggaagtggagtcacttgccgaatcgttgaatatcgccgtgcgcgagctgcgtgcggcgaaaggtgaggatgcgacgcgaatcggcacggtcgcggtcgcctatcatggcggtatgtcggccgaaacgagggatcgggcgcaacgtgatttcgtaaccgaccgtgtgcctgtggtggttgccacgaatgcgttcggcatgggaatcgacaagtcgaacgtgcgttatgtgatccaccataatatgccggaatcgatcgaagcgtactatcaggaggcaggtcgtgcggggcgtgacggcgagccgagccggtgcacgttgctgtggaatgaatctgatattgctacgaggcggaggctgcttgattcggattatgagaacgagcgtttgaccgctgaagagcaggaggttgtgcgtgcatcgaaacggcgtctgctcaacgctatgatcggttattgccgtactacggattgtctgcacgagtatatgaccaggtatttcggcgaggccgggggagcagccgtccgcgatgacggcgcatgcgtgggaggatgcgcgaactgcgggaatacgtttgaaaccgttgacgtcacggatatcgcgcgggccatcagccgctgcgtgcatgacgtgaaccagaaggtcggttcggggaagatcgtcaaagtgctgcgagggtcaaaagcgcaggatttaaactatcttcatcctgtcgatctgccgacgtacggcatgttgagcgcgacttcggaggtacagattcgtgacgtgctcagccagatggcgacggatggttttctttccatttcggaaggctccatgccgatcgttcgctttggtgaacgtgcggcggaaacggtagcgccgaattttcattatgaaatcaagaagatcgaacggaagcacgctacgaaacgtgcggaatcgccgtccgtaggctctcaggccatgggatcgtatgtgccgggcgacggagacgaggaattgttcgccaaactgcgcgcgttgcggcttgacatcgcccgcgaactcggtaaacccccgtatatcgtcttttccgataaaacgctgcgcgacatggtgcgtatcaggccggtcaccggcgagcaattctcgcaagtcaatggcgttggtgcgctcaaattggaagcgtatggcgaacggttcatggaagtgatccgcgatttcgttgcatgaatcaggtgacgtgtcagcttgaggaataagcgtatcgattattgcaaaatcatacgttttatatgatacgtaacacgttatcggcaacatgtatggcggtgaggttgacgtatgccggcaaaacggcgacagtagagacgaacagttgttgaagaaaggattgatgatggcagaagacaagccggttgtggaaagcttccagctcgaccacaccaaggtgaaggctccgtatgtgcgttatatcgacacgcagaccggtccgaatggcgatgtgatttccaattatgatttgcgtttggtgcagccgaatgagaatgcgattccgaccggtggcctgcacaccatcgaacatacgattgcggtgctgttgcgtgaacgtatcgacggttatatcgattgttccccgttcggctgccgtaccggtttccacctgctgacgtggggcgagcattccacggaagaagtggctcgcgcgttgaaggaggcgttggaattcatcgcatacgaggccacatgggatgacgttcctgccaccaccatcgaaagctgcggcaattaccgcgaccatagcctgttcacggcgaaggaatggtgcaaggatattctcgccaagggcatcagctctgacgcgtttgagcgccgtctggtctgatttgcgtgcgattgcacgtcttttttcgggcatattgcgaatactgtgccgtgggcatggtatttttgacgctcggaagaagacaaggtgatgcaaaggtgaacgagatgggtgaggagagcgtcattacctctgaacggcggttccgtcgcgccactatggctgatttgccgaccatgctgaagatttatgagcatgcccgcaagttgatggcctccaatggcaatcccacgcagtggggtgataagttccctcgtgaggaagtggttcgtgacgatgtcgaatcgcaacgcaccgtgttgctggtcgatacggttgatggcgaggaacgtgtgctcgcccagttcgcattgtgtccgggcatcgacccgacgtatgtgaatatcgatggtgcctggctggatgacgatccgtatgtgaccatccaccggatcgcctcgtcgggtctcgccaagggtgcggcgaaggactgcatcaactggtgcatcgaacattacggcaatgtgcgcgcggatacgcatcccaacaacaaggccatgcagcatgtgctcgaatcgaatggtttcgcgcgctgcggcttgattcagttgcttgacaggccgtccgacaccacgcgtatcgcttatcaacggcatgaatggtgagatttgcggatttatatggattgatatcaatcaatataaatttcagcacaaataatcgcaaataatcttcgatattgagaagcaaaaatcccgttgaatatcgtatttcagatgttcaacgggatttttatatccgattgtgttgctttcgatatatcttacgaaagatatatcgaaagcaaccgtatcgtcggtttttagaacagtcctggctcgttcaatgcggaatgcttgcggctgtacacgaaatacacgatcaaaccaagggcgaaccagattgcgaaacgcacccaggtttcccaattcaaaccgcaaatcaggatgaagcagaaaatgatcgcgcagatcggcgtgaacggcacgcccggggcgcggaagccgcggtgtgcgtccggctgggtcttacgcatccacagaatgcctgcggacacgatgatgaatgccgacagcgtaccgatgttcaccaattcgaacagcacgttgatgttgatgaaaccgccggcgatggccgttagaataccgaagaaccatgtacctttgaacggggtgcggtatttcgggtgtacttcgccgaagaacttcgggaacaggccgtcgcggctcatggcgtagcagatgcgggactggccgtacagctgcaccagcatcaccgtggtcatgccgatcagagcgccaagattgacaacgaacgccagccagttgagaccggtttcgagaatcacgccggccaccggagcgtcaatgaagttcgcgaactccttgtatggcaccacaccggtcatgatcagcgtcatgacgatgtacagcacggtggacacggccagcgagatcagaatgccgcgcggcagtgtcttgttcggattgatggtctcctcggcggaagaggacaccgcgtcaaagccgatgaagctgaagaacacgatcgacgcggccggaacaatgccgtacggctgcgtcgagcccggctggaacgtgtaaatgccgtacggggagaacggcttccaattggcgggattgatgtaccagacggtgcacacgatgaacagcacgatgatggccagtttgatcatcaccataatatcgttggttttcttcgtctggttaatgccgatggacagcacccaagtgatgatgagcacgatcacgaaaccaggcagattgaagtatgtggtcacgcctggcgtggtgccgtatgccgcagtcagttcaactggcagatgcaagccgaaaccttccaacagtttgttgaaatatccggaccatccggcggacacggtggccgcctgcaaggcgtattccaaaatcaaatcccagccgatcacaaacgcgatcagctcgccgaacgccaaatacgcgtacgaatatgcggaaccggacactggtgccatcgcggcgaactccgcatagcacaatcccgcgaaaccgcagcagaccgcggccagaaggaaggagatgcacaatgccggacctgcggtgagggcgcccttgccggtgagtacgaaaatgccggtgccgatgatggcgccgattcccagcatggtaaggtcaaatgttttcaatgtgcgtttcagcggagtcgactcggatacgagctggtccactgactttttgcgaaaaagatccatggtcttaattccctaaaaatggttttatatgggctggaccggacggatttccgggactctggcacgcctcaaacgccagaaatcaaagaagggctgaacgcctcatatacgggaggtgtacgcgccttatgtaaggagagtgtaaaaacctggcacggacaaaaccgtgaaaaccccgtgaatcgtctcgctaagtgtgcgcgcctttccgaagccgtcacgtgggagcgcaacaatagagccatgactttcaacgctgcccgtgaatggcaattctcatccgaacaaggcaaggccaattatgaggccgcccaaaagcaatatccggcgcaggccatcgtcgatatggccgcattgcgaaacaacatgcgtcatctggtgagcgtggttggcggcccgaattccggcaccgccgtgatgggtgtggtcaaggccgacgcgtacgggcatggtcttattccggccgcgctcgcggcactggcgggaggtgcgacctggctgggcacggcgcaatcacatgaggcgctgctgctgcgcaaggcgggcatcgggccggaccgctgccacattctgacatgggtatataacggcatggctgtgccttttgacgagctgatcgacaatgatatcgatatttccgtcggatcattgccgggcattgacggcgttgcggctgcggcgcgtcgtcttggaaaaaccgcacgtgtgcatgtgaaggtcgattccggtttcggccgcaacgggttcacgcccgccacgttcgacgcggcgctcgccaagctggtgccgctcgccaaggagggtgtgctgcatatcgtcggccagtggagccatttggcggtggcggacgctccggacgttcctgaattcgtggcatccaccgacagacagatcgagaatttcaaggatttcacccgtcgtatggagcaggcgggcattgcgccggagattcgtcatctcgccaataccgctgccacgctttcacgttccgagattcattttgagctgacgcgcccgggtatcggcctgtatggttatgaggctgatccggccatgggcacgccaggtacatacggtttgacgccggccatgacgttgcaggcgcagcttggtacggtcaaggatgttgaagcgggccatggcatttcctatggccgcacgtacctgactccgtccgatacgtccaccgcgatcgtgcctgtcggctatgcggacggcattcaccgttccgcttccggttttgatatggaaggcgcgaagcatgtggtcaagccaggaggcccggtgcgtgtgatgaccacggagggtccgcgcctctaccgtgtgtccggtcgcgtgtgcatggatcagtttatgcttgacctgcacggttccgcggaaaagcttggcgtgcatgagggcgacaccgtgcagctgttcggaccgggtcgcggagaggattatgccgagccgaccgccgacgattggggccgtgccgcaggaaccatcagctatgagatcttcacctgcctgtgcaaccgtatcccgcgcctgtacgagcatgcctctgacgtgctgtcggtcgaagatctcgccaaactcgatcccgcaaccctcctataaagaatcaggcgtgcgatgggaggcacgccgtgaaagtcaatatggtgggcgcggtacgttcgatggttggtcaacgtgccgcgcttgctgttaaggtggtgagctatgccaggaatgattctgaaggaagatatcgaaaaagttcgcgccaccgccgatttgtacgacattgtgtccgcaacggttacgctcaaaccttcaggaactggcacatacgtggggctgtgcccgtttcatgacgagaaaacgccaagcttttccgtgcgtccggcgctcggtgtgtggcattgcttcggctgcggtcttggcggagacgtgttcggctatgtggagcatcaggagaacgtcgactttcgtgatgccgtcgagcttttggccgaccgataccatatcgaattgcgttatgaccagtcgaacgccaagaaggagcataccggttcgaaacgtgcccgcctgttggaagccaacgaggccgcgcaggagtttttcgtctcgcagctgatgaccaaagacgcgctcgccgcgcgcaaactgcttgatggccgtaatttcagccaggccgattgccaacgattcggttgcggatatgctccgcaaggctgggataatctggtgcggtacttggcaggcaagggcttcacacagcaggaaatgttggacgcaggtttggcccgtcaaggccagcatggggtgtatgactatttccgtggccgcgtaacatggccgattcgcgattcaaccggacgcacgcttggtttcggcgctcgcaagttgtatgaggatgattcgattagcgcgaaatacattaatactcccgacacgcagttgtatcggaaaaaccaggtgctgtatggcattgatatggcgaagtcggcgattgtgaagaaacgtcaggcggtgatcgtcgaagggtatacggatgtgatggccatgcatttggccggcattgataccgcgatcgcgacatgcggcaccgcgttcggtgccgagcatgccaagatcgtgcgtcgtctgatcgccgacgattcgttgggtgcggtacagctggttggtccgttgaaggttgaaggacaggcgttgagttcgcgtatcgtgttcaccttcgatggcgatgcggccggtcagaaggctgcgattcatgcgttcggcttggattccgctttttcgacgcaggcgttcgttgctgtggccgacgacaatctcgacccgtgcgatttgcgtatcaagcgaggtaatgaggcggttcgcgcgttgatcgatcatgccgaaccactgtatgatttcgtgatcaaaaccgcgatcgggcgtttcgacaccacttataccactgggcagatgggcgcagtcaaggcggtggcgccgttgatcgcacagattcgtgaccgttccctgttggatttgtattcacgcaaggcggtgcgccagatcggcgtcgacttggatatcatgcagcgtgaagtgcgtgacgcacgacgcaaactgcaggtgcgggacgaagatgcgtacgctccgaaacgtcgttttgcaggcaatgccggagctgcggtggaaccgcgtatggaacaaggcacgaatccgtatgcgaatccttccgcgcggaaggcgttggaacatcgtgatgcggcggagcaatcctactatcgcattgatgatgccgtgttcatttgcgaacagcagttcatggcaaccctgattcaagtgccgcttgccgttgatccgacactgttcgccagtcttacgctgtcgagcttcatgacccccgtattccgcacgttattccaagcggtcgcggcggcggggggactgccgtctgctgataccccgcaaggattgtggatgcacaatctcaccaaagcgggtggtccgatgttggaatccgtcatcaacgagcttgccgtcatgccattgccgcttcctccgagcgatactgacgcagaacgtgcgtcgcaacaatcgcaggaaggcaacgtgcaattgcgcaagccgaccgatgacgaacgcagatacgcgtctgaactcatcattcgactgcttgacacgggcatcatgcgcaaaatcggcgcggaccagcgtcgcatggcgcaactgccggacggtgccgagaaaatcgagctgcttggccagattaccaagctggaaacgttgcgcaaggatctgcagacgagggtgttcggcaataacgtcgcctgaatatttggtgtgccggagcgtcaacccccgaacgtctttgtcgttcacctgaatttgccacatgcctgagtgcggtatgaacagccggcgaacgtgtggtgaacgcaggaagaatacttaacgaattcttggctggtgcacggtatccttcggcgtgttttgcaattgcaaaacagttttgccggtttgcaaagtcagggaacagtaaggcgcatgggctgaaaaacgttggaatggtcggaaaaatagtatgccaagggtatgtggtacgcgatttttcgggtaaagtgaatacggcgtttcttgagtaaatcgcccgggtctgcaaacggtttgcaaactggattcacggaggaatgaatgcgacgattggtcatcaaaatcctgaaaaacgagaccattctcgtagttgcttccatacttgctcttatttcatgctttatcgtgcctcctgacaaggagtatgccggatatattcatgccagcaccatttcgcagctgatctgcctgatgctggtggtgtgcggtttccagcgcatcggtgtgttccgcatcatcggttcgcggttgctgcatcatgtgagcaccgcccgcggattggtgatcacgctgatttcgctcacctatttttccggcatgctgattaccaatgatgtggcgctggtcacgttcattccattcgcgatcgcggtgctcaccatggctcacatggaggagcatgcggtgctggtcggcacgttgatgaccgtcggtgcgaacgtgggcagtatgttgacgccgatcggcaatgcgcacaacctgtatttgaaagcgttgacgggcatgccgtccgctgaaatgatcggcattatggcaccgtattccgttgctgcggcggtattgctggtggtcatcgtctgtgtggtgttcggtaagaaacctgtttccgaattttcctctatcgacggcagcggcatcgaacagaatgtgctcgctccgaattccgatcagccgcagccggatgagattcgtgtgaccggctacggcgcaggttacggtggttggcgcacgatcgtatattgcgcgctgttcatcgtgtgtttgctggctgtgagcgatttcattccgctatgggccatgtgcgtgatcgtggtggtggcgttcctgttctgcgatcgccgcgtgttccgcaatatcgactggggattgccgctcacgttctgcatgttcttcattttcatcggcaatatgaaacgcgtgccggaattctacgagctggccgcctccttggtgggggcgcatccgctggaagtgtccgtggtgtccagccagttcatctccaacgtgccgaccacgttgctgctgtcgggcttctgcgaccagtggcgtgcactgattattggcaccaaccttggtggcatgggtacgctgatcgcatccatggcctcgctgatcggatacaagaacgtgacgcgtaagtaccccgataagaaggggcgctatttggccgtctattcggcggtgaatgtgctgttccttatcgtactggtcggtttgagctggattatcgagccgtgaacccatgctccccggtcttgatgacttgcttgtttgggatcggggagccgttggttccatggttttgccgtcggtatgatcgctgctcagcgcgttcgagttggcaagaacgtgcgaactggctatactgattcaagtttggccctgtagctcagctggatagagcatgtgacttctaatctcaaggtcgggagttcgagtctccccggggtcaccatcaagcccttacgtcagtaggcgtaagggctttcgtatatcgataggcggctgcttcggctgtcgcttgggcagcgggaggaacccatgaagcgaatcgtcgcgggcattctggcgcatgtggacgcgggcaagaccacgttgtcggaggcgctgctgtacgctaccggccaagtacgcaaactcggccgcgtcgaccacggcgacgccttcctcgacacggacgccatggaacggcagcgcggcatcaccatcttcaccgagccggccgtcatcgccacgcccgacctcaccatcaccctgctcgacactcctggacacgtcgacttctccgccgaaacggaacgtacgctcgccgtgctcgactacgccatcctcgtcatctccggcgcggacggcatccaaggccataccgaaacgctgtggcgactgctcaatcgctatcaggtgcccacattcgtcttcgtcaacaaaatggactcgcccggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgttatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaaacggcaccgcgcacgccggcgacgcggatgtggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgccggcagtccggtcctccagccggtgctcacgtacacgctggaaccgggggagtgcgacattcacaaatgtctcgtcgccctacgcgaactggaggacgaggatccgctgctgcacgtcgtctggcagtctcgcctagaggaagtgcacctgcagttgatgggcgcggtgcagctggagatcatccagcagatcatgcacgaccgtttcggcctggacgtcacgttcggaccgggcagcatcctgtacaaggagacgatcgccgcgccggtcgaaggcatcggccatttcgagccgttgcgtcactacgccgaaacgcatgtgctgctcgaaccgctgccgcagggctcgggcatggcatacgccaccgtgtgcagcgaggacgtgctcgaccgcaactggcagcgcctcatcatgcagcatttccaggaacgtgagcatctgggcgtgctcaccggctcgccgatcaccgatatgagaatcacgctgctgacgggccgtgcgcatctgaagcacacggaaggcggcgatttccgtcaagccacgtatcgtgcgattcgtcaggggttgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtccccgaattcatgcacctcgactacgcctggcacggcgaagaggcgtaaaacatgtagataggctgccgacgccggactgtgcaaagttctgcgtgtcggcagtttttttttaaaaaaaaaacgcgagtggagtagatgtgtgagaaaaagaaaaccccacacgaggtggggcttggtggagcggacaacgggactcgaacccgcggtctcaaccttggcaaggttgcgctttaccaactaagctatgtccgcaaagaacttccgccgtgagaagcggaaattcagtgggtgatataggaatcgaacctatgaccccttccgtgtgaaggaagtgcgctagccgctgcgccaatcacccgcgacggtgtccagattaagtgccgaacacgtccacctcaatttgacgaaatacagacaacctcgccgaccgcgatttcacggccgaacggccgaatgagaagtggctgacggacatcacccgggatcaaggcccgggacgggaggtgtacctctcgccgccggtcgactgccacgatggcgggatcgtcgcgtacacggccgggtccggtcccaacgcggagctagccaacaggatgctcgtcaaggccgtggaaacgctgccggaggggcgaggtccctggtgcattccgaccgcggctgccactgtcggcggcccggatggctggatctcatggaccgttacggcctggcgcaaccacgagcgtatcaaacggtcactcggttggatgagtccggtacaataccgtcagagccagggaatgactgcgtgatcatctccaagaaaacgtccgcagcctgctaccgatatcaatcgccctacatcgacaatgtattatcgacaatatattgcgataatccaagaatatttgatgattagtcggtaatgtcggctttgtagaagttcacgtaggaacggctcggcgtcggaccgcgctgaccctgataatgcgagccggtgccttgcgaaccgtacggatgttctgcgggagagctgagctggaaaaagcacatctgaccgatcttcatgcccggccacaacttcaccggcaacgtcgacacattcgacaattccaacgtgatatgaccctcgaaaccagggtcgatgaagcctgcggtggaatgcgtgagaatacccaagcggcccagcgagctcttgccctccagtcgggcggcaatcgtcggatcaagctgcacatactcccacgtggaccccaacgcgaactcacccggatgcagaatccacggttcgtccgaagccacctcgaactgctcggtcagctcgccctgattctcagccggatcgacatacgtgtacgcatgattgttgaacaggcggaagaaacggtccaaacgcacgtcaatggaagcaggctgcaccatttccggggtccacggatcgagtgaaatatgaccttcggcctgcgcggcgagaatgtcacgatcggacagcagcatcgaaactccttattgccaggcacgcgaatgtgccggtatggcgctcgccaacattcgaacgttcgcatggttgagcgtgcgaatgccggcaattgcgaaatgattattagctggctctagtctaacgcggtatcgctatatcgtggcttatatcgggctgtaacgattgccgtgtgcttggtacgcaaaatccgatgcatggattttctacgggattcttctgcaggatttcttacaagattcccggcgcgatatcatgtgctgcaagccagtcgcgcaaatcgctgaattcgttgagactaaccgcatgatcgagcccacggtagcttttcgacgtgagaaacgtatgctcgtccagccaggcggcagccgcgaaaagctccggcatcggaatcacggtatcgttcttgccataaccgtagaacacaggaatattcaactccgcgacataactgtcggcaggcgcgctaccggcgacgattcccggagcaaggaagccggaaagtgagattgatgcggcgtaccgttccggatggacgcgcagcaattgaatcgccagcaaaccaccctgcgaaaaaccgatcggcaccacagcgcgatcttcggaaacattgcgcgcgacccaatcgtcaatggcttgggcggcagcataggcgtcgcgatccaaatcttcgccggaaggcacgcaatcatggaaccacgaatacgcgccctgaccgaaaccgaattcaccggaaccagcctcctgcagcacgagcggcgcgcgcaacgacgcgaaatcgttgtagggagctacgtaacgcatcatgtcggccaaatcagcctcattggaaccccagccgtgcaggcagaggaacagcgggcgtcgtggagccgcattaccacccccgcgcgaatactgcacgtgcgtgacctgcagcggctcgccgaaccgccccggaaccacctgcgatttgcgcccgatcagaccggtcggggtgtttggattgctggaatcgtgggaatcgctggtttcgtgctcgcgtatttcactcatgcctccaatatacccgtttcagcggggcaatcctcccagtcactggaaggattgggacgctgagcggcttgtaagcgggcagattctcccactgactggaggaatccacccgttgaaggcaaaaagaaaccccggtggagagaagaccaccggggagagaaaggagagagaagaagaaagggttcaattgtcgggaactgctgtgggttcctggtcggctcttttgctgacatctcctatataagcagacgatgctgagtacatgtctggcgttttctgggaaatatctgagaatttcaattccctcatgttttagattgtggaatggcctccagtttgccacgttatacgcgtgttccgtttccgcgcagttgtctcatcctccaggttcccacagttcgttcgcaaacaaactcatggcggatcaccggctcacgccagcttgctaaccccatcagatcagcggatgctagatctgcgcgtcggcgtccacgctcatcacatacacgttgcgtcgcagctgcttggattgcgcacgcgtaatgtcgcccgcctcgtacatgtcttggatcacacccagctcgataccgtagctttcgcgcttcacatcttccgcctgcgcctgcgcctccgcgctcgtgcccacattcgggcgcgacctcagcgtagcctcgcctcgtcggtaatccagcagcagtgccgaacaatgttccgtattgtatgtgtcacggcccatctcctcatacaggcggtcgattacatgttcgatggcatccacctgcaccacgcgggtgtgcgcgaacagctcgtcgtcgctgaacagcggggtagtgcggcgaatgcggctgttcacacgcttcaacatggtgcccatacgcctctgcaacgctctgaagcggcctttggctcgccagatggtgcgtccggaattatgttccgtttcaatatggcgcagtgagctcatgatctggtcgagcaggcgctcgcatgcttcgatttccagatcgtgcgctgccttgtcgtcgttcggcgtcgctttgactttcgccagtcgcgccttgacgtattccttctcccaattgagcgcatcgatctgcaattgcatatacccttgcggatcgatttctccgatgcgctgcttcagccgtgtaatacgtttcgtatacgagtcgatgatcatcagcaccgcacgacgattgtcgggtgtgactcgtcccgtcagttcctccacggtccgtcgcagcacttcgatggtgatttcagccattttcacggaagtgtctttattgcgattcggcgccagcagaggcagcaggaagttggcgagcagcaaggttacgacgatcacgccacctgcgatgaagatcagctcgtcacgcatggggaaccacgcgcctcccgtaatggtgtacgggatcgtgaacatcaacgacagggtgatggtgcctttcggcccgccgaacgtcatgaccgcggccgaacgccaacgttgcgccgtcatcttgcgtcgcttaccggtgacggtatctcgtgcgagacgcagcatcaacgaaatccacagaaatcgcatgacgatcaccactgcggaaaccgtaagaattgcaaccagcagccgccaattgctgacctgaggatcatcccagcttgcgctcatcgcattcggcagcagcatgccaagcagaatgaacaccgtgccgttgagcgtaaacgagaataccccccatacgcttgacgaaacaatgttggtgcgagcaacattcgggccgatgccggttcggtcgaaacggatgatcaaaccggccgtcactaccgaaagaatgccggaaacatgcaccgcttccgcacccaaatacagaatgaacggcaggaacaattccatcaaaatacggcttgtggtcgtctcccaaccgaaagatcgcaacgattcaaataacaggtcggcgatcatgcctactgccaagccgaaaatagcaccgccgaagaacgagaacacgaactgtatggcagaatcgcccacttcgaatacgccgctgatggccgctgcaatcgcaaactggaagccgacgatgccggacgcgtcgttgaacagggattcacccttgagcacgctggtttgccgttgcgtaagagcggcttccttgccaagcgaagatacggcgaccgcgtcggtcggtccaagcgcggcaccgagtgccaaagccgcggcaaggggaattgcgggccatgcggcatgcaggatgaaaccaacggctaccatcgtagcgatcgctagtccaatcgccaatgaaagtgacagtttaacggatttcaacagctcgcttttgtcgatttcatgcgcttccaaatacagcagtggcgcaatgaacagcaccatgaacagttccgggtcgagtgtgacgttcggaaaaaacggtaattgcgatgccaacgcacccaacgcgatctgcacaagaggcgtggaaaccttgggaatgaaacggctgataaaggaagacagcacaaccgcggcgataatacatacaatcaattcgaataccgccaacgtgcctcctttgcgcgcattttccaaactcttccagcctaccaagaggtatttatgggtgtgtttcgccttttgcttcacgtgaatggaaccgtatagtggcggatatgcagtggagtgacgacatgggacttgcgatcgagttggctcgtgaagccgcagcggagggtgaggtgccggtcggtgctgtcgtgcttgacgctgggggagcggtgattggtcgggggcgtaatctgcgtgaggcgcatgccgatccattggctcacgctgaggtcaaggccatgacgcaggccgctcggtcgcttggtacgtggaatcttgccgattgcacgttgattgttaccttggagccatgcccgatgtgcgccggcgcgtgcctgcaaacgcatgtcggacgaatcgtgttcggcgcgtgggatgccaagttgggtgcatgcggttcgatttgggacattccgcgtgaccctcacgtcggccatgttccggaagtcgtcggtggtgtgcgcgaaatggaatgcgcacgattaatgactgatttttttgctggaaaacggtaactcgattttgcagtcgcaagaaatactttccgaaagaaagaaacacgctcgatgacgtcaacaaataaagcttgacatattatcgaaggtgacaatacaaggcaatcgcaatatgtaaaggatgctgcaatgacgctcattcagaccttccatggcaacgctaccaacggtaccgaactcactgcggtctacgccgaacagccagccgcgaacgtggcgttcgcactcgtattccccggcaatgatctgccgcgacttgtgcactggggccgcccgctcgcagccccggcaaccgcgatcgacatgttcgacgcgcaaatgccacagcgcgtttccggcgcgctcgactacacctcatggccaagcgtactgcccacgcaatccgaatcctggattggcgcaacccgcttcgacgtacgccgcgacggcgtggaactgttctgcaagttcgcagtcagcaacatcaccgccgaaaccgtggcagctggcaaaacctacgtcatgggcgaaaaagacggatacccgagctggagcgtggccgacgaacccaagcagaccccaaccgttaccgtcaccgcagaagacgtggaacagcatgtgaaactcatctggacctgcgaactcgacgaaaccggcctcatccgtcagaacgccgaagtcgtgaacactggcgaaggccagctcgaagtcggcaagatcgaactcgcattcaccgtgccggccgacgccaacgaaatcctcaccaccaccggccaccatctgcgcgaacgctccccgcagcgccaggacttcaccctcggccgcttcgccaaagcatccatggccggacgcccagacttcgatgccaccctgctgctcagcgtcggcgaaaaaggcttcggcttcacgcacggcaacgtctactccgcacacgtggcctggagcggcaacagcgtgctctccgcggaacgcctgccatacaccagcggcgtgatcggcggcggcgaagtactgttcggcggcgaaatcagcctcgccaatggagagtcctacaccaccccatggctcatcggctcctacggcgaaggcctcaacgaagtcgcagcccgcttccacagctacattcgccgagtgcaccgcgactggcttgctgaacacaacatcgcgcccaagccgcgcccggtcattctcaacacatgggaagccgtctacttcaaccacgattatgacaccctcaccgcactcgccgacaaggccgtggaaagtggtgtggaacgcttcgtcgtggacgatggctggttcggctcccgccgcgacgacacctccggcctcggagattggcagatttcgcaggacgtgtggcccgacggcgacaagtcgctcaaggcgcttgccgattacgtgcacggcaagggactcgaattcggtctgtggttcgaaccggaaatggtcaaccctgattccgacctgttccgcgcacaccccgactgggtgttgaagcccaccgaaggccgtctgcccatgcaaggacgtacccagcaggtcgtggacctgaccaatccggacgcctacgactacatttacggcgcaatggacaagctcgtcggcgaactcggcatcgactacatcaagtgggatcacaacaaactcgtcaccgaagctgtctccccacgcaccggacgcccggcagtgcaccagcagacgctcgccgtatatcgcattttcactgatctgaaggccgcgcatccaggacttgaaatcgaaagctgctcttccggcggtggccgcgtggacctcggcatcctcgaagtggccgaccgcatttggggatccgactgcgtcgacccggtggaacgcgccgacatccagcgctacacctcgttgctcgtgccgccggaaatgatcggcgaacatgtgggcgcatccccggcgcactccacgcaccgcgccaccacgcaggaactgcgtatggccatggccttcttcggacacatgggcatcgaatggaacctgctcaaggaaccgcaggaagatatcgacaagctcgccgaatgggtcgccgaattcaagaagcatcgcgaatggttcgccgtagacgcagtcgtgcattccgacgcagccgatccggcagtgcgcttggacggtgtggtcatgcctaaccaagcggccgccatctaccgtttcacccagctcaccacctcgcagacctacccggccgcgccggcacgcctgcccggactcgaccctgacaaggtgtatgaggtgtcgccgcttgacgtgagcctcgacctcgccaagcaagacatcgccaacggacagagcccgctcggctggtggaaggccggaggcgtgaggatgaccggacgcgcgctcgccacgtacggcatccgcccgccggcactgcacccggcgcaagcagtccttttcaaggccgtgcttgcgcccgtcgagagcgctgaataagccgtaatcgcataacaaaaatcctccctgaacaaaagggaggattttttgtattgcaagacaatcaatcgcaatcaatcagccaacatattgccgaattgcctgtgatgcggccgccttggcccacaaagcccaatcgtggtcgggaatttcaaaatccactggcgcggcctggctatgccgatacatgttgatgccgttacgcaagtcgtcaatgccgaatttcgcgatgaacgacgattctccggcgatcatgattttgtctggcatggcaagattggcgatggtcgccaccagggtgccgagacggaagcaggtgcggttcaccagattcgtcgcttgcggtttgttcgcgcgtgcgtcacgtgcgaaatcgtcgaatgatgcgggatgtccgatgatttgcgaatattccgccgcgatcgagttgtcggacaggcattgcgcgcatcccctgtgtccggaaacacaacgcggcccatccggatcgaccagaatatgcccgaccaaaccgtaacttttatccggacagcttaccagctcgccgttgaacgtcaacgaatagccgacgcccgcgccgaacgtcagcaccgcgaagctatccaatccaacgcccggtccaaacaggcaggcgtcaaccaccaacgaatcgatatcgttgtaaattccggtaggcaatccggtcgcctcacgaaccatgacggaaagttccacgggctgcgaccagtgcatgaacggtgcgaacgtcaccacggtaccgtcgacaatatgcccgccaagcgagattcccacagcgcacggtttcggccagcccgccatctccgcctcgtcggaacagtcggtcgtcagttgtttgatcagcgcgaccacggtctgcggggaagcgtcttcgattttcagatcatggcatccggtgatgatctgcccgattgcgttgaccgcaactgccgaaatatgcgtcgcgttgattttcatgccaacgaaagatcgcgcattcgcaatcacctgcaatccggtttgcgggcggccgcgacgttccgtattttctttctgcacgaaacctttcggcagtttgccggccttgccggacggcatcggcgtctcctcaatcacgcccgcataaatcagatcgctggtaattcgggaaacagcaccctgcgaaagtcctaaaatctgcgccaacgtaatgcgtgaaatcggaccatatttcatgatgcaagccgcgactttatgggtatattccgagccttcaaaccactgtggcagaggtgaaaccgccatctgaaccatccttcgtgctcccgttcgcgcacatcgtgcgtcaaattactttctcagagtaacaaaatctcgtcgtttttgttttccgccccgcacaggcgcgctgagttgggaatgaaaaccgcccccctctataattctcagtaacggtggtgtggtaaggaagctgctccaccgtgatagagaaaaaatacaaaggagtcgagaatgaaacctgattccaccactagtgtaggtaaattcaggaggattgtataccgcgctctcacggccacatgcgcaatcgcgttgacggccggccttgcaggttgcggcaacagcaccgctggaaccgtcactttggatttcttccaattcaaagccgaagcagcggactggttcaccgcaaaagcaaaggaatttgagaaaacccatcccagcatcaaagtcaacgtcaacaattcgtccgacgcaaccaccgatctgcgtacgcgactcgtgaaaaatcgtgaacccgacgtcatcactatcaatggagacattaatttcggtatgctcgccgaagcaggtgtcttccacgatttcaccgacgacgccatcgtcgacgaactcaatccaggcatggtgaacatcgccaagagccttgtacaaaccaacgacaaatccaagaagcgcctgtacggcctgccgtatgcgggcaacgcatccggctacatcatcaacgccgacgtgtgggagcaggcgggtgaggatcccgacaatccgccgcagacatggagcgaattcatcgacctgctgcaacgcttcaagagcaagggtgttgtaccgatcgaagcgagcaccgccgattcgtggacacttcaggcgccgttggcgtcactcaattccacgctggtgccggaatccgaatatctttccctcaaagacggatcgaagaaattctccgacctgtggggcactgtcagcgatcagctggtcgagatctaccagaattatacgcagaagaatccggcagtcacctaccagcaggccacgcaggatctggccgcaggcaaagccgcgattctgccactcggcacctacgcgattccgcagattcgactcatcaacagcgatgccaacctgcggttcgcgcaaatgccggcaactgataatgccgaagaacagcaactcaccgcaggcgatgacgtgatcctgaccatgggcgcacacaccaagcacgagaaggaagcgcgcgaattcatcggcttcctgatgaacgacgaaaacatcaaggactactccaagcagcagtccgcctttaccccctacaaagacacgtatgtgggcgatgaagcgctgaacggtgtgcttgacttctaccaggcgggcaaactggccgacttctgcgaccattacgtgccagccagcatcaacatcgcaggcttcctgcagacgctggttcagtcgggcaacaccgaaaaattcctgaacagcatgcaatccgaatacgacaagatcgaagccagaaacttcaggtgagaggaggaacggacatgactaccgcacatactgcaaatactgcgaagaaatctgcaaaaacttccaagaataaggtttcgaaatattccaagcgcaaggtcgatccggcattttattggatgaccgttccggctgcgattctggtgtccatcttcctgtattggccgttcctgcagggcgcggcatactcgttcactaattcgcagggttacggtgattttaaattcatcggattgaagaattatattgcgatgttccaggattctcgcgtcggtcacgcgtacctgttcactattctcatcgcagttttgattacgctcggcacgaatattctcggcatgttcctggcggtgctgctgaattcgaaaatcgcattcaaaaatggattccgtgcgattttcttcattccgtacaccctgtcggtgctggtgatcggctacgtgttcaagtacattttcatgacgccgctgccggcgctcggccaggcgctgcatattgattggctgtcgacgtcgatgatttccaatccggatttggcatggttcccgattgtgttcctgtcgatctggcagggcgttgcctactccacactgctgtacttggctggcctacagaccatcgacaacgagatttacgaggcggccgcgatcgacggtgtgaacgcttggcagaacttctggcagatcaccttcccgctgattggcccgttcttcaccatcaacatggtgttgagcctcaagaattcgctcggcgcgttcgaccagatcatggcattgaccaagggcggcccggattccaagaccgaaaccgtctcgtatctgatcttccagaacggccttggcaatggcgaatactcctaccagatggcgaacgcggtcacgttcttcatcgtgctggcaatcctggccttcgtgcagctgaagttcttcagcggcaaggaaaaggtctgagcaagggtctgaaagtctgaaggtaaagaggaaatatcatgactagcgcaactgttgcaaagactgcaaagactggcgttcaagcgcaagcaaagccagagaaaatccgcagggatcataaggtcaactggtggctgaccgcggttgtgacggtgttgagccttaccgtgctcgtgccgttgtatttcgctgtggtcaccgcgttgaagacgccgggcgaggctggcacgttcagcttgccgaccacgtgggaatggcataatttcgccgacgcatggaataaggtgaactatccgaaggccgcacttaactccgcgatcatcaccgtgtgcgcggtggtgttgacgctgctgacgaacacgttcgtcgcgtatgctgtggcacgaaatatggataagcgattcttccgcttcctgtattacttcttccttgcgatgatgttcgtgccgttcacggtgatcatgctgccggtcgcgaaggaaatgggtacgttgcatcttgataatcagcttggtttgattattctgtacacgattcttggcatcggcaccaacctgtttattgcgattggttttattcgttcgattccgatttcgttggaagaggcggctcgtatcgacggtgcttccacctggcgtattttctggacaatcattttcccgctgatgggtccgattaatgccacgattgcgattttgaccgcactgtgggcttggaacgacttcctgctgccgttgatcacgctgactgatcagagcaatcagacgattccgctcgcacagtacgtgttccaaagccagttcacgtcgaactatccgatggccttcgcgtcctatctgatggccatggctccggttctcatcgtctacatcttcgcccagaagtgggtcgtcggtggcgtgatgaggggagccgttaagtgaacagcccagtggtctgttcataggctctccctgagcgagccgataggcgagtgaaggcagggacaacgcggccgtaggccgtccgttcaggaagtaacacttcaccgctctgagcgggactggcctatcccactccccagcgcgggacgttccatttccctttctggaacgtcccgcgttttttatttttgcggattggtttttcgcgtccgtaagaagcgtattcttttcttgctttgcacaactcgccgcgggaaagaaagaaaaacagggttgcataccataggggagtaggcaaaatcgatcttctgcatgaagctgacatgagctgaaaacgggcagagtcagtcacgaaagatcgaacgaaaatctaacaaacgtcaagcaaaggagctccacgacatgacgaatttcaatcgttccacccttcccgacaccgtgcgttccaacggcgcgaccccgaacccgtggtgggccaacgcggtggtgtatcaggtgtatcctcgttccttccaagacacgaacggcgacggcatcggcgatctgaagggcatcaccagccgtcttgactatctggccgatcttggcgtggacgtggtgtggttgagcccggtctacaagtcgccgcaggacgacaacggctacgatatttccgattatcaggatatcgatccgctgttcggcaccttggaggatatggacgagctgcttgccgaagcgcacaagcgcggtctgaagatcgtgatggatttggtggtcaaccacacgtccgacgagcatgcttggttccaggcttcccgcgacaaggacgatccgcatgccgactggtattggtggcgtccagccaggccggggcatgagccgggcactccgggtgccgagccgaaccagtggggttcctatttcggcggttccgcttgggagtacgatccgaagcgcggcgagtatttcttccaccagtattccaagaagcagccggatttgaattgggagaatccggaagtgcgcaaggccgtctacaagatgatgaattggtggatggatcgcggcattgacggcttccgtatggatgtgatcacgcaggtttcgaagactgttgataagaacggcaagctgccgggagaagacggctgcgagattgaggattatccggttggtgaggaaggctattccagcccgttcccatggtgctccgacggtccgcgcatcgacgagttccttgccgaaatgcgccgcgaagtgttcgaaggccgcgaaggctacatgaacgtcggcgaagcgccgggcatcactccggcacgcaacgagcatgtcaccgatccgaagaacggcgaacttgacatgctgttcctcttcgaccacgtgggcatcgaccaggaaggttccaagtggaacaccgtgccgttcgaagtcaagaatctgcgcgcccgcctcgccgaccagcaggaggctgtgaagaacgccggctgggccagcctgttcttctgcaaccatgatcagccgcgcgtcgtgtcccgttggggcaatgacacggaccgtgagtcgcgcgagctgagcgccaaggcgttcggcatgctgctgcacatgcaccgcggcaccccttacatttacgagggcgaagagctgggcatgaccaacgcacacttcaccacgctcgagcagtaccgcgatctggaatccatcaacgcctaccgccagcgcgtggaagaagcaaaatgccagtccgcagaatcgatgatggcggcgctcgcgctcatcggacgtgacaacgcacgcacgccgatgcagtgggatgcttccaggtatgcaggtttcaccgcgccggacgcggcgacggaaccgtggatcggcgtcaatccgaaccatgtcgagatcaacgcagccgaggaattcgacgatcccggatccgtgtacagcttctacaagaagctcatcgccatgcgccacaacaacgcgaccatcgcgacgggcgaatggaatctggtcgcggcagacagcgagcaggtgtattccttcacccgtaccagcggcgacgacacgattctcgtcatcgtcaatctcactgataggacggcgcaggtgcctgctgaggtcgcgcaactgcttgaggatggcgtgggcgagtcgcaggtactgctcagcacctatgatgccgtgcatagcgtaaagtcggtcgctcgcggcgagctcgctcgctgggagggggtcgtgatccagctctgatcgatctttcctataaactctctgcaaaaagcgttcgtgcgattcatcacgggatcgtacgaacgctttttctttatttgtattgtgatttatcagattatgtattgcgattattcctgattgcttgtgattacttttcgcaagcaatctcacttttcatcgcgaaagccgcatgataaggcagtttcggcagacgtacgcttacaataacgctcatggaacaaaacgaggttctcaaagcattgcagcgcgatcacgcagctgaactgaaactagccgccgaacgactcaagggcactgcgcgccacacggaaatcattccgtccaaggtgctgtccgacatgaccggacatgagattctgctcaagcctgagaatctccaggtcaccggatcgttcaagattcgcggcgcctacaacaagatcgcatccctgagtgatgagcagctggctcgcggcattgtcaccgcttccgcgggcaaccatgcgcagggcgtggcctatgcggctcgcgaacgtggtgcgaaggcaacgatctgcatgccgcagatcactccgccgctgaaggttgacgccaccaaggcgtacggcgcagacgtggtgctgtacggcgaggtgttcgacgaatccgcagcccgcgcccaggaattgagcgacaccgaaggcatgatctacgtgccgccattcgacgattacgaggtgctgtgcggtcagggcaccatcggccttgaaatcctcgaagacgtgccgaacgtcaccgacgtggtcgtgccgctgggcggtggcggtcttggtgccggtgtggcgctcgccatcaagacgttcaagccggaagtgcgcgtgatcggcgcgattccggagggtagcccagcatggaagaattcgctggccgcaggtcatgtggttgccgccgaccaggtgcgcacgtccgccgagggtgtcgccgtgaagcgtccgggcgatctcacgttcgcgctgctcaacgaattccttgacgacatcgtcaccgtgaccgagcgtgacatcaacgagatgatcctgctcatgctcgaaaagcacaagctggtggttgaggctgccggcgctgtgtctctggctgcgctcgagcacctcaacctgcgctcgcgcaagttcgctgaggcgaagggtccgcatgtggtggtgccgatcatgtctggcggtaatgaagacactgtgtccattggcgctgtgattcagaagggtatgatcacgcgtggccgcatcatgcatttcgaggtcgagctgcccgataccccgggacagctggtgaaggtcgccacattgctggccgagcagcgtgcgaacgttatcgcgctggatcacgaccagttcaaggcgtccagccattacgcgaatgccgtggctttgggcgtgacggttgaaacgaatggtcccgaccacattgatcgtgtgctcgaggcattgcgggaagccggtttccagccgaagcgcatttactgatttcagtaccgtttttcagtatttgataaccaataagggtcttggaaagccttgcgatgatttctgattgtcgcaaagcaatccaagacccttttgttgtttatattgcttgactagccgttacgtcattcggatttttgtcgttgaaaaattcggattttggtaacgaccaaccaaaaccggtgtaattccaacgatttgtgccggtactgcaagacgtacgagaaaacgtatttactgtgcggcttactgctcggcggtgatggtttcgtcgacgagctgcggcagggcgacggcgatatcgtcgtggataagccggtcggccaaccgatcgtattgcgtgcgtcccatgttcataatggtgatcggcacgcccgcctctgcggctatgggcacgatgcttgccgcgggcatgacttccagcgtggatccgatgacccacagttcgtcggcctgcgttgcgagtcgatacgatttttcgagcgcgccgtccggcagcgcctcgccgaagtagaccacgtcggttttgatgagtccgttgcatggcatgttgccgctgtagggcagtctgcgatggcagtgcggatcgggttcgttgtcgagattcgccatgatgtcggcggtgtcatattttgcatggcacttcatgcagtgcgaggtaccgatggtgccatgcagattgacgatgacgtcgctgctattgccggctttttcatgcaatgcgtcgaagttttgtgtggcgagcagcgtcagcatgccagcctgttccagtttgacgagcgctttatgtgcggtgcccggctgtgcggtccacacgggtgattccttctgccaacgccaggaatacttgcgatcttcctcgtggcaaaggaatgcttcgatgtcatacactttcgtttgttcagggtgcttagtccagacgccatccggtccacggaagtcgggaatacctgcggacgtggaaatccccgcccccgtcaatactgcgatctttttgctcatatcttaggtatagccgcacgacgtaacttctgatgtttcacgtgaaacagggaacatcgggcaatcaaattcgagaaaagcaatcttaataatcatgcatggaaaggaatgagaggtgcattatgactactgatattgcacaaaacattgcagatgatggcgctgatgcggccgagactgccgaaacgaccgagacggttacggcgatcggggcaatcgatatcgaatcgatggtggcgccgccgtcgccgacacagcttgccccgattccgacgccgcgagcagactaagttcttcccgcacactgatgagtttccggaaggctgccgagtgatttccgacttggaccaggatgattttggatatcccgtgaatatcgagcaggttacatacgtgacccgtcagctggctgatgacaccagtgttgatttgccgatgtgggtattcatgcctggcgttgacaatatgcccgagggcgcaatgccggaaggtggttggccggtgattgtgtttgtgcgcggttcggcattccacgagcagaatgtgaccgattactcgaattatttcgtgcgtattgccgagcaggggtatgtggtggctgcgctgaagtatcgtcacagcgatattgcgccgttccccgcgcagatgcaggattgcaagactgcggtgcgtttcatgcgcaagaatgccgaacgcttccattgcaacaaggatcgtattgcgctgtggggcgattcttcgggcggtcatacggtgctgatggctgggttcactggcaatcgcgcgcctgatacggatgcctatgccgaggaaagcgccgaagtgaacgcgatcgtggattggcatggccctactgatttcgcgaagatgaacttttatccgagttcgcagaaccacagtgatccgcagtgcccggaaggtgtggtgattggtggcgttgacgtgcttgaacatccggatttgagcgcccaggcttcgcctatgacttatctgagtgccgatatgcccactccgtcaacgctgatcatgcatggtggccgcgatcagttggtgccgttcaatcagagttgtcgcctgtatgccacgttgaaagcgcttggcaaggatgtgacgttctacaagctcgataacgcctgccatgcctgttacggattccgtagcgcttgcgcgttgcgtttggtgttcgattggctttccgatcgtctgtgacttgctgtgatgcgctgttgatctgctgattgccgtgttgttgcgttgtgtgacacgcggcaatcagctttttctgacgatttttgggttgtgctggagttggttttgcgatttatggtgtaagaaagacggatttcgacacgccgacgctttccagtgtttgcaagggttcgcgtcttgtttcgtcatgcctgatttgcgtggaatgggattgtgctgtaggtttatctcttgctgccgctcggcgagtggttccccggttggggtgcctcgaggcgggtgagcggtggtggtttgagaactcaagagcgtatttgtactacttctttatagtcaatgatcagggtgttcaggaacaagtgccgacagtgaacacctttattcgatcacacacagttgtcgggagccggcgtcgtctcgcccccgtatgagccgtacccgcgtcgttcgggaacatgcgccgtcagaccatcctcggccatgatcccgcggagcaccttctccgagacgccggtcctgagcatggccttgaccctgcggtacccgtacccgcccttggaagcggcgaacgccccggccaccaggacacacagcccggcgtatctgtcaaccccgggcctggcatggtggcagtaggtggccgctcgttgcgatgccgggcaagcatgtcatcgagctgagtgaacacgtcgggcgcagacggtcgaccggaagcgtcctctccctgttcgacaggcgccgcaggtcggcgtccgggtctttttctgcgagcctccaccacctcccgcatcaccgcgttccccagttccggctcctcgatccgccggcgtagggcctcggcgtcgccggcgtcccgatcccgtcgcatcgctggcttgctggtctggccggcgttcctgtttttgggccgcaacgcggccataccgccctcgcgatacgccttgacccagttgcggaccgctccgagccgtccggcaccggttcgatcgccttggtcctcgtctccagtgggatgatgggtttcgccatatggccggcatacctggaatcctttgccagccagcgttccaggcactgcctggccggatagcccagatgcctcaccacccgggccgtggtcatcggcgtggcggaatacaagtccaccgcgcgccgccgttcctcaggaccgaacatacgataatcctttcgttcagtctccaagaaaacgtccgcagccccttatcagaaagagaaccacggagataattccttgcctgctaattaagccatgaagtgatgtcgggccacacgtacggaccatcacgattcaactggtataaatcttttcaacattctctcgagcattgcgaacaacacaaacaatatgattgcaatgccaagatagacgataagagcgtcggcgtagacctcactgtacttaaagctttctgatccaatgatggtcgcccgggccatgatgtccatcacggagatcgtatataacaatgaagtgttcttcagcatatcaatcaccgaattcgaaatgttcggcacagcgttaatcgcagcctgaggaatgattatacgagacactgcatgtacggcaggaaggttcagtgatttgattgactccctctggccctcaccaaccgtgaagtaagcgcttctgaaaatctcgcaaaaatacgcactggcatagagcgtgaacgtgacaatcgctacagtgttcggatagatggtcacgttactgacgaacttcggattttgatgaacgaaggccacgatacggggcattccataacagaccacatacagttgcacaagaatcggagtagaacggatcagagacacaagcaggccaacgatcgtattcagcaccgggatccgtcgcagacgaacgacacagaaaagcattccgccgaacaaacccaaaaaagcggaaaccactgtgaccagcactgcgactggtgccgcctgaagaatttcatagaaatgattaaaagcgtattgggaatcgaatgacatatcaagcaacctttttcaatgaagcgtcatagactaccgaaatcaacttgtcgataagcgcggcaattacccagtaaatcagcataagagctacgtagatttccagttgccataggccaaagtcatccgcggaaagcgtgatcgccttctcataaatatccgtgataccgatagtgaacaaaatcgaagattgcttaaccgcagtgattaacagattggcgaaattcggaagacaattaattagagcctgaggaatgacgatacgcctgtagtaggtcagtctcgacaaagagagggatttcgccgcttgcacttgtccttctgatacagcatcgaagccagctctcatcatttcttcaaagaaagccgacaggctcaaggcaaaggcaatcaaggcatataccaggggatcatccgaatcgacatcgacaccaagggaagcaagaagcgcgggaagagcgtagtaggaaatgaataacagcagaagcaatggcgtgccacgcatcaaccacacataacctgtgacgatcatttttatgagtcgattgcgggaacgcccaagacaggtgagcagaatcccgatgaacatacctagaaccacagattccagaactatgcctagcgtataaggcaaacgcgttagtagcggcgggaatgccgataagaatgccgatgcgttgaaataagtattcattctacttactcctcgccgtgatagcgacgcaggaattcctcggtacgctgttgttccggtctgttgaaaagcttctccggggtcccctgctccacaatggaaccgttttccatgaaaataacgttagaagagatacgtctggccaaagccatctcatgggttaccaccaacatggtacgcccctccgaggcgagctgctcaatcactttctccacttctccaacgagttccgggtctaaggcacttgtcggctcatcaagcagaagcaaatcaggattgaccgcaattgctcgggctatgcccacgcgttgcttctgccctcccgatagatccttgggatatgattgagccttatcagcaaggccgactttgtctaagagttcaaggccgagttgatatgcttcctttcgaggcattttctttgcataaatcaaagcctcagtgacattctggatggctgtcagattcgcaaaaaggttataagactggaaaaccatagcagtcgcgccacgtacgaaagcaatgtctttacgatctctggtagcaaggtctatagtctttccagctaaagtgagtgttccggaatcggcggtttcaagaaaattcagacacctcagaagcgtggttttgccggagccactcggtccgataatagaaacaacctgtccctcattttggctgaatgaaactgattttaaaattgtattgccgttaaagcctttaaccagattcctgattcctattgacatgtcatcctctgtttttgtttatgcaagattgcgaaattgccacatccatcactgcagtcgatcgataacagctttgtcgaaggatggtccttcgaatggatcaccgaaataatctctataaatcgttagcagcgcttcgcaggttggcgtaggaacccccaatagattccccaatgcaacaagaggggcaataccatatgggatgtcttcttgaatgaaccgatgccgtatatctttgggaccaatcaatgaggaatagaccggattgtttttaaataattcagtcaatgtgaggtaatggcttccccaaaacccgttaagttgcgccgtgatgggtatgtacgggctttttaatgcgtttgcaagattgtgccgttccccatcaatatgcctgacaagttgctctgtacgttctgtgaatccgtcggacagcatgtaatactcagatccgctttcgattcgagtcatattcagaaggcaaagtggagcatggatgatgggattcggagccatcaaagaggtggcgaacaccgtgtcatagttcagcacgttcgaataagcggatgacaaaaaacggttagtttcctcatgagcgtccgaattaatcgcataggcgatctcgatagatgatttgagtcctttgaagagcagcgaagcactctgttccggtttttcgttatcgaacatgaactttgagacatacggcattcccgtggattcagcaatcgttaaccgttccttctggatgccatcttctccagccaatatctggaaagcctcatacgcgccccaattcccgttgaacacgataagacgaattgccgagccgggattattttttgcccagtctcgcacgttcttaaaaacatcattgtgattattagcccatgtgcagataataatgaagtcggcaccatccaaaacttcagccagattatcgctcgcatgaatcttccataatccatcaatcacgcctgtggaagatattgcagagccctgcaacgccgccagtttcgccgcattacgtgtatataccatcgggttatatccgagagagcttacatgcaaagccgccgcgatgccggtgtttccagcagacagaatagcgattttccccataacaccaccaaccacaaaatgaatttttaaaagacataaatctgccgtacggggaaaccgtacggcagaggcttcaatcgtcaatcacttccaatagataacgctatcgaccttgtctgcgcccggtagtttaaagacgtcttcgccataccacttctcggacagcttggacaaagtgccattattgcggaaatcatcgagaaccttgtccacatccttgcggagcttcgcagtgctatcgcccttatgatacaggaacaccgttgggaacaatccgatggaatccgtcgtagtcagatcaaggccgagttcatctttaatgctttggaaagacgtgtaagggtagatcgccgcgtcatatttgccagcaccgacggctttaagcacatcagcgaccgtggcggatttttctgtagcaccttcgaactcaattttgttgttaggatgcttttcattgtattgattaataagagtgtagcgtgcatcatccgtcggaatcggtgcaagtttcttaccggatttcgcaagatcctccagagaattaatgttcttctcatccgatcggataatcagtctggcatcactgagacccgtaggattttcggaataatcaaaagtcttaaaacgctcggcagtaccgtagaaagagcacgttgccgcatcatacttgccactctacaatcccgtaagcaaagcatcctgagccagcgcggtatacttgaatttgtactggggcagtttttcatcaatcttcttcagaagttcgaaatcgtagccagtgtagttattgccgtcaacgaatgtatacggttttttccctgtcacaccggcaatattgacaacctgaacatctttcgatgcttctgtatcattcttagatgttccagagccgcaggccgtcaaggagaaaacggatgccgccgctgcgatcacggctacaatacgcttattgatgaggctgttagacatttattttcccttcctcttggcataactatccaactgatgagaagcatgctatctgaggaatgaacccaaaatgcctttcgcgctatcttatctttaatggagaaactataagcgtgatttataaacgccaacgagacaaacggtctcggacagatcagacgctaccgaagtaaataacgcaaatacccaatcagcagcctagaagcaaaagccaaaaagatgaatgaaagcaaacccatatccaacttaaatcgaggtgcgagcggattcccagactggcacggcggctccaatgacagacaacagaaatagcagcggaacaggtttctcatgagtgtgaagcccaatcggaattccagggactttgatgagaaatgtatggagccgaggcggatgattcaatgacggcaaggagagactgtttggggagtatcgacatgaatgacggtatcgtgcgtcgtccacggtacaggggatggacccgtgatcgctacgactgcagtcgggcttctccattccattcccatgagagggcgcacgctccaaagacgtgcgccctctcatgggaatggaatggagaatgaaatcaacggtcttctatctggacatgacccccgttctcgcaattgaccccagccagtccagggatggcttcggatgacgttcgaaggtgtccttgtcccaggaagccagaccgaacgtcggagcgaacgacccccactcgtagttgtcgagcaacgaccagtggaggtatcccctcacgtcgatgccatcgtccatcgcgtcgtgcatgccggctatggcgtcgaaggtgtagtcgatcctctggcggtcgtccgcggtggcgatgccgttctcggtgacgattatcggcgtgtgcccggcgacgtcccatgtgtgccggatggcgatgcccaacgccggcgggaagtactcccagccggtgagggtgcgttccgcgtcctcggggatcggcacggggccatccttgccgatgaaggtcctcagataggcctgcacgccgataaagtcgtccccggccgcggcttcggtgaagtagtcctcgcgcgggtactggtattcctccatctcccgttcgcatcccggcatggcatggaacgcctggcaggcgatggtccatccggacttgatccgagggttcccggacagtatttcccgagccttcctgtgcgcctcgacgagcgtgacggagatgtccggatcgggcgcgggcagcgaggcggccacgaagtcgctgccttcggttccgccacgggtcagcgcgaccatgttcggctcgttgatggtgcatacccaggtgacgtcgtggagtatcgtcatcacgtaccgcacgtacctagcgaagtagtcgacggcatcggcgttgagccatccgcccttggccgcaagccactgcggcagtgtcatgtggttcagcgtgaccatgggctcgacgccgttctgatggcacacgtcgatcatatggcggtagtgcagcagctgcgctttggagaagcatccctccgcaggctcgatgcgggcccattcgatggagaagcggtacatgcgcaatccggcgtcggcgagcattctgatgtcctcgccgtagcggtggtagctgtcggccgcgtctccagacggttcgttgaggtccgtgcgttcggcatgctccctggcccaccagtcgctcgcgacgttgttcccctcgatctgatgcgcggctgtggatgcgccccagatgaattccggcgggaactcgtattgttctttcatgacatgtctttctatttgatgcccgttccggcgacaccttggatgaagtagcgctgcaggaatacgaacaggaggaggatcggggtgaccaccagtaccgctccggcgagcaggacgctgtagttcgtggcgttctggccggtggagtagagggacagtgccacgggcagcgtgtacttctcctcggtctgggccgcaaccaacggccacaggaagttgttccaggaggacaggaacgtgaggatggacagcgtcgccagcggcggcccgcactggggcaggacgatctggaagaatatgcgcagctcaccggcgccgtcgaccctcgcggcctccatcagcgcgtcggggattccggagatgaactgtctcatcaggaagactccgatgggctggcacaggaacggcaggatgagcgccgcgtaggagttcgcgagtcccatgttcgagatgatcacgaacagagggacgaacgtggccacgctcggaaccatgagcgtcaccatgacggcgccgaacaagatgttcttgccggcgaagtccatcttcgccagggcgtatccgaccatggagcagaacaccatgttcccgaggacggtgatcacggcgacgaccatgctgttggtgaagtaggtgccgaagttcagctccccgaaccatttcgcgaagtttgcgagcgaggcgtgctcgggcaggagcttcggcggtttggcgaggatctccctctgggtcttcaacgagcccaacgccatccataggaatgggaagatccagaagactccgatcaccgcgaggacgcagtaggagaggccacgtcctttgacgaatcggcgccagatcggctgcttattgctttgcggcttcgatgccgcgactgtcgtggctgtcatctcaatcctccttgagaatgcggaactggagcacactgaccagcgcgatgatgatgaacagcacccagctggctgcggaggcgatgccgtactgtccgaaaccgaacttctggtacacgtagtacgcggcggagagcgtcgaatcgagcggtcctccctgggtcatcacgaaggattcctcgaagaactgcaggtaggcgacggaaagaagcacggcacccagcagcagcgtgggcttgagcagcgggagcgtgatgctacgaaaggtgcgccatttgcttgcgccgtcgatggccgcagcctccttcaattcctcggggatggcctgcaggccggcgaggaagatgatcatcagcgttcccatgttgcgccagatcgtcatggccatcagcgcgggcagggcgtagcgggtgtcgtgcagccagtccggtccggcgataccgaagacggccaggagcgagttgagcaggccgtccttctggaggatgtacctccacacgacggagaccgcgaccacgctggcgacaaccggcgcgtagaacacggccctgaagaacgcgttgaggtgcttggatcccttgttgagggccaccgcgaatgcgagggcgatcgccatggtgatcggcaggccgacaagcacgaagattccggtgacgcccaacgcgtgcaggaaacggtggtcgtggaacagggtgatgtactggtccagtccgacgaagttgacgttgaacggggtgcgaaggtccttggaggtgatgtcggtgaaggacatcgccatcgaggacaggaggggaatcagcatgaatacgcagaacacgactgcgaaaggcaaggcaaatccccatgcgagaatcgtacggcggcggcggaggacgttgcccgagccctccgtcttcgtctttcttgtcccgaggctcatgggatcagtttcccgttccgatggagtcggcttcggactgcaggttcttcaagccctcgtcaacggagacctgtcccttgtttatctgctcgaggatgcggtcggcagcggaggacacctgcgcccaggtggacagcgccggcggagccatggtgtgcttcagctggtcaccgaacgccgcgagcttgtcgttgccggagagcacgtcctcatcccatgccttctgagaggcgggcaggtcggaggacttcttgtaccattcgacctgcacctcgggcttgcttgcccactggatgaacttccatgcggactgcttgttcttggagtccttgaacgtcacgaagttgctgccgccgacgaaggacgtggcaggacccgaggattcgttcatcgacggcagaatcacggtggcgtacttggattcgaagccatcgccgcccaattcgttgatctggctgacggcggtcggcccctgcagcatcatcggtgtgctgccggatacgaaattcgctatgtcggcgccggaactcacgtcggcattgacgtccgctatgccatccctgtagaggctagtggtaaagttcaatcccttctttataccgttatcttcgaaagtccatttcgtctgttcctcattagtcagggacgcccctgccgagtaggagaacggcagagtcccaaggaacgcatcagtgccagatggattgaggttcatgccatatttgaccccgtcgaccttctgcatgtccttggccatccgcttaagctcattccacgtcttcggagctttgttccaaccagccatcccggcgatgtcggtacggtagtacagcactcgggtgtcgatgtaccaaggcacgccgagctgtttcccgtcgacctggccagcagccctagacccgtcggagaagtcggacatgtcgaggttgtcaggcacggtggagaatgagttggagaaatcggccatccaggtagtgcccatctgtgcaaggtcgggaccgttgcccgcggcgatggcggtctggagtttatcgtgcgctgaggaccatggaatcgcggtgaccttaaccttgacgtcagggttctctttctcgaatcccttagcgaaatcatccagcagatcgccctcgttgcccatggcccagatagtcaggtcgccggtggccttgcttgaattgatggtcttgaccgcatcggaatcggaatccgcgttgttcgcggaccgtccgcacgcggacataccggcaatcatcgccacactggccatgccggccacgaccgctttgaaaaatggcttcctcattaaaatctcctttgattcatatcaatctaaccgcttagattgatattacaatttaagcgcttagatttaaggaagtcaaagcgacacgcccatatgatttatgcgcttagattttttgattgcatccgcagctgccgcgcacaatgaggcggaccgggagtactcgtctttcagccttttcccaaggctccccgttcctggaaagcagcatgcgagccgcctcgcgccctatgtcctccatgggctggcggacggtcgtcagctgcggttccatcagccgtccggcgaggattccgtcgaatccggtgacgatgacgtcgtcgggaacccggacaccggcctcctcgaggagtctgatcacgccgaaggcggtctggtccgtgccgcagaccaaggcctgcggcagtctgccggatcctatcgcctcgcacagacccaccatgtattcatcggacgtggcgaaggagtcatccagcagcgcgtcgctggaatcgagaccacgttcctcgaggcatttccggaaggcgacgtagcgggcgacgacgtcgtccgaatcgaagccgccgacgaacgccatctcgtcgacatgatggacgtctacaagatggtcgacgatctgtctcattcccgaggtgttgtcgcattgcaggtacgcggcaggcaggttctcgtcggacacacccaccatcacaagcgggacggtcttcgccagcacggcgaggggaagtctgtcgttatatccggtcggcatcagagccagcccatcgacccgcccggcgatgtcggtcaccgacttatggtcgtccctcgccaacgcagcccccatgagcatgcccttgccgcttttccagcattcaagctcgaaaccgcggagcacctcgtcaacgtatagaggataggtgagaacgtctggctcgtcgtcatcggacatactggccggcatggaggatacatcggacctatcttcttcgagaccactcccctgcggcttctccagcagcatatcgaacgcgtacatgcccaacgtgcccgtcctgcctttggcaaggctacgtgcgttgccgctgggaacgtagccaagctcctcggcgaccctgaggaccttggccttggtatcatccttcactttgtcgggatgcctgaaggcgaaggagaccgtcgcggtagacacacccgccttctctgcaacgtcatacaccgtaactcttgccataagaccagtctaagcgctttgacatatgagacacacggactgaagtccaaaagcttcctctgaccgttcgcccggaaaccccggggtccgggctccagccggcaggccggcacaacaaacaaaaaaaaagggggttcccggagccgaagctcgacgggaacccccaacgaaagaatgcggcggcgtgctactctcccacaccctctcgagtgcagtaccatcgccgtgccaggccttagcttccgggttcggaaagggaccgggcgtctcacctgggccatgatcatggcccaggtgagacgcccggtccctttccgaacccggaagctaaggcctggtcgcggcgatggtactgcactcgagagggtgtgggagagtagcacgccgccgcattcaacttatggaccttccggtcgagccccatcggggttcccggaaggtccttttttattcccgcgcacgggtgtcttcctccattcggtggagggaaacggacgccggaaggcccgtgggcgggaggattgttccagtgagtggaggaatcgggactactgctgattcaaccaggcgtggagtttcagatgattgagcgcggtattgggatcatacgtatcatccaagcgttcctgatacatggcaaccagttcgtcgctgcgtcccagcgcttccaaagcggcctcgcgaatcgtctcccactcgtagggcaccacttcttcggggaacatcatcgtgacctgattaggtttgtcccgcaacaccagatcgacaaaatcgagcagatcctgccaacgttcggcagcaatcagacgtgccgcatacgcatcggcgagcggttcggaagtatgattgtcacgcaggaaacgatcagcctcatcaatgtcaccactaatccgcagcaagtcatgtcgcaaaaactgtacggcatgatcgaactgattctgcgcggcctgcgcaatctccttttctgaaagcaaagcaggatcaagcatcgcgagattattcaaatcttctgcggataaggaatcagcgtcttcaaacaaacccaaatcggttttcacttgcgcaacagactgcgaatcagtttgcatgtcgcggctgtcggaatcatctgccgagtttgccaacgtcgaagcagacgtggcgaaatcactcatcgtggcaatgcccttattcaacgcatcgtaagcgaacatgcgcgtatcgtcccattgcgcgaacgacaggccgcacgaaagcagttcaaccatctgcatggcgttaagacggaaatcctcattgcaggccacttgcgtgatgatattcagcgcctgttcgccggtcatgggatcggcattgcaggccacggcgtccatgtacacgcgcacggtctgaatcaggtctttcaaatagtcgaagccctcattgtctcgatctgcgacgttgccaacgaatcgcgcggtcatttccactgccttggcgagattgccgacagcatccagccaacgtgtgcttacgatggcattgccgaccaccgcgtccacgccggaaagcgcctgcgaatcaagatggaacgttggcatgtcgattcttggaatctccacgccggtatcggtgcgttcggctgtgggcaccatggcggcgatggaatcgaaataccattgcatgggcatactgattaccatgtccgcgtcggaaagctgtgctacgggcacattattgcggttttcggcatcttcctgactggcctcgcggatcatgtcgttccataggaacgtcgggccgtcggattcgccggaatgcagccatccattgttgatgtactcggtgagatcctcgacttcctgcagacggttgatcctaccgtgttcgttgctcattgcatgcctttcctttaaaaacatggattgcatgtgccgcgttgacgacgggtgcttcgtggaacaagacatatccttattcagcctatatcatgctgccgttgtcgcgcatgtttttttgctcttttcacggcgaaaagccgatgattttgaatagtcgcttgaatgctgttgcatttctttttgattgagcgaaaagattatgccgaaatactgtgtgaaacgatgtgtgaaacatgatttggaatgagcggcatggccgtacggcggcgcccggtagaatggcagtgttgccgcaacagggcggctttccatcgaaggaaaagggaatgatatgaaggttgcaagcggtaatgttctgtggcgtcagcgcaagcgtaattggtgtcgtacgccgttcacgttcaccgtgtacatgctcactgatcaggaaatgagcatcaaaaccggcatccttaacgagaaattcaatctcatcaaactattccgcatcgtggatattagtgtggagcgcacgttcctgcagcgcctgttcggtttgagcacgctggtacttgatacgcgcgaccagtcttccggcaacggtgttgtggtactgaagaacgtggtgcatggttttgaggttcgccgggtgatgcaggaggccgtggactcatcccgtaaggaaaatggcatgtcagcgcgcgaattcctcggaggtccgggcggtccggggccggaaggacctggcatgggattcgatgcgcctgatatgggcgatttgtagagacgcgtggtagtttcgtttcagcgcatacgaaaggcgcttgacttgagctggtttttctggctcgagccaagcgcctttctttttctggagagtaccgccgcggcggtatgggaatcgttatatgtcctatggggcgctcatacaacgtcctctggggcggtcagtacttgttggcgccgctgccgacgaagttgacctggaagccgcggtggtagtgcaggaacatgtcggcgccgtagcggtcgacagggcggtgggtgaacagcatacggatggcgaaagcggtctgcacgtcttccggcaggttcatgaattccttgtgcgcatcccaatacgggttcatggtgatggctgcgtccggcacataggcgtagccgtaaccgtcttcgttcacgtagcccatgaacggcaggtcccaagcgttatgcgcggtgagggctgccttgaattcctccacctgagcgagggcttcgtcgctgatgccgaggctcttggcaacctcgttggctgcggcggtcttggcgtccgcgtcctggccgaacatgttcagatccacgttgatgacggtcttttcatctgccatgatgaattcctttcctgcgatgtgttcgcataatgtcatgaacatcagtagtgttcgttttaatgttcgtttagataagcaaacgaacatcatttcttgaagtctggttcatgttgttgatggatgcttgctgtatccgtgactaacgatagcacgcttttttagctgtgataccgcggaaaatactgtttttgcaattgatgatgctgggaatcgttgatgttgcaatgattgcaggtcttgaaaatgacattgtaaaaagtaacattgagcgtgttctttttgttctgcaaaaacatgttacttttctgttcaaacgaacatctgcatatgattgtagggtggattgcacgtgtgaaaaggtggtttgaaaaggcttgagcgatcatcgacgatgcactgtgtcactttttgcggatgaggtgacattttccatgtctgaggcgtggcggccgtcggttcaacaatgacttttcgccacgtcagcaattttctggaactagaatgctgggttgccggtgaggtgacggtagagttcggggtcaaccggtttcgcgagtttcagtgtggaaatcacgacctttgattgggttccgtcatctgcgatattcactgactcatgcgcatcgtctacagctactgccgaaccgacataatagtaggatttctccttttcctcggccttacgtcgaataaaaatgggaacaaaatgacgattcttccattccgacgtatgctcggttccatcaagcagccatttgaattccagagattgcaaagaacgattgtttttgctgaaccattcaatttctccaggattcaagaaacgatcgccatactggcttgcctcatatttaatgaagatcggcaaagaattcgtgtcggtgtcaagcttatatccgcccacattctgcggaatctgctcatccttccacgcgcacaatcgcatgacatcggcaagactatatttctcgccatatatgaacccatgatccggcatgatgcgacgcttgcgagcttcccttgacagtgcaagcgcattgaacaagctggcttcgatggtatctgtaaagaacgttcggaatgttgcgtgatgcagcattgactcgcattcctgggtcaatgcatacgattcattgtcgcgcatacaaaccaaagaagtattgccgaaacgagtgcgattcgcacttgtgaaatacgaataattcaacgtggaaaaagcagaaccgcactgctgaatattattatcgacatacggaaacagcgtagacaataatgtttgcaaatcaaacaaactcaagctgtgctgtgtggaaaaacgttcaaacagtaacgcatcatcgttggaacaatccggattgatgcgacgccaatccaaatcgcacaacaccgcaagaatcagcgactcatgcgggcgcaaaccacgcaactgagttgcagccaacattttcagcacaccagactgcgcgtttgacaccggttcaagctgctccacatacgaagccgacgcatgcttgccgcgcgacagactcttctcacgagagaccacgaacgacagataatcgttattcttcgaagccaacgtgaacactaaagacgcatcgcgatgcgcgaaatccatcagcatcggaatacgacccaactcatagcgcatctgctgatactgcttgctcagcagcttcatatccgacaaatcagcggtatcgagtgacgcgagcacgcgctcgcgggcgattttatcgaaactgatcgaagaaatgccgatggactcgcgttgaagattcttacgggccacatcacgatcgccagtattgccatacaatgcgatcggaatcaaataattattggcgtaattgccaataaaatcaatcactacaaccgaatctttaccgcttgccttacgtaaacctcggccgagctgctgtgtgaaaataatgctcgactgcgtttgacgaagcataacaatttggttgatatgaggaatatccacaccttcattgaataaatcaacggtgaagatatagtcaagttcgccattttcagctgtttgacagcttcgtcacgttcggcttgcgagttttcgccggtaatggctttcgtgcgatacggtcgttccacctgctgattcacctgctcgttgaacatggcggacagacgtttcgcctcatcacggcgagagcagaacaccaaaccgcgcacatcggttccggcttcgctgtaaatctggattttgtcgatgatatagcgcacgcgattagggtcggtgagctgttcgagccaacgggaaaactcagtgcgatccttgtctgtcatggaatcagcggaaacctgctgccccataaacttgctaatgtattcgccaaccccgtaatagtgggacgggcagagcatatcctcttcaagcgcctgctgcaagcgaatctcatacgcaacgttattgccaaataattcaactgatttcgccaaggattctcccgtctctaagcggagcgtaggcgggagatgaattggcgtgcgttcgcatgttataatgatgttcagtcgtacatgttgtaatcgaggaggtgacaatggaattggagtcgaatcatcattcggtgttcctgttgcattatcatctcgtgctcgtcgtgaaataccgtcgcaaggtgttcgacgatatcgtttcggcgcgtgcgcgtgagatattcgagtacatcgcacccaagtatgggataaccgtggaggaatggaaccacgacatggaccacgtgcatgtattgttccgcgcccagccgaagagtgagttgagcaagttcatcaacgcttacaagagcgcgtcgagtcgtctgctcaagcaggagtttccgcagattcggcagaaactgtggaaggagtatttctggagccgcagcttctgcctgctgaccacgggcggcgctcccatcgaagtggtacgacgctacatcgagaatcagggacgcaggtaggaggcgcgtcatgcaggtcacacggcattgcgcggtcacgtaccgcatctacccggacaaggcccaggccggtctcatcgaccggacgatagggtgcgcgcgactcgtctacaatctcatgctcgaaacccgcatcgacacgtacaatcgcaccggcaagtcatgcaaccccacgcccgcccagtacaaggacgagtatccgttcctacgcgaagtggacagtctcgcactatgcaacgcccaattgaacgtggcgaaggcgtacaacaatttcttccgcgaccccaagcatgtgggcttcccgaaatacaaggcgaagcatcgcagcgcatggcggtacacgacgaacaacaacaaccgcaacatcctgtatttcgtcaaattgaggtggacgtgttcggcacttaatctggacaccgtcgggtggtggtttgagaactcaagagcgtatttgtactacttctttatagtcaatgattgccagttcatcgtccgctcgttcgcgagtggccgggaggccttgaaggacggtgaggttttcgtgcgatgcgcctttccttataaggcgatcgtcaattttcttgtttttgagagtcacatgttggctttctgcaaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatatggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccctttgtggatggagccgtctaaggtgagactcgtgattgggactaagtcgtaacaaggtagccgtaccggaaggtgcggctggatcacctcctttctacggagtttttcaggacgccggtccggcgtccgtcgtgtggcccatgcgccggggatcgtctccggagggtgtgggcgtgctggcgtggaagaggtcatgggcttcgcgggttcctcttgggggccttgcggggagtggtatgggtatgcttttgggttcccggaccgccacccgcatccgttttgggtgcgtgcggttttccggatgcccctggcgggacgccgtcggccttgcgggccgcgggtcgggtccggtcggggcgcgtggtggtttgagaactggatagtggacgcgagcaatgcgatgatgtgatgtcatcgtttgctttatcgcgatttcgccaggcttctttttttggagtctggtttcgagatcgatcgttttgtgatcattttttacagtgtgatgatttgtcgtctggcgtttgaagctatcattagggttttttcggggcgtgtgccgccctgaagggcgtatggtggatgccttggcagacagtaccgatgaaggacgtttgaggatgcgataagcctcggggagcctccaacatggcttcgatccgaggatttccgaatggggcaacccgccggccgtcatgggccggcacggaaccttgttgttccgggggtacgcagggaagtgaaacatctcagtacctgcaggaagggatactccgtgagtagtggcgagcgaaagcggatcagaccaaaccatgggcgcgtgatacccgtcgggggttgcgttcgtggtgttgagggagcgtgtgtcccggttccgacggaccgggcgggagtcataaaacggcttgccaggggaacaggcttgaaggcctggccgcagagggtgccagccccgtacctggaagcttgccgtcttccgatcatgtgtcccaagtagcgcgggcctcgtggaatcccgtgtgaatcggccccgaccgtggggtaagtctaagcatacctgtctgaccgatagcgtaccagtaccgtgagggaaaggtgaaaagcaccccgggaggggagtgaaagagttcctgaaaccgtgcgcctacaatccgtcggagcctccctggtggggtgacggcgtgcctatcgaaaaatgagtctgcgagtcagtggtgcgtggcgaggctaacccgtggtgggggagccgtagcgaaggcgagtctcaaaaggcgttttgagtcgcgcgccctggacccgaagcgggatgatctagccctgggcaggttgaagcgcgggtaagaccgcgtggaggaccgaacccacctgggttgaaaaccggggggatgacctggggctaggggtgaaaggccaatcaaattccgtgatagctggttctctccgaaatgcatttaggtgcagcgtcggttgattgcatcgcgggggtagagctactggatgcttgcgggcccgtgtcgggtaccaatagcagccaaactccgaataccgtggatgtgtattccggcagtgagtcggcgggggataagctccgtcgtcgagagggagacagcccagatcgtcgtctaaggtcccgaagcgtgtgctaagtgggaaaggatgtggagtcgcatagacagccaggaggttggctcagaagcagccatccttgaaagagtgcgtaacagctcactggtctagtggttccgcgccgacaatgtagcggggctcaagcacaccaccgaagacgcggcagcggcctttgcggccgttgggtaggagagcgtcccgcgtggggcgaagcggccggggaaccgtgccgtggaccgcgcgggagtgagaatgcagacatgagtagcgagagacgggtgaggatcccgtccgctggatgaccaagggttccggggccacgttcgtcgtccccgggtgagtcgggtcctaaggcgaggccgacaggcgtagtcgaatggatgaacgggtggatattcccgtaccggcggcgtaccgtaagagccgaacggatgagtactaacctccggtcgcgtggcgtcgttcccttcggggttcggggtccgcggtcgttgggagcgtagtcccggtaggctagcgcacaggggtgacacggaatgggagccggccgcggaggtggttttccgtggtcaagcacgcagcccgtcccataggcaaatccgtgggacgcatagggtgaggtgtgatgatgggcgtcctttggacgcgatatccggtggtccaggccgtcgagaaaagcctcggcgcgaggggcgtcgccgcccgtaccccaaaccgacactggtggtcaggtagagaataccaaggcgatcgagcgaatcctggtcaaggaactcggcaaatcactcccgtgccttcggtataagggagacccccgggcgtgaagaggcttgccctcggagcgttggggggtggcacagaccagggggtagcgactgtttaccaaaaacacaggtgcatgcgaaggcgcaagccgctgtatatgcactgacgcctgcccggtgccggaaggttaagaggatccgtcagccccttttggggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcgcggattgtgtagcataggcgggaggcttcgaagcatgggcgccagcccgtgtggagccgcaaggtgaaataccgctctgttctcgtttgacgtctcacctcgaacagtcatcctgttcagggacagtgcctggcgggtagtttaactggggcggttgcctcccaaagagtaacggaggcgctcaaaggtccgctcagcccggttggcaatcgggtttcgagtgtaatcgcacaagcgggcttgactgcgagaacgacggttcgggcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacggacctctggtatgccggttgtcgcgccagcggcatggccggttggctacgttcgggagggataaccgctgaaagcatctaagcgggaagcctgctccaagattaggattccttggcacttcggtgtctgtagcccgcatgttgaacacgtgttcgataggccggaggtggaagccccgcgaggggtggagccgaccggtactaacgggcgaacgcggcacactctttccgacccgcttgctgggtcgggtctcgtcctgtggtggtttctttcgttggatggcaaggagcattgtttcttgtggtcacgatgacgataccggtgaagcgtttggttgttcgcgtccgttgtccggttcccggaccgccacgatcggaatcggtcgtgtggtatggttccggttctgccggccgatccttgtggttggccgttatattggttttgcggtggtcatggcccaggtgagacgcccggtccctttccgaacccggaagctaaggcctgggtaatcggatgcagtcagagcctgcatggctttctgcctctcatcctcactaaaatactgcgactcctttataagttgagaataacggttatggtcgttaatctcatacaaggttttatccttcttcggattgttaatacctcgtggcaaatacatgcaattacctaacgaattacccaaaatatgtcgaggcctcgaagaatccgccgcgtcaatacgcttccgagcaatgatatgctccaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgatcaaaggcctgatcaaattgttcttccgaaatacgcgtgccatagtcacgagaagaattacagtattccattaacctctgatcaccatgagatgaccatgctgatgtgatagcatcatacacatatgcagccttaatattagatagcgctgttgtgtattcttccgaagatggatctaaatcccacaatgccgcgaaataagataacgtcttaaacgtcgaagataggccgttttcataatcattgccagtagatttaaatcgacgcaataaggtctcaaacatactctgcaaattattgcatatgcgttcggtcttctggagaatatcttcnnnnnnnnnnnnnnnnnnnnnnnnnnnnnnnnnnnnnntgaactcaacttacgattgtccaagttcatggccactccaagaagcccgaagccaatctctggagcggcactggttgtctcagggacaagagccgacaaatgatctacaacatactggcccaacgctgtaccaaattccggcaacgtgaccgtgcgattctgggtcagttcatcttcagaaaaatcatctacatcaaattcagcttgcttgcgcatatcaagatagtaatttttcacatactgcaacagctgatcttgcaacggagattcctcagcccctcgtagccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatatgccactttattgggattgctattcaccagcttatcaaatatcggctctgtgaacttatccccgttgtctaaatgaaagtgcaacacccgttagattggaaattgcctagaaaaccagtccgaagggatgtcgcacctatgggagaagtatattcgcacctgtcggaagaggaacgccaggtcatccagatcgaggtaggcaacggcgccagcatacgcgggatcggcgcgatgctgggccgcagcccgtccagcatcagccgggagatcaagcgcaacacatggttcccgtccaacgagaacgagtcgtaccgcccgtaccggccgaaaagactgaaggcggggccatggaccggccgctactacatcgccgggcccgcgcagcgcaaggccgaccgcaggagatccaagccacgaaagccctaccggctgtcgcacgaccgcctgtgggcgcaggtggccgaatggctgggccgcggctggtcgccgctgcttatcagcggcaggctgcgcgtcctgtggccggacgatgcgctcatgcgcgtgtgcccggagaccatctaccgatgggtctactccagcaggccgcttcgggaacgctgggcgcggtgcctgccgcgagggcacaggcggcgccgcaggcacggcggcaggaggacgtcgcgcttcccgattcccggccgagtgcccatctccgaacgcccgccggaggccgacggcaggagcgcgttcggccattgggaggccgacagcgtcatcggagtgggatgcaacctgcacaccgaggtggagaggaggaccaggttcctcatggcccgcatcgttccggacaagaccgccggcgagagcgtcggggcgcagctggacatgttctcgccgctgccggccggcgcgcgcgtcagcgtcacgcacgacaacggcaccgagttcgcccaccacgaaaggctgcgcgacgggctgggcatggccacgtacttcgccgacccgtactccagctggcagcggggaagcaacgagaaccgcaacggcatgatccgccggtatctgcccaaacgctgcgagatccggatggacatggcaaaggaggtcagggagatcgtcgacgagatcaacaaccgtcccatgcgcgtgctggactaccggacgcccgccgaggcgttcgccgacgaactgttagaattacaggaccaacaagggtgttgcacttctaaatagacatcgggatccccttccggcaacatcttctttacagactgatagacgcttgtatacgattccctgttcaacggtttccaaaactgcaatggatcttgccgatacttcttaatagtagatagacgctgctgcccgtccaatagttggagcttcgcatctttatcgttatcgttctccggataaacaagtaaagtaccaaaggggtatccatcatgcagggtctgcacgaaatcttcctgcttcttttttgtccaaacaaaccctcgttggaattttggcaaacttatgcgatcgagttggtcaacggataattcgtcaatacggtatgaggacatcagcggctccttacgtcacgccaatgatctcaccaaacagttgatagatcaagcgtattaacagtcagactcagctttgtagccgaacggcggcggccattccgccgtcgccataggtggggtgggtcatgaaggcttggctggcggtggtgtcaccgcgcatctgtgtgtgatcgaataaaggtgttcactgtcggcacttgttcctgaacaccctgagcgttcaatttggacggtgtcggcggtgatggcgccggtggaatgagaacaccggcatcgtccggttccttggtagattcccgagtgcttatcaaccaaactgatggttctcgggaggaaaggaaatgacgacaccggtgtgtgttcaacagcgtatcaggcagctcgaccgccagggcttgagccacagggagatatcgcggaaactcggcgtatcgcgcacgaccgtggtcaagtacgccaaccacggggattactctcccaagccccttggctcggggcatgcgggcaggtcgctggtcgacgcggggtattcggccgtcgtggacgggtggctgaccgcggatctgcgcatgcccgtcaagcagcgccacaccgcgacgcgcgtgtacgagcggctcgtggcggagtgcgggttcacgggctcgtattcgtcggtgcagcgctgggtcaagcgctggcggcgggagcatcgcatggagtcggacggcttcgccgagttggagtgggcgccgggaagcgcgcaggtcgatttcggccaggccagggccgtgatcgccggagtcgaacgcgtggtgcatttcctggtggtgtcgttcccgtattcgaacatgcgctgggtggtcgcccttcccggcgagacctcggagtgcgtgtgccagggtttgctgtggatcttcgagcgcatgggcatggcgcctagggtggtggtgttcgacaacgccaccggcgtgggccatcgcaggccggacggcacggtcacccagacccgcttgttctccctgttctgcgcgcattacgggttcgagccgcggttctgcaacccgtattccggccatgagaagggcagtgtggagaacgccgtcggcttcgtcaggcgcaacctgatggtgccgatgccgtcggccgagagcttccaaacgctgacgcgcgtgtggctcgacgcgtgcgaacgcatcgccggatcggatcactaccggcatgatgttccggtgatcgaactgttcgaggcggagaaggaccacatgcttccattgcccggcgtgcggttcgacccgtgcgactggaggagcgtgaaaaccgacaagaccggcgccgccacgatcgacgcgaaccggtatctggccggaccgaaatggcgttccatgcgcctgcaggccggggtgcgcgtcttcgagatcgaactgcggggccccgacggcgaaacgatcaccacgctggagaggatctggggccattcggcgaaaacccaggtggatccggcgagcctgctcgcgatcatcgcgcgaaagccccgcatatggggcgaaagcccgatcaggaacgatttccccgaaaccgtgcgagccctgctcgaccgcatggacgcacgcacgcgctccaatctgctcgacgacatccgagccgttgccgccgactgcgggttcgctgccacggccaaagcggtggaaaccgtcatcaacgcgggacggaccgtcgaccgcgcggcgatcggcacatgtgccaaacgcatcctcgagggtgcgggaaccgaaggcgggcaggatttgaagcgttacgacaaatacatgaaggaggccgaatgagccagcaaaaaccgcggcagcgcggcggccgcgttcttgacaaggccacgccggaacaggtcatgggcctcgcccgcaacctgccgttgacacacagcgtgctcgagaaggccctggaggacgccacgcccggccagctcggcttcctggccaacctgttcgagaaggagaacgcgagccgggccgaatccaaacggcggcggctgctcaaacaggccgggttcccccagagcaagaccctggagggatacgactggagcatggcctcgtttcccgccgactggggccgcgaacagctggaaagcctggaattcgtcgaccgggccgaggacctcgtgctctacggcgacgtcggctgcggcaagacccacctcgccatcgcgatcggcatgctcgcatgccaacgcatgatacccgtgaggttcttcaccgcctccagcctggtcatgcggttgaggaaggccaaggacgacaacagattggacgccgagctcaagtcgataggcagggccgggctggtcatcatcgacgagctcggctacctgcccatcgacatcgacggggccaggcttctgttccaggttatcgcggacagctacgagacccgcagcgtcatcttcacctcgaacctcgagttcagcagatggggcgacgtgttcggcgacggggacatggccgccgcggtcatcgaccgcatcgtccaccacggcaggatcctccgcttccacggcgaatcctaccggaacaaacactccctcatgaaataaaccaaacaaacaacaaaacaaggaaccaaccgccgacggtgttcaagttgaacgccgacggtgtccagattaagtgccgaacacgtccacctcaatttgacgaaatacagccatgcgctggctgaaaagtacatgccgaacggcacttgcggcgttatttccttcctgcacgccgacgtccgcggtgaacgcgatgtcgtattcactcagatccggcctgtcatcgtcgtattcgatacccgccacgccctcggcgagcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggtcctcgctgttcgtgctggcctggccgtacgcccgaggatgggtcgccagatgcttgcccgacgagtcgaggacctcgacctcgagcgcgcggaggcccacgatcacctctctgcccgcgttcgcccggtccgcggaataacgatgccgtccctcgagcgtgaccacgccgtaccggtcggccttcatatgccgccacgtgaccacgtcgaaacgcttcccgggcaacggcagcagcgccgcacggtcctcggagaacaggccacgttcctccgtgtccttgcggtaatgcggtttcgtggccagctccaggcaccggtccggcagcccggcgttaaagttctccaggctccatacgctcggccggggcacgaacagcttgcgccgcaccatgccgaccttggactccaccgcgcccttctcatgaccggaatacgggttgcagaacgaacaatcgaacccgtaatgcgcctggaaggcctggaacaggtgcgtcaggcgcggctcgcgctccccgtaccccttatggcccacgccggcggcgttatcgaacacgatccgctccggcacaccgcccagccactcgaacaggttgcgcaacgccaggcacgtgcactcagcgttctcgcccggcatcaactgcaccagaccgacgttcgaatacgggaaatcaagcacgaaatgatgcatccgctgcaccacgccgcgcaacagcacgtcgacctcgccgaaatcggcctgcgcctcgcctggatgccataccagatccatgaacgcctcatcacgctccgccgcgaactcacgcctgagccgcgccaccgcccgcgtcaccgtggacagggagacctccgcgccatgctcgtccctcaaccgctcccagatcctggtcgcggtatgccgctgcttgcgccagttcgcgcgatcctccgcgagccactgctcgatcacgggcagatacgggtcgatcaccgacgcgcgcggctttctcaccgacggcacggccgacagatcctccttcgcgaggtacttacgcaccgtcggctcgctgacatgtgttttccgcgcgatcgacgcgacggattccccgttccgccgcaaacgacggatagactgtacttggggcatgctgatcataatcctttccggtcctttctggcggagatacaagcaccatccagttaagaccattccgtggtcggcatgctctgcctaaacccgaaaaatcatcgtgactaaacccgcaacaactaattgaacacaaacatgcgcctcgcggtcggtgccgtcgagggacgcggcgatcaccctgctgtcgctgacgtgcgggctgagggcatgcgatgtgatcggtctgaggatcgccgacgtggattgggattccannnnnnnnnnnnnnnnnnnnnnnnnnnnnaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgccgtttgcaggaggaagatgcggtccaaccgccaggggttggaatgttagtgtgcggattggcgtggttggaagttcatgtggccgttcgcgttggtgttcgtgttcgtgttcgtgatcccgattctgtacgcgatctacatcagcttcttccagaagcagatgatcggcggcacgaagttcgtgggaatcagcaactacattcgcctgttccacgaccagcagttctggagctcggtcggcagggtcgcgctgttcacctgcgtgcaggtgccgatcatgctgttcctgtcggcggcgatggccctggcgttggattccatgaagctgcacggcgcgaagttcttccgcatctccacgttcctgccgtacgcggtgccggccgtggtgtcgactttggtgtggggcttcatgtacggcgcgaagtacggtctggtcggctccctgaacgactggctgggcacgaacctcgacgtgctgagcccaagcgtgctgctcgcttcgatcggcaacatcgtgacctgggagttcaccggctacaacatgctgatcttctacagctcgctgtccacgatcccgcattcgctgtacgaggccgcctcgatcgacggcgcgggcgaatggcagatcgtcaagtccatcaagctgccggaactgaagggctcgctcgcgatcacggtgatcttctcgatcatcggctcgttccagctgttcaacgagccgagcatcctgcagaacatggtgccgggcaacgcgatcaccacgtactacacgccgaacatgtacgcgtacaacctgagcttcgcgggcaaccagtcgaactacgccgccgccctggcgatcacgatggccgtgatcacgatggcgatcgcgtacgcggtgcagctcaacagcatgaaggagcagatgaagtaacgcccggtggcgcgaaccatccgcatatagggggaagaaacgctaaggagcatcgaaaatgagtgacgcaacaatcgccgcgggcacggagcagaggctcaccgctcaggagctcaaagcccaggagaaggccgcgaaaaaggccgagaaggaacgcctcaagagggtcgcgcgcgacgagaaggccgagcgcaagagggctgcgaagtccggcttcgcgaacgtggcgaacccgcgcaggagcacgctgctgaccatcgtgtgcgcgctgttcgcggtgtactgcctgttcccgttcgtgtacctgctgatcaacgccacgaagacgcaggcggacttcacgtccacgttcggtctgggcttcggccgcacgttcgctttgtgggacaacatcaagaccgtgttcacctaccaggacggcatcttcggacgctggttcctgaacacgatcctgtacgtggtcgtgggcgccggcggcgcgaccctgctcgccatcatgggcgggtacggcctggcgaagttccgtttcccgggacgcaaggtcgtgttcgcggtgatcatcggcgccatctcggtgccgggcatcgccctggccgtgccgcagttcctgctgttcgccaagctgaacctgacgaacaccccgtgggccatgatcattccatcgttgatcagcccgtttggtttgtatctgatgtggatcttctccgaccaggccgtgccgaccgagctgctcgaagccgcccgcgtggacggcgccggcgagttccgcacgttcttccaggtatccctgccgctgctcgccccggggatcgtgacgacggccctgttcacgatcgtggcgacgtggaacaactacttcctgccgttgatcatgctgaaggattcgaactggtatccgctgacgatcggtctgaaccagtggaaggaccaggcgagcaccgctggcggccaggcgatccagaacctggtggtcacgggttcgttgatcacgatcgtcccgttggtcatcgcgttcctgtgcctgcagaagtactggcagtccggccttgccgcaggcgccgtcaaggaatga
